United States Patent 8,781,750 (CELL-TYPE-SPECIFIC PATTERNS OF GENE EXPRESSION) - sequence listing, part 4

SEQ ID NO: 35762 - DNA, 27049 bp, Homo sapiens
tgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtggtgagttgctgcgctggcctcaaggaaccacgtttagacaaacttcggaggcaaaggatgggggtgtctctccccctgccctcggcggtgggcacacagcgtgggggaggggcttcggtaaacagcttggggggtctttggcaagctattggagtgatctcttgcaaacggtgggggatcttttgtaagcaaagaaaacctttgataaacaatttggcaaccttcagcatacagcagtggggcgaaaaacaagccagagagtgggagaggggtgacctggcaaactactggaaagggactcttatgtaaatagcggggacatcctctagtatctgggacatttggcggggggggggggcggtctttgtaaacaacttttggacacatctgggcagttgctaagggctcttgccaagcgtctaggtaagcctttggcaaacagctacaggggtcgtttttgctaatgtaggactttgggaacggtgctctggcacacaatttgggtaaacttatgcgcgcataaggatgggagggagcttggtcaaagcggggcttggcaaatttctaggaaccttcggcacagatccggagagggacctttaaacaaacagctcgagggggccatttgggaagtgattggggcaggagggaagcagagagcgcatcttttttctcctggcttaatggacaaattggtcaagggctgggcctcggaaagtttcctcgaacttctccaaagggtcggagaaaagaaggagagagctggcccggcaggagggaggaggagtggggcaggcgctggagggcccggcgcgtggggcgggggcggactgcgctccgctcgggtcggagagcggccagagagccctccttcctggctgggctcccaaaccgcggttcagatgttgtcttgtgagcgtgcgcgcgcctggctggaggggcactgagcctggccgcagtgttgcgtaagtagggcctgaggagagaggcaggccagggacccatcaagatgtcctttccagtccaggggatatctgctcccttgttgcttcagccaccctgccctccagcctccccctcaacctgtccgggagaagacgcccatgccctctggtcaccctaggaactccttcaggaggtgacaactaccctctcccaactctcacccttccaaacagctaggtctcagccccctctggatagatgggttgggaaacctccatacatttttagagggctacttttttcaaggatctggagctggctggcataatgatgtggctgttgggtgggggtgagagtggagctttgggacaatgacaaagctacttggtttcctacaccttttccagccaatgggtcacaggatgaacccctaaattggggttcagcctgggggccacatgggttcttggcttgcacaggaaggaattcaagagcgagccaacagagtaaagtgaaaacaaatttattaagaaggtaaaggaataaaagggtgattattccatagacagagcagggaatgggctgctggactgagtatacatatggttatttcttgattatatgctaaacaaggggtggattatttaagagttttccagaaaaagggtggggagttcctggaaccgagggtttctctcccttttagaccatatagggtaacttctcaatgttgctatggcatttataaactgtcacagcgctggtgggagtgtctaatgtatttaacatgctaatacattataattagcatataatgagcagtgaggacgactagaggtcactttcattgcagtcttggtttgggtgggctttctccagcttctttactgcatcctgttttatcataggggtctttgtgacccgaactgtatatggtgaaatcagtcctaccaacctcctgtctcattctgtgactaagaatgcatgcctgccctcctgggaatgaagcacagcaggtctcagcctcatcttacccagccccccactcaagatggaggtgcctggtttgaacacctctgacaaatggaagtctgtgttgtccagaggcaatgcagtgggggcttaagaagataactctggacttagaccgcttggcttcaaatcaaagagtgcatgaaccaaccagctggcctagtgatgatgttaggcaagtgacttctcagtttcttcatctgcaaactgggaaatttcctatctcagggttaaaagagaggtaatcttaggtgcttacctagcacatggtaagtactcaataagcactagccattattctattatattattattattgttatgtcctccatttcccctttcctaactacttccaacaaggctaggaccgttgtcagaagatctcctggctcctttcaacattctaacacagtacttatcacatacttcattttgttttatttgggatctatcagcctccctgctaggatttgaaccttagagacagaattgtctatctttttcacctgtttttcctcagcagtagcactgggcttggtacatggtaggtattaaaaagtatttgttgaataaataaatgagtcggttgctccctgaacctctgcagggacctgctcagtttgggcctcagtttgggcagggccagttgtatgactcatgaaggacaggactactttctttttgcaaatggctgattcaggatttaaacccaggtctgtctactgccagagcccatgcacatagtccttgaatctctttagaagaaaacaggaggaaaaaagtccccaagtcaccagccgcaaggtagataaatgagttgatagaggtaaaggaaggatgctggagtataatgattccatatcacagcctctggagccagattgctttgtcccaaatccagatctaccatttgtgaactgtgtgatcgtaagcaagtttcttaacctctctgtgcttcagtttcctcctctgtataatagggttagtatatctacattacagagttttgagcattaaatgagttaacatattctgactttagtgcctggacatatagtcagcacccagcaccaacaagtggtagccatgctctctatagctgtatgtcctgtcgctcaactaatgggtgaccgtgctggtttgggaacccagtactccacccagtgctctgggacccctggcttatttcctgtctggactatggcactgggttggggggctgattgctacagcctgctttggtcagtactgtgccatcctaatgtggctaattgccttgggggtgtgcatttctttcagcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggtgccggggcagggcttggggaggcagggccatggggctgagggacacgagtctccttgacccatgcattctctccactcaggggatccatgaggtgtcttttgtgaaggcttgacatcttagggagtttcaatacacagttcttagaaaatgaagtcagacagacttgagtttcatacttgctggccatgagacattgggttacttttcagtgctgtgaatgttggctttccaatctacaaaatggggcttaaaaaatgcccttatatggtatgttggggaactaagctaggctgaactaatacaaacggcttctatgatttttgacacagagcaagagtgtagtaatgctagtcattgttattgtttttagatgaggtcattgggatgggcagaaggaacgtgatgattggtagctaattgggtttagcagcccaattgggttataactggttgctaattgggccaagagctgtgctctgtatgggtggtgctgggttccaatggtgggatctttgccctgtgccccataatgcactacttatggccctcccccaccagccagaagtgacagatggaactcctgagctggggcctaaaaatgttggctggcctgggactccctgggtcttcaaggcattctgggagggttgtccttggcagtgagccctgcccagcctacacacacatacacgcaggcacatgctcacatatacatacacatacctgtgcacccttcccgtgcttgtgcatatacttgtatgttcacatacacacacacactcaaactttttcatacatctgtgcacacacacatacttgcatatacatacacttatgcacatgcatacacactcacatgcagttctaccacctccaggatcattggctacacacctgatctggacccagagacagtggatgatgcctttgctcgtgccttccaagtctggagcgatgtgaccccactgcggttttctcgaatccatgatggagaggcagacatcatgatcaactttggccgctggggtaggcagaagatggggcagaagaggggccagcagggatcagtgttgagacgagggggtgagatggacattagaggggcgtggggatcctaagggcggcttagataggacagtagatggtgtgggccctgggggtggtttagatgggggcagcacaacacggagtggacactggagagccacgttgacatgggggcagatggtgtgttgtggtataacctggaggccgtctaaacccgaagcaagtggtctactgtgctgtccaatatggcagccattaggcagaatatacatggctgtttaaatttaaattagttaaaaattttaaattagtttcctggtcacactgggcacattttaagtgctcaaaagacacaggaggctagtgactattgattttggacagcacagacaaagaatattcctcttaatcacagaaagctctgttggatgatgctggtagacactgaggaactgtagatatatgagagtggtttggaaacagtggagcagtgtagacactagaggaagggtcgtagaacctggggccaggtggccatgtgagtttatggtgtgaacactgccagtagcacagacataaaggtatgtggtatagacactgagtggtaagtgatgaaggtaaagagcaggggaaacaatgtagacaagtgggtgggtggtacaggccttggtgacaaggtgggcatgaggattcatgttgcagatattggtgatagtgtgacatgaaggcaggattgtggttaagagggcagtattgacaggatggaggatggcatagacactggggatgatgaagatggggtgaggacactagtgtggtaatgtgggtatgtggtacatatagtgtcatggtggtagagtagacaatggaggtagagggtatggatactgggagtcatgtaaacctgggagagcagtgtagaccataggatggtaacaaccaggtcagcagatctctactgagctcctgttgacagtcctggataaccccactgggacaagggaaggggacagatgctgggtgggctgacaggctccacatgtagatggggtgtggaggggtttcagggtctaggtggcacagctagacgctaagacccagtgtgtgtttcagagcatggcgatggatacccctttgacggtaaggacggactcctggctcatgccttcgccccaggcactggtgttgggggagactcccattttgatgacgatgagctatggaccttgggagaaggccaaggtgagaaaggggccctctgcatgccccagaccttctctcctgtcctctctccactccatttgcttggaccagagaggtgggaggggaggaaagtcacacatctgggtgagtcagaatcttggtctccaaagaaggcctggagaagtccaacctcccccttccatgtcactctttagtggtccgtgtgaagtatgggaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaaggtgagcatccactctagtccccaagactttccaccccaagcctccagcttcccgggctccccagtgtgctcttccctccacactctccaggactggctgccactgccagttaatgagcatccctccaacgtccttcactcagttcccccccatcctgatctgagccattgctgtttctctcccaccagtaccatgatgaacgtagtactctaattaaatcaagttgattttttttaagtttcaccattagcaatcatttaggaagtcacagatttgatttgctaattatttatttctaatatatattggagtgaacttagaactattacaatgcccagtggttctctctagaaccagtctttacacttcagtcaagattgatacttcaagggcatgaggaaaggcttgctggtagctggaaacctagcagtgtgatagggaggcaggactcagaccagggctggactcaacctggtttgcgtactccaactgaggaatttcagctattgctcctgccttggtcctgatgctgcctctgctaatgcgtgtgtgtgtgtgtgtgtgtgtgcctgtgtgtgtgtgtgtgtgtgtgtgtgtgtgtgtgtgtgtgtgtctgggcacgggggctatactatctgcctctcttgggcactgtctttttctgcctcctgtctagcttgtgtctgcatctctgtgtcttgataaagactttaggcttgactcagtatttgtgtttgtgtgcttgtcagtgcctgagatgcaacatttcagagattttgaagccacatgggggaaatcttttaaaatggggtacagatattgacatacacactcaatcctttttaaaaatatccttgacacacttaatagtcataaatcacaaaaagacaatgtaacttcatactctatgaagtcatcatatttgataattctgcagattgaaagcccagaaaacctggcgaaaatggaaaaaagtctaaaaatttttaacactatcttctttcccatgtcacaaagactctatagtctacatagactaaagactgtctttttgtctgtaattttatgtctgtgaatctccctaaccccactgtaactgaaaactaagcaccaaccatcttgacagaatgaaagaaacaaagagctagttaattcccttcctgtttatgcttttactaccagagctaaactttatattaagtaagagtttaagccattcaccattaataagtcagacattttgaaataaaaatattttttgtatcttgcgtttcccggtagggattacatgtggcgttaacccttccctgtgtcacccctctgataggaacagaaagctttggtgatagttagatgtggaaacagctgtatttcataaatttgggaagggttattccctgcattggacattagccatttactttgtgcttagccagatgcaagtacgcacaacacgcacgtgtctgggtctcgaggcagagattgttgttactcagcccctgctgatggctgagtcagtgtctgattcttgccatccttgtcaggggaatttgggaggagacaggggcttcctgggtggtagaaatgagaggtcagaggcagggggctggcattggtcgaagttaacgctttgcctttctcaactctgaggccactaaggtatctggactcagtcttgccttttctctaggtgccattgtttctggcattgcaggacaaggtcttttggtagagaggggagtggtgaggatacagggcctcgagttctgtggtgggaggccagggactgggctccattccggccatggtggagttaacgggggctggtgaggtcacctctggcgccgttgtgcacagatggtccttgttatggacttgtggttttgctggttggcaattccagagacaccattttttagctttgggtggatgaggggaggatggggagaatccaagacagacaggccaggctctgaaccccactccctcccccaactctccatttatggcccctgtcttgaagatgtcaaagtaggagcccagagtgtttagtaaaagggacctgaaggcaccacctccctctccctccctcctcctcttcattctttctctccttcctacagagactgcaacaaggccatccaggaaggggcctggggttgacaggaggtaaagcaagctttctgtgtatgcgtgtgcacgcacacacacatatatgagagtgacagactaagcaagagagattgagattagtgtgttttgtagtttttagttacaaccttcattcacttctttcatttctgtgaccatgagcagtttgagaaccatctttgtcctagccttgatttctccacctatcaaatggagagagattctcgtggtcctgcctgccatgactgatatattcatgtcatacatcattattacatgaaatttgcatggtacaggtgtggaccaggcagaatggacagtgcccttggggctgaggcagggttctagaagcccttgctgtgtgccaggtgtcaatcattttgttgttgggtggtccacaaggtcccacgggagggattgggataaccagggaagcaggggttctctctgggagctcagagaagcagctccttaccaaccagtagagatgttttcttaatattttaacaatgcatcaacttcactggtgtgaaccggcaggtgggcagccagccagccctgtgcccatggaagcatgtctcattcacatccttccctctctcccccacccttagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccggtgggtgccactccctctccctccctcagggcccagcacctgctgtctgacaaaaaaaaaacccataagactccgagtgcccacctcctttccccaagacaggggtgctaagacatctgtgcgaatgacatccacaccaagatgtccgtgtagctagtcaggatacttgtcacctggtatggcctgggcactgaaatcagaacagacattgggcatcaacagttgaattggtgacacttaaatgtcaggcctgctcaggatcctctgaccgacctgcatcccttttctctcaggctctctggcagagacttctctctcctcctctctgaccctgcaatctctcttccctgcctttcctggtctgtatctccaccttttagtctgttttttattaagagctccgtgctttcctccctgtctccttcctgccctcctctctatccctccctcctttccttcttcccttcctccaacaggaatttactgagcgcctgctttgtgcagcatacacagaggttggtctctgcaaagccctgcccaagggggctcacagctgaggggcatgtgctggtgccatcagcttcatccaactccctttgcccctagcccatctgcccccttccatgggaggctcattagaactctggaatctggcttcctgggtttgaattgcagctctgatacttcctagcagtgttggcttagggaaatttcatcatctctctgatctatttcccatccatgaaacgcggtgctattcagtccctcctgcacaaggctgttgtcaggggtgggtgagatgagtctaaagatacagtgcctgggactgagtctaacttaggtgtggttcattaaggtcagcgtcatgtcattgcttcctggtggtagcctcagactctttgctgcgccttgacccgtatccctaaccccacagccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgatgaccgcaagtggggcttctgccctgaccaaggtacgaggccctggtcattggacagagaccctggacattgcccttgcccctaaacttgctccaaaaaccttcctgagacctcacccacttcaagcatagacactgccccccagacacccacctacccagacccgcccacctgggctgagacaatgcccatctctggtggagccaaggtccctgcttagatcctgcccatccaggtggaggcacagcctccaaaatcagaccctggtagaccagatgctgctactcacctcctgggtaagaactggccttcctgaggggtcactgctcttgtcttccccttcagccaccctccaggcgggcttgtgactaccaaaattggctgaattctgagcacagattaccagagagacaattctcctaagagacattcccactgcacaaagaggtgccttcaaggagctggtaggcagtagaagaaaggaaaaaaggaagagcctcatgcttgatctgacaccatggtccacgcagccctgggggagcccccagagccctctctcccccatcagtcagcaccatctgttaccagggtgtaaatggtgggtcctcgtcagtcctgggtgctgaggatggagctgactgggacagctctctgccccctaggactcacaagctcaggggagagagtgaccaggagacagcttgtgaccttactatgtgctcagtgcagtgagcagggtgcttggggccctgtgcccaatctaggctacagagcccagggttgcagggttgcttaaagctccctgatggcccataatggccaggtcagtgggcaggtccagggcctgtcagaattaggcaagcctgtctttatgttgctttcattctttttaatcatcatgagatggaacttggcagatgtcagtggacagaggctggccaaaggaggttttcttatcccctgctaaattccttgctaggacacagtctgattttaccagcttaaaggtgggattctccaccttcctgagtggttcaagtatccagagctcagtggctcacccagggtgaatattatagtctcctggggctgccatgacaaagtgccacaaactgatggcttgaaacaaaccccatgtattctttcatgcttctggaggctggaagtctaaaatcacggcgtcagtaaggccatgttccctctgaaggatgcgtcactccagtctatgcctctgtcatgacatggatggccttcttccccctctgcttgcctctcctccttttttttttttttgagacggagtcttgctcttgcccagctggagtgcagtggcatgatctcggctcactgcaacctctgcctcctgggttcaagtgattctcctgcctatttccaaataagttcacattcacaggtccctagggttaagacttgggcaaatcttttctggggggacgcatttaaccacaacagggtgtgacacaggttttgctcgctggctgtggctcagcctgtgcaaccacgctaagtgtgaaaggtttttactgctttcacctgggcagaaatggtggcaacatggggccagcctatccccactcttcttacctcttcagagaggctgaggagctgggtttgtagagctcatcttttatagagagacataaaaagccaggaagcaggattttaaaatgaatggggttttaagtagaaaattcgcagatactacttgttctgttcctttatagcacacctgtcctgatactgacttggaaagagacaagaagactttggctgaccccacttggaaacaataggcactaatcccaaaattgtgtattgatcccagaattctcaggaaaagaaaaaaaaaatcaatacatgccgcttccagggttctcagccttactgtggggctgtcctcaaaagtctgcatcactgggtcaggtcttgacttctctctcatctctcttcctgtctttcaaccctctctcctccctgcaaccctcagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggtaaacctccgggcgggggttgggggtggagggtgaggaggggggaggtcatgtagcctgggatggaggcccagggggtgggaccagcaagatctcatccagccaggagtgctggagacgagggcaggaaatgggagtgttgacctggtcttgggaaggcagagcagctctccaaggggatacttggataactcttccctatccgaacaatgctaatatccatgtcactcttagcgctccatttctgggtttctcccattttctaggtgagtaaggtcacctggtgcaaggttacacaggtttgagcaacccagtggagtttagaatccaggagaatagccaagtacaggacagaattttccatcatgtggaatgaccttaacaatacgggggtggaagtttctagttttcataataagctttgatttttagtatgtagtagaaacagaacaaccagtgccttaagccaattatttatttatttatttatttatttatttatttatttatttatttattgttggttcttacagtgaggctagagtttaaaaagtcagttcatttttaaaaaatatttaatggtccaggtgatatctgagccaggccaaaatagtgaaagtggtgcttgagtgatgaagtttggggactgctagactcaggaaaaagcccaaggtctgccgtgaggggtgctgggttcaaatgtggcctctgcccttcactagctgcaagatattgtgtaagtctttatacctctttggactcagtttcctcatctctaaaataattgcttatcatgaaaagtgccatactgtcagttctggacacaccagcggccccctgaccgccctgactcttgtgggcataagaatctgagctttgggtttgaatccttgggcaagtcactcaacttttctgggcctcagtttcctcacctgtgaaatggtgcaatcatgataccccactcccagggctatagagaggactgatttgggtgatgtcagtaaaaagcatatataaagtacaaagggccccaggactccccaagtccaggcatcttcttgttaccttacggagcttacactaaggccagaaggcgatttcttctgactcttagatggttgggtgggcacccctgggggctcaccctagtggggagaacctctggagctgcagagagtctaaggtcaggtgttctccccaggggcctctcctgacattgaccttggcaccggccccacccccacgctgggccctgtcactcctgagatctgcaaacaggacattgtatttgatggcatcgctcagatccgtggtgagatcttcttcttcaaggaccggtgagtgcaggagcttgcttcttgtcctccttgtctcctgtcctctgctcttataccattattcttttccctcactcttcgctgaagactccgccaaatgcttcccagaatgacctgaattaggcagtttctgctgtgtatcaaacaacctccaggtttcagtggatttgcacccaagcattttgtttgctctctcatagtctgtgggtctactagttatcttgactttcagctacagtttgggttcaggtgtgctctgcctgttgttctcatgggattagcagctactcatggcagatgacagggtgcaagaggccaaactgaactacacaagctcatttaaagcctccactcacatcttgtctgagaatattccactgcctgaaataagtcacatggccaatcccaagacctaccctagagggtagtactgcaaagtcacatggaaatgcatatgaatgcataatcctaaaatcaaaatggagggaagaattgggaaccataattcagtctaccacaggccttctagaatggcgttgccctcaaatggccaaattactctgtgtatgggtggtgagtgactgcagagtagaaagaggtggtattcttcatgctatagataaagatcaccactcagttgactaaagactgaggtttaccctaatgccctagttccctggagaatggcaggcagtatctaggacctcattaaagggtctgtccttccattcttctatcatccatccatctacccatccatccatccatacctatatctttccatccatcatccatccagccagccagccatctattatccattatttatgatccagccatccattattcattattcatccatttattcattcatagagtatagtagttgagaaaatggactctgaagccagattctctgggttagaattctgtaactgctacttactggttatgtaatcatagacaagttaattaagtatcttctttgtaccttggtttcctcatttataaaatggggctaatattccaacctatctcctagggctgttgtaaggattagatgaacttagtgctgagaacaaaaacaatgcctgacacagagtaagtgtattcatattagctattgttattgacaaataattgtttggcatctactgtgccaaatactttgctaggctttagtagctggaggaggaagaatgatgttctcgggacagtggggtggggggctgctagatcagtgttctcaaagacaggcgcatgggcctcctataacagaaccatctagagtgtgggtattaaaaggtgggttttctgccccagcttcagaccctcctgactggaactctggggctaggccccaggaatctgcgttttagcaaattctcccagtgattctgatgcacattaaagtttgtgcatcacaagtccagtttgagaaataggcatggagaactgacatggcaagatgaaagaaaagtgatcgcagaggtgttaggtgcttttgtgagcacgtcccagtcaaggaaggcttcacagatgcagcagcatttgagcagagccttcaaaggagaagcaagaatctgatgggggtgacaagttaggaggttctttgagacagagggacctgcagagccaagccatagtgatgtgaaagtttctggattagccagtgagaatctggtgaggctagaagatgttccataaactttcaggaagagtttcctctactctaggcactgggccaaattctggggtgcagatgccttgcccttcacagggtctgctggccaatggggaaatggcaagaatgcaatgagagatgagacttagaatgtagtgagaaatcaggtcccgtcaggcctcgaatgcccaaatcaggatatataacagcagatgtcagcactgctctgcagttcccattgtaaggatctggcaatgtgcttcatctggagctcctcccactaagaaagccctgaccacacatgcagatctcagatgtgtggggcctaggaaaggatgcagagcccagacccaggctggagccatccctggcctaccacatcacagttttctttcaaaaggaacgtgatgagtgtttaatgggtttatttgattaaccagtaaatattaaacttcaaccatgagcaaaaattgctgctaggcactggtgagggtgggggtcatgaaggacagtattgcagggtgattaaactcagactttggagtcagatctggatatgaatcttggtaataactaatttatttagtcattgatgtagtgataactaagtaatttgaatcctaacctctctgagcttcatttgctaaataaaaattgtgacaccttcctacgctaggatgtttttctgcaaataacagagaccatccctctgcaaactcaatccagcctaaacagtagagagaaattgctttcatttggtacaaagtccaggggtagagctgcctgcaggggcagagagagggtcagtgacttgatgtctttgtccactgctagcctctgcacttacttcatcctaaggccggttctacctcatggtcacaagaaggttaccagtggcagttggggctctaatccctgccctctcccaggaagcgagagagaaagagacacgcacagatacacacacacagacccccagatgtgaaatacaagtctgtgtgttccgtctttacaccactgtaagtcatatggcaactgctgaatcagtaacagtgctagggaatgctaaactctgattggcttagaccagtagttctcaaaccttggcatgcgttagaatcatctggaaggcttgttaaaacacagattctgggccccaagcccagagattcttatctgtagatctctgtaaggacccaatcatttgcatttctaatgagttctcaggtgacgcagatgctgctggtcaggagactgcactttgagaaccagtggcttataccaatcagtatctacccctagaatgggggtaggggacacagggtcagaggaggtgaaggctggatcataaatgtggagttttgtgaagaaggatggtggggaaatagataattaatgctaggtagaccatccagagtgcatgctgtcttaaaagattgtggggattaaattacaaggcacataaataaagcacatggcatttagtaggaccctcaataaatgataactcttactcttgacaaagtacacaaattcatttcattttaattcaggaaatacttgagtgtcatcagctcctgccccaattggcctctaatcaaataggagagttaagacaaacagacactactgttccaggcactcagagttgatgattttgagaggcttagagagggaaaacacaatatggatggaggtagtcagggaaggcttcctggaggaggtagagggagagaacagggtaggaggatgtttctcagctccagcagattgcagacaggaactctgcccgttctccagtccttctccaaccttcctttgatcctgcctcccactcccatcatggaatcatctctgggatgtttctgggtgggtttgggggtgtgtgtggttcgagctgcagggtgactgaagatgtggtttcctgtgcccccttgcctcctgccaggttcatttggcggactgtgacgccacgtgacaagcccatggggcccctgctggtggccacattctggcctgagctcccggaaaagattgatgcggtatacgaggccccacaggaggagaaggctgtgttctttgcaggtgtgtgggaagcacccttccttggccctcagctccacagggctctgcaccagggctcctgggtgtcccaggctcactccccctctcaaaccacagttcctatgcacccgtgggtgctccctttcctttatggattcattctttcaacattatttcctgaagtgcgcagctcctctgggagattggttccgacacccaacatcagatagcattaaccctcagtgtacacatttcattttcttaattcttttcaatccgtctcatttcttttctagaagaaaaaaagtctcagtttagtgctggtgtgtccctaacgcctttgtagtgatacagtctttggcaggtaacagttttagttcgaatgttttaaagaatatttgttttcatttttacttttagacataaattggttttaacagaggcagttagttataatagtgtggagtttcaaatcaggacagaaacggattattcagtaactgatattttgacagtcaaaaaacattttttaataaatttatttttaaagatttcaaaatgaattcactgaaagcagaatgttaagtaaataatagtacagggagcccctagaagtggtagaaatcatcaaggtgaggtctgtatggctaaggtttactcatttaacatttattggagcatttccatgcgctgggctttgccataccctggggatacaagctctgccttcgcgatgctcacaaaccactcagggagacagacagctgggctcttatgaggggtaaagaaggatttaggaggtccctgtcctggtctgaggtgggatcctagagaagataaaggctcagccaagactattgtctccaccacctggctcccacctcccccaatccaccgtaatcatgggtcccggagaggacaactgctggctcctagggcacctttttgcaaattagcaaaaggtgcctctttatgacagcaaggcccttagagtgcacgacttggtgagcagagtgtgagctggatttatcccccaactcatgtccttgaccaggcaccttctgtaattgacttctaaagccctctgtgtgagccctgattctgggcactgcaaccaggagtgagcaggaagttgcactctgttgggaatggctgcagtggggcccgtggacagacagatgatgggaggaacaggctggcctagggcatgtcagcaccagccaacacaccctttgcttccaccccagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggaggtaagggagggcggtgggtaggacagcagcacagttggctgcgagagacagagaagccgccctgaggcttcaagcctcctgggctgagttcagaggttggtgggctctggatgccctctctctggtatctaacctctttggtctctggcacctctgagatgttgccaaaggtgaaccattcttgtacacattgctgatataattctggtggaatatcctttctctttgcagaattcttttgattggcccatgtctggtctggaccctcacattttgaaatgactcactgaagaagggggtaataaaaataaagataataactgctcctattgacactatgtgtcagagactgtcccaagggttctatgggataggaattattattcctcccattttacagatgaggaaacctgggttcagaaaggttaggtaaccgtggctgggcacagtggctcacgcctgtaatcccagcactttgggaggccaagatgggtggatcacttgagctcaggagttccagatcagcctggccacatggtgaaaccccatctctactaaaaatgcaaaaaaattagctggacatggtggtgcatgcctgcaatcccagctactagggagactgaggcaggggaatcacttaaacctggaagacagaagttgcagtgagctgagatcatgccactgcactccagcctgggcaacagagtgagactccaactcaaaaaaaaaaaaaagaaaaaagaaaggttaagtaaccagcttggagtcacatagccaggtagggacaggttgggatttgaaccctggcattctgtctcctgggaaaacatgttagtcttcactcttcactactattctatacccgagatggtggaatgggggttccaagagatgggggaacatgaaggcagtggacaaaatatgaagaagacttagagatgggtgcaccagtcatccatagaagccagcatccaaatcagaccccatggaaggagcaggtgccctgtgtcatgctcacagcaggcccgtggctgtgggtgcaggttggcaggggaacaatttggaagcagatggttctgtgctccaggttatctacaggaaagggtccagttctgaggggctatagtcatgaccagggaacctaatatccaggagtggctggtgagaggtagcccaaacctcaggagtttgactgtaattcttcacactttctagaaaaggaaacggaggtccaaagaaattaaataacttgttcaagctatagagatatgtgtatttgcacaaagccaggattatagctacttctcttgtattctaactgagtaccccctccactatacctgccagtccatttgattagtgaggaaagagtggtcggggcacaaagacttgtggtgtgtctttccatcccctccctcctggtatccccacattccttccatggctgccactgcatctgggccctacccaagaattttagagggcacttcctgaggcctttgtctgccatccccaaaacaatcccgcttacttcctaaggcctctgtcttctcccccttccctcctccccactactctgccccccagctgccctgcattcagaaactctttatatcccaggcctgcccatgtcagggtggaattccagacatattgctaagacacttagcaacctaagctgattgatatctcaagcctcaagaaagaaaacagtcaggcaggaaaccacagagcaggctttccacccaccagctccagacactagccccagacagtgtgcacgcacacgcacacacacacacgcgtactgcgaatggcatctcagcattgtaggagccctgaatctccaagtcttagaattgtggctggtgagccgcacagactcacagaaacgtgaatcttagaatcctaaagccctgaagttttcaaattatggtgttggaagaactttttaaatcacttttccatgcactgtatctatgtaaacatgcaaaaacagacctgttcctagcatataggaacatgattgtgtgcgcatgtgcgcatacacacacacacacacacacacacacacacacacacacacacacaggcatggaggttgtggcagtgccttgctggatttccaggcagagttatttgcctcccagtccttttccacacaagcccacctcccaaagccagagccaggacagacagcgtgctctacagaggaaccaccctgagacttcctgaaaagggacagagctgaagggcctatcagaagctctgggctggcttccaaaggagacagatctctattccaagagaagtggtgaatgagcttgtgacactggccctgccgtggagtctgcagaggccccagaggcatctttgctggagaaggagagagagccccagagtgacagaggctgagcagctgtcttcagcatgccaagaagagctcaggccctgcttgtagaagctttcactaagccacaaatatatgttccacatctgctgtgtgccaggcacttagctagctgctggagagacgggggtcaaaaaatcatcacaccctgccctcatgtagtttatagtagaatgagggaaaattatgtaaacacatttgaatcagataatgatggctctcagtatggggcctctaccatagcccagcctgaggctatgcaggtcacctatatttctcagttgaggtagatactgttagctccttttcccaagtgtggaaactgaggctaaagtggctcaaggaaaagctgggacacaaatatctgtgttcttaacacctgctatacatggcaacttctacagctgcagagaagtaccacatcttctgacaccacagtgcttgtattctttctggatgaaaagaacttggaagcaaactaattctcttatctgagactcagtttcctcatctgtaaaatgggcttgacttctgccatccccaccttctgtgggtagaatgagaaagaaatgagggccagttcaagtgtgggacacacatctccaaactatcctaacgctagggaatgtagtttgagggctcagtggaggtgccttggatgggagtgttgggattttgagctagggaacttggttttggtgacccagggcatgaggaagcatgccaggttttgtaagaatgagttttatgctgcacctgggattaaggaaggcgttagttcttcggggtgatggctgagggagaagtccctttgagggagaagtctcctctagaagggagcatatagggaaagctgctgttggggtccagggtggaggtggtcaaggctggctgcagaaaggaagggagccccctaggaggcactgtggagcaaaaggtggctgctaccaggatgggatgcgaacacagattcatctagaaacagctccacttgggcaagacttgtttactaggatatccatagctcccatagtgggagctcagtaaatatttatggaataatgaagtggagaggcaaaggaatcaacatgacagcagcatttaaaaagttctccaaaaatcttaaaagacagaaggattgctagccagggagaagaacatactaaccgatgcccaaagtatttacctgaattaaaggcggggcccaggattgctgccgccggaactgaggtggcatgtggcccaccctgtgactaacaggccttggacttacacgtaccttccaccttgcattgtaacctcactgccccagccatggtcatctcccagggcagggactgtcatctccctgtggcagatgaagaagcagcaatttttccaagccatgaagtgaaagaatgatggggcagattcccatccctgggcttctagtttagcactcctcggattacagcagggatttgtttgtaagggagctaacatttcttaagtacctactaaatatttatgagacatggggatagaggctctgcatgtgctgttttatttaatgcatgcattaaattaaatacactaaattagacacaaccccattttacagctggtaaaactgtagctgtatggaaagtggttaacacactgtttggcatgtagtaagtgctttataaatgttagcagtaatcatgagattgtttttatggggtcatccaaagtcatataattaaaagtggtagatctgaggctcagactcaggtctgattccatgcccttccttccactgcagctggctgcttccctgaagggctaggtccagtttccgaggcctatccaggagccatcagctgggtgctcccatccaggccaggggggaagtgtcctttagagaggccctgctggttcactgtgtctgtttctttacagatacaatgaggtgaagaagaaaatggatcctggcttccccaagctcatcgcagatgcctggaatgccatccccgataacctggatgccgtcgtggacctgcagggcggcggtgagccacccaggactgtctccgctttctaggactccccgcccctagccagggcccagctccttgcaaatacacacttctttattgtgcagggcaggcaggcaggcggcgcccaggaaaacaaatcaactccttcatcctagtgctgggaaggtttccagatccctgacctctgctccttggcctggctccaggcagtaagacccagaaagacttctcacagctgcagggcctggagccagggcaggggagggcggaaggcctgggccaggggagaaggaacatgggctctgtgccgtggattcattctggggtttgatccaggcccatttgcgttttgcaggaggcctgtgaccacctcccattagcagaaggatggctccatttgagacaaggcaaactttgtcatgctctgttgctcatgtggcaaagatcctccactcaaccagtttgcccctggccccctgctgattaaaacacaaccagtagcagcgagggatagaatttggagtttgaaaatcatactcttgaggaggcatctgtgagctttctagggtcctggaaatgggtccagtttggctttttttagaggagatttcaactaaattccacagatttttttttttttgagcacctactgtatgctaagcacaggccctgacctccagtagctgaaggtcttacatgtccaagaaaatgcagtgtacaatcagatgctagattaggagttatcttcaagaataaacatctattgagcacctactacatgctagcatattaatagtaaatgagattatgtatgtcaggagtcacaaactccaacagctccatgtgtcaggcaggtagcacaaatgagtaaagcaggcaggggcagacagtggggaactgtggagtctgtgcggaatcagagcacatgcctcatttacaggagacactttcttctcaccttcagataattattggcgggcaagattaggggcctaggcagctgccatggttcacacctgtcatcccagcactctgggaggccaaggcaggagaactgcttgagcgcaggagtttgagaccagcctgggcaacatagtgagactctatctctacaaaaaaattttaaaaaacattagctacacatgacggcgcatacctgtagtcccagctactggggagggtgagcagagaggatcgcttgagcccaggagtttaaggctgcagtgagccgtgttcatgccgctgcattccagactgggtgacagagtgagacctggtctcaaaaaaaaagaatggggcctggtgttgttagatattctatattagatattctagtttttttaaaggaagccagaaatctgtacttctgtgtgactttttggatgtttacatgttggcaagttattcagatttaaagacaaaacaaaacaaacttgtgagagtcaaataaaacccatctgtgggcctgacaggactggatatatcctgttttgccacctctggtacatggaatgtgcttagtttgatgcttgtgttaagtggagttattgtttttaataatagcatatgttatctgacttaatgctcactgcaagccctagaaggttgataatctttatcctcatcttagagatgagcaaacagggaataaaagagcttatttcacagccatttcccttcttccactcccagagggggctcttctgggcttttgttgtgttttggttttgtttttgttttcttttcttcaatcagctcagattgaaacaattgaatttttttttttttttttttgagacagagtctccctctgtcgcccaggctggagtgcagtggcgcgatcttggctcactgcaagctccgcctactgggttcacaccattctcctgcctcagcctcccgagtagctgggactacaggcgcctaccaccacgcccggctaattttttgtatttttagtagagacgaggtttcaccatgttagccaggatggtcttgatctcctgacttcgtgatctgcccgtctcggcctcccaaagtgctgggattacaggcgtgagccaccgcgccccgccacagttgagttttttttttggcggggggacaaggtcttgctctatcacccaggctagaggcacaatcatagctcactgcagcctcgaactcctgggcttaagcgaccctcccacgtcagcctcctaagtagcttggactacaggaatgtaccactatacccagctaatttaaatatgtttttcgtagaaatgggggtctctctatgctgcccaagctggtctcgaactcctgggctcaagcaatcctcctgcctcagcctttcaaagctctcttctcgtttaaaagcttcttccctatgccaggcagaaattcaaagttcccaggaaccttctgtgtgccagaatgtcaggataagggggtcacggtctcttctttctctatcccaggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggc

SEQ ID NO: 35763 - DNA, 196020 bp, Homo sapiens
gctgggcggggccgggaagcggcagtggcggctacgcgcgcgggggtgcgcgcgggaacgaccgggaaacaccgcgagggccggggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaaggtgggttcgcgcgcccgtgggggccgggagaccacgcgaccggggccggaggcggcagctggcctcgcgggcctcgggccgcccctcccccccgcacgccacgagggacaacaaaggcaggcgccgggcccgccacgcccccgccgcccgctctgggcgcccgcgatcccggggcctgactggggttcggggctctctcctctgagcctacgcacccatggtgaaagcccctgctcagtctcgtgtgccagagcaggtcgagctcagccactaagcgagtgtgactctctctcttttgtcagctgccttaggtgtgtgaacaatgatccctaaagaccgagcaagcgtggtaaaagcagcttcaagttttgtttagagcgtattcaaagtctcgagggggtttgctacctgttgttgaattgctaaacgactgggatgattgtattcgttaattaataacaggcaatatgaattctaggatggatgagaactattaacgacggttctacctcatcgtgcttctggttctgtgtggcgtgagagttgatggtcgcttgtacgtaaagtgttctaaagggaggccttccccaagaacccagtttttattagagcacttttcttgtgtcacctttattttcttcgtagtgtttaccacattttgaaattattcatttactgatttctcctacctttggaacggaagttccgccgagtcagtagttttcaaagttttgacttaatcctttgtttataacaaatgttttttttttttccaacttcccttttgtgtaaatattcaggaggactcccttaaagggtgtaatgaagcaggtagccgaaaaggctccccagcctctgaagttttcctatcaccctctttagttctgtactttctcctattgagaatcatagcactgaagcaagggctttgttcactgcagtgtatccgggaacgtggctgatacttattgccttacccttagtggctgcttagtaaatatttgttgaatgaatgaaaacataaactagtttaggaacctatttttttggcctcagcagctcagtgaagcctgtcagtgtttggcagttattaggcatgggcagggatcttgggttcctttggcattacacgtggtacattcagaaatgaccatttctggccgggcgcggcttggaaggccgggcgggtggatcacctgaggtcaggagttcgagactagcctgaccaacatggtgaaaccccgtctttccaaaaaatacaaaattagtcgggtgtggcagcacatgcctgtaatcccagctactcgggaggctgaggcaggagaatctcttgaacccaggaggcagaagctgcagtgagccgagattgcaccattgcactccagcctaggtaataaagtaagactgtctccaaaaaaaaaaaaaaaaaaaaaacaaaaaaaaaccaaagacccagaaatgatcatttctttctttcttgtttttgaaggtcagctagaaaaattacatttcttatctgaagtttgaggaagtgagagacagtaattatatttttaggtgtctggacttttcctcctctgaaattacatttagactgtagatttttagtaatattgccctttcttacacagtgataaattggtcactttttaaatgtaagtaatagagcttccagaagtggctaatggaattgaatatgttatgaaaatattggttaattcttctttattacattccttttagccaatgctttgggtcttaaattcagtgaagctttaacaaagaaaaataatctacaggcatattcctttgaataatatcaaggaagagagtagaaaaaggcaaatttcagtaatttctacctctccgcactgttcagtgtgcatcagtttgggatcaactacaagaagctttagacatggataatccttcgatatttgtttgggtgggtagggaagtggctacaaagcagtttgaggaattgcccagcagtattgagaccactaggctaatgttgattcactatccctgagactttatagacaaagttacctttgacttctcaggactttgtaaagccagagtgtatttctagggtctactgagattgagaaacgtatataccctaggcctgacagccagaatcttttcagtctctgggtgttagcgttgaagtggtgaaaatattatcacaaagttctttgcttcttttctacacagtgcatttctatttggtgtacgcattggttttaactaaccgtttctagtgcatttaatactgcattttcagagcagacaacagtttcagtctcagtaaacatgattttgttagtgtcattttttatttatttttattttactttatttttttgagacagggtctttctgtgttgcccaggctggagtacagtggcgtgatcatagctcactgcaacctcaaactcttgcattcagctcatgcattcagtgaacaactgagcatttaccatgtgccgggtacttaaagtataactcacttaaagtcctcatagcagtcctaaatgatagatattatttaccttctttttcaaatggaagatacctgagacttcatttaggaattttcttttttttttgagacagggtctttctgtgttgcccaggctggagtgcagtggtgagatcatagcacactgcagcctcaacctcctgggctcaggtgattctcccacctcagcctcctgagtacctgggactacaggcacgaaccaccacacctggttaattttttgtattatcagtagaggcagggttttgcagtgttgcccaggctggtctcgaactcctgggctctctgcctgcctcagcctcccaaagtgcagggcttacaagtgtgagccaccacacttggcccacactgactcttacttgaaatattttgagactaataaatttttgttttcttaaataaaatataatagactttttttgatcaaaagattaattgggccaggtgcagtggcttgcgtccgtaatcccagcacttgggaattccaggtgggaggttcatttgagcccaggatttggagaccagcttgggcaacatgatgagaccctgtctcaaaacaaaacaaaacaaaaaaatacatcagttgtggtggcatgcacgtgtagtcccagctacttggctgaggcagggtccttggaggatcacttgagcctaggaggtcgaggctgcggtgaactgtgttggcaccattgcactccagcctgggcaacagagcgagaccttgtctcaaaacaaaacgaaacaaaacaaaacaaaaaacaaaaacaaaaaaaaaccagattaattgtttatgacatagaaattaaaatttcttaattaggagtcagtgttttttttgttttttgttttttgttttttttttttgagatggagtctcgctcttctgcccaagctggagtgcagtggtgtgacctcggcctcccaagttgaagtgattcttctaccccagcctcttgagtagctgggattacaggcacccgccaccacgctctgctaatttttgttatttttagtagagctggggtttcaccatgttggccaggctgggcttgaactcctgacctcaggtgatccgccagcctcagcctcccaaagtactgggattacaggcatgagccactgtgcctggcctacatgcattttcatgtttggtaatttggtaggatgatttggaaaaaaaatctaatcagaattaaatattttatagtttattaaaaattggactgagactgggggctgtggctcacacctgtaatcccagcaccttgggagaccgaggccggtggatcacctgaggtcaggagttcgagaccagcctggccaatgtggtgaaacttctgctctactaaaaatgcaaaaattagccgggtgtggtggcacatgactgtagtcccagctactcaggagactgaggcaggagaatcactcaaacctgggaggtggaggttgtagtgagctgagatcgggccattgcactccagcctaggctacagagcgaaagtgtctcaaaaaataaatacataaatagagacagggtcttactgtgttgcccagactggtctcaaatttctggactcaaagtagtcctctaacctcgtcctcccaaagtactgggattacagtcatgagccactgcacccggcctatattcactgtagttattaaaaatataggccgggcatggtgtctcacgcctgtaatcccagcactttgggaggccaaggcgggcagatcacctgaggtcgggagtttgagaccagcctggccaacatggtgcaaccccgtctctaccaaaaatacaaaaattagccaggcgtggtggcgtgcgcctgtaatcccagctacccaggaggctgaggcaggagaatcgctggaacccggtgggcagaggctgcaagtgagccgagattacgccactgcactccagcctaggtgacagagcaagactctctcaaaaaaaaaaaaataaatatttacctgaggccaggtgtagtggctcacgcctataatcccagcactttgggagaccgaggcaggcggatcatctgaggttgggagttcgagaccagcctggccaacatggagaaaccccatctctactaaaaatacaaaattagccagatgtggtgacgcatgcctgtaatcccaggtactcggtaggctaagggaggagaattgcttgaacccgggaggcggaggttgtgctgagctgagatcgcgccattttacttcagcctgggcaacaagatcaaaactcggtttaaaaaaaagaaaaaatatatatatatttacatctatatatttacatatatgtttacatatatatgtatatttacctgaaatgttgatttggttccatctgaacagcctttttcaaggacattgtctttttcagctatagagtttggcattgtttagttaatctgtaaaatacagattgtagttattatttttgagacagtctcactgggtcacccaggctggagtgcgtggcacgctcttggcttgctgcaacctctgtctcctgggttcaagcaattttcctgcctcagcctcctgagtagctggaattacaggtgtgtgccactctgcctgggtagtttttgtatttttttagtagagatggagtttggccatgttggccaggctcgtctcaaactcctgacctcaagtggtccacccgccgcggcctcccaaagttctgagattatgggtgtgatcctccgtgcacagccggtcattatttttttatgttgctttaccgtgtacaaaaaaagtgcagtacattatatgactcctttaggaaacctgtgcttattaaagattatgaagttaccttgcggataagtacaatgtattttgtcagttttgtaagatacacttgaagtatttttttttttctcgtttgagacggagtctcgctttgtcacccaggcttgagtgcagtggcgcactttcggctcactgcaacctccgcctcccggattcaagccattctcctgcctcagcctcccaagcagctgggattataggcatgcaccaccatgcctggctcatttttgtatttttagtagagacggggtttcactatgttggccaggctggtcttgaactcctgacctcaagtgatctgtccaccttgccctcctaaagtgctgggattacaggcatgagtcactgcatccggccagagttttaatttttaatttttgtgggtacatagcaggtctatttcaaagtttattttattttatattttttgagagtgagtctcgctctgtcacccaggctggagtgcacccaggctggagtgcggtggcacgatcgcgatctgggttcgctacagcctgcgcctcctgggttcaagcgattctcctccctcagccgcctgagtagctgggactacaggcaagtgccaccatgcacggctagtttttgtatttttagtagagacggggtttcactgctttagtcaggttggtcttgatctcctgacctcgtgattcgcccgcctcggcctcccaaagtgctgggattccaggtgtgagccaccaccgcgcctggcccttgaataccgtttattaaaaatttacggggctgggcgcggtggctcacacctgtaatcccagcactttgggaggccgaggcaggcgaatcacgaggtcaggagatcgagaccatcctgactaacatggtgaaaccccgtctctactaaaaatacaaaaaattagccaggcgtggtggtgggcgcctgtagtcccagctactcgggaggctgagacaggagaatgttgtgaacctggggggcagagcttgcagtgagccaagatcgcaccactgcactccagcctgggcaacagagtgagactgtctcaaaaaaaaaaaaaaaagtactatgttgagtatattggagaaaaactgacttcaaattttcacttgaaagtatatgggccaggtgcagtaccttatgcctctaatcccagtactttttgggaggccaaagtgagagaatcacttgaacccaggagttctagactagcccagagaagttggtgaaaacggttgtgtacagaaaattaaaaatcagccagatgtgttggcacgcctctgtagtcctagctctctgggaggtggaggaggaggatcacttgagcccaggagattgaggctgcggtggctgtcattacaccactgtattccatcctgggagacagcaagaaaccactgtcttgaaaaaaaaaagtatatggtccttcaaaaactaggcttgctagtttttgttgcaaattatcaatatagtataaggaaggggaaagtagtatgtagtttttaaagtttttaaaattggctgggcacagtactgtaatcccagcactttgggaggctgaggcgggtggatcacgaggtcaggagatcgagaccatcctggctaacatggtgaaaccccgtctctactaaaaatacaaaaaattagccgggaatggtggtgggtgcctgtagtcccagtttattgggaggctgaggcaggagaacgatgtgaacccagaaggcagagcttgcactgagcagagattgcgccactgtgctccagcctgggtgacagagcgagactccaaaaacacacacacaaaaaaagtttttaaaattaattatttgagacggagtctggctctgtcacccaggctggagtgcatggggacaggtgtgcgccaccacacccagctaattttttgtatttgttttttagtggagacggggtttcgtcatttcaggctaagtgatggaagaagaccccatctcaaaaaaaaaaaaaaaaaagtaaatgattgcctttttatatgctgtaagtaagtttcaatggtagtagcagaaattgtgtgccctttgtcctatgcataataattgtagactttgcagttgatgtaattttgaccatacaccactcatctaaaaaatatttattgtaatagagacataccacattaaccttgaaatgttggatggtagttcgaaagttagctccggcaaaaaaaaataaaaaaataaaaattctctcgtccaactgaaaggcaggtatagatgtttttcttgcttggaattggaggtttaaaaatactttttgaggctgagtgtggtggctcacgcctgtaatcctagcgctttgggtggccgaagtgggcggatcatgaggtcagaagttaaagaccagcctggccaacatagtgaaaccccgtctctactaaaaatacaaacaaaattagccgggcatggtggttgcgcgcctgtagtcccagctgctagggaggctgagggaggagaatcgcttgaactctggaggcggaggttgcagtgagctgagatgatgccattgcactccaacctgggtgaaaaacaagactctgtctcaaaaaaaaagaaaaaaaattttttgagagtattggctactcaaagtgatattgaacatgtaattgccaaataaaacttttacatttaactcactaatttattcttttcttgttgtgttacccattatttttccttgctgtgaagcttcctagctgatgtgtctactactggtttgggcttttgacattctttacattaatatggataatatttcactttttttttttttttttggtaaaaaacacaggagatttatctttgtgaggtcgaggcaggggcaggtcacatgaggtcaggagtttgaggctagcctatccaatgtggtgaaaccccgtctctactaaaaatacaaaagtagttgggggtagtggctcatacctgtaatcccagctactctggagactgaggcaggagaatgacttgaacccgggaggcagaggttgcagtgagccgagattgcaccgctgcactccagcctgggtgacaagaccgaagctccgtctcaaagaaaagaaaaaaaaaattaaccgtcttaaccatttttaaatgcacacacatatttgtttttgtaagctcctttatagcacagagcgtgtctcagacatctataaatttcccataacgtaagtacttagtaggtactaggaagtaagccaacattttctcctgcaaaaattgtactagtttttgaatgcctgtctttatcttgcagtatgttcatgcggatgctcctaccaataaaacactggctgggctggtggtgcagcttcttcagttccaggaagatgcctttgggaagcatgtcaccaacccggccttcaccaaactccctgtaagtacatcagcttactgttatttgggcatcctcagttgctgtatacttttaggtgtagcatccagcttttttcctttgctgctgctagcgtgtagaatttaaaaaaaaaaagcaaaaaacaaattttagttatagaatattactattttttaactgtaggaagctgctttttgaagaggcatttaacatttgcattaaatattgcagcagtcattgtgaagacctaacaatattttactatgttgcagttccctatcctctcgccgtaccgagtcttctccatgctttctcctgatgcagctcttatgccataaatagaatttatggaattttttatattttgtaggtgagataccttctgaagttgtgtgagaatataattttggtgtccttgcaattgtgtgttttatttttgtttttacagacaggatcttgttctgttgcccaggctggagtgcagtggtttgatcacagcgcactgcagccttgatctcccggctctagccatcttcccacctcaggttcccaagaggctgggactactagcatgtgctaccacgcgcatatgggtgacttttaaatttctgtagtgatgggatcttgctgtgttgcccaggctggtctcaaatttttggcgggaaggcgatccttctgcattggcctctgaaagctctttgattactggtgcgagccaccacaccagcccttctctgctatctttattttatttaattaatttatttatgagacagagtctcgctctgtcacccaggctagagtgcagtggtgtgatttcggctcactgcaacctgcagcgattcttgtgcctcaagactcccgaatagctaggattacaggtgcgcgccaccacacccagctaatttttgtatttttagtagacacatggtttcaccatgttggccaggctggtcttgaactcgcagcctcaagtgatccacccacctcggcctcccaaagtgccgggagtacaggtgtgagccaccacacccagcctttatttttatgttatgatatgttatgttatgttatattatatcatgttattttttgagatacagtcttgttctgtcgcccaggctggagtgcagtggagtgatcttggctcactgcaacctctgcctcccgggttcaagcgattctcctgcctcagcctcctgagtagctgggactacaggcatgcaccacccaccgcacctggctaatttttgtatttttagtagatatggggtttcactgtgttggccccgctggtcttgaactcaagtgatttccctacctcggcctcccagagcactgggattacaagtgggagccactgtgcccagcctctgctatcttatactcctttatttatattttcgaactctgattttacaaatactagctttttaggaattgtctgtcatatctttcctcataatttttgtcttttaattcattttggttttcgttgtttctagcgtgctgttagctgcctgtatgaatctatgatcagtagaccttttttgtggggactgttcttgatcactaaatcgtttaacaacttactgatctttcaaatataattgagaataagaaataataggcggggcgtcgtggcttatgcctgtaatcccagcactttgggaggctgaggtgggcggatcacgatgtcaggagattgagaacatcctgtctaacaaggtgaaacaccatctctactaaaagtacaaaaattagccgggcgtggtggcgggtgcctgtggtcccagctccttgggaggctgaggcaggagaatggcatgaacccgggaggcagagcttgcagtgagccgagattgcgccactgcctccggcctgggcgacagagtgagactccatctcaaaaaaataaataaataaataaaattttaaaaaatagtattgtttcggtgatcttgctgtaaatgtgtttgtctgtgatgtttttattatccaaaaagttaaagaaatttagttaaatatattgatgtggttacttttctcattttgaattataattgggaagcttttatcattcctaggttataaaggaattcagcaatgtgttcttttagtacttgtatgatttcattttttacctttttttaattttaatttataaagatagagacggggtgttgctgtgttgcctaggctgatcttttttttggagtcaaagtcttgctgtgttgcccaggctgcagtgcagtggtgcaatttcagctcaccacgacctctgcttcccaggttcaagtgagtcttgtacctcagcctcccgagtagctgggaattcaggcacctgccaccatgcctggttaatttttttgtgtttttagtagagacggggtttcaccatgttgaccaggctggtgtcgaactcctgatctcaggtgatccacccgcctcagcctcccaaagtgctgggattataggtgtgagccactgtgcctggtcccaggctggtcttgaactcctgggctcaagtgatcttcctgccttggctttgcaaagtcctgggattactggtatgagtaaccatgctcagccttattatttattttttttttgagacagtctcactctgtcacccaggctagagtgcagtggtacaatctcagctcactgcaagttctgcctaccgggttcatgccattctcctgcctcagcctcccgagtagctgggactacaggcgcccaccaccacactggctaattttttttttgtatttttagtagagacggggtttcactgtgttagctaggatggcctcaatctcctgacctcgtgatctgcctgcctcggcctcccaaagtgctgggattataggcgtgagccaccgtgcccggccccagccttatttttacatgtcactctcttatccatttaggatttgccctggtagttagtgtgggaaatggcagatccatttttctgtttttccttatggttatctggttattccagaaaagtttatttaaaagggctccttttctccactgattgcagctcagcaaatgttaagaatttgattaggtgcagggtcctaagaatacaaacaaatactttatattatttgtcctcaggggactcacagtctaatgagctgtgtgagtagagcctttgacttacttggtgatgtcaggaaatatttctgtggaaaaggacatttgaattgtgtcttgaaagttgagtgtgagttcttcagctaagtgggggaggatgggattttcaggtagtggtggcaacacataaaagtgttatggttggcggagtgcggtggctcatgcctgtaatcccagcactttgggaggctgaggagggcggatcacgaggtcaggagatcgagaccatcctggctaacaaggtgaaaccccgtctctactaagtagctgggattacaggcacctgccactgcgcccggctaatttttgtattttctagtagacacagagtttcaccatcttggccaggctggtcttgaactcctgacctcatgatccggccacctctgcttctcaaagtgctgggattacaggcgtgagccactgtgcccggccctttttttttttttttttttttttgagacggagtctcgctctgtcatccaggctggagtacagtggtgcgatctcggctcactgcagcctccgcctcctgggttcaagcaattctcatgcctcagcctccccagtagctgggactacaggtgcctgccaccatgcctggcttatttttgtatttttagtagagacaaggtttcaccaggttggccactcctggtcttgaactcctgacctcaggtgatctgcccacctctccctcccaaagtgctgggattacagatgtgagccaccgctcccagctagctgcctgatgttttttataacaaaaatttaaacatacttaaaagtaaaagcttacaagattagtatgaagaacttttattttctcttcactcagaatctacagttaacattttacccatttgctttatcattatcattttctgtgggatgtgtgtgtgttatgtattttatgtgtgaaaaatttgaaagttccatgttcctttacagctaaagtattcatttcctgttctcttacattatgaactgggctagaattatcaaattagctattgattgaggttttcaatagtttaattcactataatatagtacatattgattgcactttattaattgtaacataatttagagtaaaattacagattacattatataaagtattttacataatacgattgaaattatattgggattcttaattaggaatgtatgaatcttttcaaaaatggtgttttcagagagtgttatatgtaggctatttgactcctgggaactaaaccattatttagttccagattttaaaatattagggaagaatatttttaggcagaagccgtaattaaaaacaattcctggtttagtgccactgggaaccgatgtacttgccttcctctcaaaatggtgttcaacactttcccagatgaaagggattgatacaatccataatggtataaaacaaaattcgatgagatagataattaacaaagcaaagaatgtttcagtgagacatataaatcacatactttaaaaagttttttccctgagtaatcagtatggtataagagtttatgctgggcatggctcacacctgtaatctcagcactttgggaggccaaggtggtcaaaactcttgagcccaggagtttgaaactagcctgggcaacataggccccgtctctacaaagaaatacaagaaaaattatctgggtgtggtggtgcctgcacgcttgtaggcccagctacttgggaggctgaggtgggaggatcacttgagcctggcagacagagattgcagtgagctgagactctgtcttaaaaaaaaaaaaagagttcactgtttttttgttgttgttgtcgttgtccaggctggagtgcaatggcgcagtcttggctcactgcaacctctgcctcccgggttcaaactattctcctgcctcagcctcccgaggacctgggattacaggcgcccaccaccacgcccagctaatttttgtatttttagtatagacggggtttctccatgttggccaagctggtctcgaactcctgaacttgtgatccacccgcctcggcctcccaaggtgctgggattacaggcgtgagccaccgcacccggccgagttcactatttggactttttttttttttttttaaatcagagtggaggctgggtgcggtggctcacaccttgtaatcccagcactttgggaggctgaagtgggtggatcacctcaggttgagagttcgagaccagcctgaccaacatggagaaactccatgtctactaaaaataaaaaattagccgagtgtggtggtacatgcctgtaatcccagctactcaggaggccgaggcaggagaatcacttgaacccgggaggtggagtttatagtgagccgagattgtgcccattgcactccagcctgggcaacaagagcgaaactccatctcaaaaaaaaaaagagaaaaaggaaaagaaaaaaatcagagtggaacctttttttttttttttttttttctttttggagacagaatcatgctctgttgcccaggctggagtgcagtggtgtgatctcggctcactgcaacttccgcctcctgggttcaggcgattctcctgcctcagcctcccaagtagctgggacaacaggtgcccgccaccacgcccggctaattttgttttgtattttagtagagacagggtttcactgtgttagccaggatggtcttgatctgacctcgtgatccgcatgcctcggcttcccaaagtgctgggattacaggcgtgagccaccatgcccagctagagtggaactttatatagtaacttcccaagtcatgctggatgtcggacagctggctcttgttctatcaaatgctgagagatttagaaagaaccaagcatttcataaggctaaggctaaaggtatattgcattaccaaacacatgatttgaaacaaaaaaaattgctaagaagatgtgggtataaaacaaaaaagaaaaatatattttaccttcactacaagtaaagtttctaattttcccacaagccctccaaggctttagtacgtgtgcatacataatgtaaacataattgtaataataggatagagctgtttttctttttttgagacagggtctctctcactctgtcactcaggctggagtgcagtggcatgatctcaactcactgcatattcgaccatgactttccagactcaggtagatcctcccacctcaccctcctgagtagttgggacaagcatgcaccactacaccctgctaatttttgttttttttttttgtagagacagggttttgccctgttgcccagactgttctcgaactcctgggctcaggcagtctttccgccttggccccccaaagtcctgggtttacagacatgagccacagtgcccggcctagagctgtttttttattctgcattttaaaatggattataagcatctgtgtttaaaaaaacaggaaagctctgagagtaagaaatatagaaggttaagtgagagtctcaagtaactggattttaattgtgtttgggagatatccaagattttgttttcttttttacgtgacacagctccaggagatcttgagaacatgtacccttatgcccaaaattgtaaacctgtcattgcacttaaaaaaatcatttaggctgggggcagtggctcacgcctgtaatcccagcactttgggaggctgaggtaggtggatcacctgaggtcaggagttcgaaaccagcctggccaacatggtgaaaccctgtctctactacaaatacaaaaattacccgggtgtggtggcaggcgcctgtaatcccagctgctcgggaggctgaggcaggagaactgctagcccccaggaggcggaggttgcagtgagccaagatcatgccactgtactccagcctgggcgacagagtgagactccatctcaaaaaaaaaaaaaaattaatttgcaactggaggaaaaatgtagaatattatattcctgaactgatttcactctgctgttgtatgaatttcagaatggagagactatctttgggaacatgggactaggaaggagaccgtaagtgttgtatatatatttgaagtgagcatttgagtttgtagcttagaactctgtctgatgaaagtggaatatgagcacctgtttaagcaaaatagtgtaggaaatttacttgtggaataatggtttagtttctttctttttttttttaaacaacttcctattgtaaaatatatagaaagtgagtaaaataaattttgacttaaataattataaagagaacatccatttaaccacagtccaggtcagaaattgctaacaaccctaacaaacgtatgtgttccttccccaaccataaactcctctttttccccacagataatcttttccttgccgtttttttttttgtatgtttttgtttttgagacagagtttctctcttgttgctcaggctggcgtgcaatggcacgatctcggcttactgcaacctctgcctcccgagttcaagcggttctcttgcttcagcctcctgactagctgggattacaggcatgcgccaccacgcccggctaattttgcatttttggtagagacagggtttctccatgttgttcaggctggtcttgaactcccgacctcaggtggtctgcctgcctcagcctcccaaagtgctgggattacaggcgtgagccaccgcgcctggcctccttgcttttctttataggtatcactgtgttagtgtgcatccctgaataatatagtattatgttttgcttgtttttgaattttgtactaatgaactcatagatattcttgtaacttgggggccatgtaggaaataatttgccaacatggagaaaacaaatagtctaactgaactgctcagccacatacgtgtggataaaacaaattactgtagaagaatagttaaatctgaaaaatctagttagctagcttctggcctttataattcatgtgcaagggcagtgagcctacatgatgtagcatgaccagttagatagagctcagtaggctgcagaatatgggctgctgtgctggagacatggactagtattccaggcagagggcatgctggaccaggtggtgggcaaggctctggaaagctatatgatcaacttcagtgcaggtttgtactccgtaccatgtggattcgtaggtagaaacctgagttcactgacattgtacttatttatttgattgatgtttcatttatttattttttctatatttttacttttttcatctttctctctctccctgtaatgtgtcctacagctttgctgaagtatggccaatgtacagtgaacagtacatatttagctgggcacactggctcatgcctgtaatccagactacttgggagactgaagtaggagggtcacatgaggcaaggagtttgagaccagcttgagcaacatattgagaccctatttatcagaaaaactaaaaattagtcgtgcatggtggtgtgtgattgtggtcccaactacttgggagctgacccaggaggatcacttgatcccaggagttagaggctgccatgagttacagtagtactactgctgcactctagcctgagtgatagagcgaaatcccatcaatatctctttctcttttttttttcctaaagagaaaggctgggtgcagtggttcatgcttataatcttagcattttgggtggctgaggctagaggagtccttgagcccaggagtttgagaccagcctggacaacatggtgagagccgtctacaaaaaataaaaaaaaattagcttggtgtggtggtgcatgcctgtggtcccagctactttgggaggctgaggtaggaggatctcttgagcccaggaggttgaggctgcagtgggctataatcatgccactgcactccagcctaggcgacagtgagtccctgtttgagaaaaaaaacctaactgaagtattttgtgttgtgaaaatatagtgtaaacataaaacagaatactgtatatatatattttttttcttaaaaaaaaaatctcagctgggcactgtggctcatgcctatctataatcccaacactttgggaggcctaggtgagtgggtcctctgagctcaagagtttgagactagcctgagcaacaatcttgtgaaattgagcttttcttaatatatctacaaaaatgtaaagtgtaatactgacgtattttaaagcagttgtcagaactcactgaaaaaattattatgtttttataattttttttttttttagagctggagtctcgctattgttgcccaggctggtcccaaactcctgggctcaagctatcctcctgccttgtcctctgaaagtgttgacccaaaagggctgggtgtggtggctcatgcctgtaatcctaacgttttgggaggctgaggcaggaggatcacttgagcccaggaactcgagactagcctgggcaacaaagtgagaccctgtctctaaaaaagattgaaaaataaaaaagaggaaaagaaagattattactgttgaagaaggagatgcattgaggagatggatacacctattttaagggaactatcattcaacgttttctcttttttttttttttgagatggagtctcgctctgtcgcccaggctagagtgtagtggcgtgatctcggctcactgcaacctccgcctcctgggttcaagcaattctcctgcctcagcctcccgagtagctgggactacaggtgcctgccaccacacctggctaattttttgtatttttagtagagacagggtttcaccgtgttagccaggatggtctcgatctcctgacctcgtgatctgcccgcctcggcctcccaaagtgctgggattacaggcgtgagctactgcacccagccacacctggctaattcttatatttttagtagcgacagggtttcaccatgttggccaggctgatctcaaactcctgacctcaggtgattctcccatctcggcctcccaaagtgctgggattacaggtgtgagccactgtgcctagcctcattcaacattttctaaatttattttcaattgttacgtgatttggtggaacacctgtaaatacgttgagcataaaatgttgtcatagccagttctaacaaatgtggtggtgtgattgaactggataatactattttgggatgttttagatgagtcacagttcataagctatctctttctgacacctttgaatttcttcccagtaagtatgactgacctcatggcaggaattctcaccaactggatcagtctggtgtaatggaaagggtgggagttggaggactgtcactttaacagtctgttttcatttgattgaataaaccgtttggaacgtgaagttaataagaaggggcttacagttggagttggacttgatcactggttttataattatttcctggggagtacctgtagcatctgagaagagggaggggaggagtaaatgcagagggctaagaagaatctgttgtcttcaagtttcactttgaacaatttttcttaatagtcctctctctgagtttctaaaaatgttctgtggcaaaggaataggagaaagcaagctgggcatggtagctcacgcctgtaatcccagcactttgggaggctgaggcgggcggattacctgaaatcaggagttctggaccaggctggtcaaccttgtgagatcctgtctctactaaaaatacaaaaaaaatcccagctattcaggaggctgaggcaggagaatagcttgaacctgagaggcagaggttgcagtgagccaagattgtgccactgcactccagcctgggcaacagagtgagactgtgtctcaaaaagaaaaaaatgaaataggagaaaactattgaatttggcaaatgttatgatctctcttactgaacattttatgatccgtatgtgagaatggtattgttttgccaaaatcatgctgattctaggactttgtggaatggatgagggagaaaacagattagcatataggtcttggaagcaagaataaaaggatggacttacgtgaaagaaatcagcagtcgtagtcacttgagttgtcatcatccatcaggtccaatctagcagggagggaatagcttgagagacttgagactgaggcacagatctctgtagaacatgggatttatcctggcaaatacagtgatcaaatttaggagattggctttgatataataccattatttaccatataatctatcttcacatttcaccagttgtctcaaaaatgtcctttataagatccacaccaacaccacatattttatttagttatatatttttagtcttatttaatttgagataattcagcctgtcttttttttttctgagatactgccttgctctgtcacccaggctaaagtacagtggtatggtcatagctcactgcagccttgacctccagggatcaactgatccacctgcctcagcctcctgagtggctgagaccacagacacattccaccacgcctggcttttcttttcttttctttttttttagacagagtcttgctctgttacccagtctggagtgtggtagcgcgatctcagctcactgcagcctccccttcccgggttcaagccattctcctgtcttagcctcccaagtagctgggattacaggtgtgcaccactacacccagctaatttttgtatttttagtagagatggggtttcaccatgttggctaggctggtctcgaactactgacctcaagtgatctgcctgccttggcctcccaaagtgctgggattacaggtgtgagccacagcacctggccaaattttttaatttttaatttgatagagatagggtctcactgtgttacccaggctggttttgaactcttggactgaagaagtccttctgccttggccttccaaagtactgggattgctgctttgagctaccacgcacagctgattgacgtttgtttgttatgacttacatttttgttgttgttttttgagacagagtcttgctcagttgcccaggctggagtgcagtagcacaatcttggctcactgcagtctcctcccctaccaggttcaaatgattctcctgcctcagcctccccagtagctgggattacaggcatgcgccacaacgcccagctaatgtttgtatttttagtagaaactgggtttcaccatgttggccaggctggtctccaactcctgacctcaggtaactgtcagccttggcctcccaaagtgctgagattactggcatgagccactccctctggcccatgacttaacatttttgaagcatgcagacaaatgttacatttgtaaaaatttcttttttttaatttttttgagacagcctttctctgttgcccaggctggaatgcagtggtacgatcctggctcactgcagtctgcctcctgggttcatgcgattctcatgcctcagcctctaaagtagctgattaacaggtgtgcaccaccattcccagctgatattttgtatttttggtagagatggggtttcaccatgttagccatgctggtctcaaactcctggcctcaagtgatctgcccgtctcggcctcccagagtggtgggatttcaggcgtgagccaccatacctggcctcaaatttttctgtgttattgcttatagttgtaatttgtttattgtcattgctgtgtacgggctgatacattttttctttttcttttttttctggagatggagtctcgcttttgttgcccaggctggagtgcaatggcatgatctcagctcactgcaacctcagcctcccgagttcaagcgattctcctgcgtcagcctcccgagtagctgggattacaggcacccgccaccacacccagctaatttttttgtatttttagtagagatgaggtttcaccatgttggccaggctggtcttgaactcctgacctcaggtgatccacctgcctcagcctcccaaagtgctgggattacaggcatgagccactgcgcctggctaaattttttctttttcttttttttttttttttttgagacggagtctagctctgtcccagactggagtgcagtggtggaatcttggctcactgcaatctccgcctcccgggttcaagctattctcctgcctcagcctcccgagtagctgggattacaggcacgccccaccatgctcggctaatttttgtatttttagtagagacggggtttcaccatgttggccaggctggtcttgaactcccgaccttgtgatctgcccgcctcagcctcccaaagtgctgggattacaggtatgagccaccacgcccagcctaattttttttgctaaagggacagagtgtactgtatgctgtggctcactcccataatccaagcattttgggaggctgaggtgggtggatcacttgagtccaggagttcaagaccagcctggacaacatggcaaaagctggtctctacaaaaaaatatcaaaattagccaggcgtttgggagggcccctgtcgtcccagctatttgggaggctgaggtgggaggattgcttgagccaggtggcgaaggttgtagtgagctgagattgcacctctgcactatggcctggatgaaagtgacaccctgtttctcctcttttttttttgggtcagagtttcgctcttgttgccccggctggagtgcaatggtgcgatctcagctcaccgccaccaccgcctccctggttcaagtgattctcctgcctcagcctcctgagtagctgggattacaggcatgcaccatcacgcctggctaattttgtgtttgtgtttatcttggccaggctggtctcaaactcctgacctcaggtcatccacccacctcagcctcccaaaacgtaggattacaggcctgagccaccgcgcccggccaacaccctgtttctaaataaataaataaattaattaattaaagggacagatagtaaatattctagatagtaaatattttaggcctgtaggctctgtgggctctgttacagccactcagtgtagtatgaaagcagctatatacaatacgtaaatgagtgtatgtatatgcagtacataataagtatggctgtgtactggtaaaactttaattttgatttttttgagatggtaccctgttgtgttaccaggttggagtggtgtcctgaatgaacacagctcactgcagccttgacctctagggcttaagcaatcctcttgtcttagcctaggcatatactaccacgtgtggctagtttttgtttttttttttttgcgaggctgaagtgggaagattgcttgagcccaggagttcaaaaccagcctgggttagatagtgagaccacatctctacagaatattaaaatattagcgtcagcatgttggcaaactcctgtggttggagctacttaggaggttgaggtgtgaggatcacttgagcccaggagttgaaggctgcagtgagtagtgatcattccactgcactccagcctgggtgacacagtgagacccttgttgtttttcgatagctgtttcataatttgccaacagttgctgtatagtattccgttgtgggaatacaccacaattttttttattcattttgcattgataggcttttggggtaatttgcagcttagagctattataaatagtgctgttgtgaatatttttatatatttcttttgctcaacttagatgtttcttttggttgtgttcttaagagtttacttgctatgtcataggttggtcaactttagtagatgttgctaaacaggtttccacagcagttctaccaatttatactcccacaaacagtgtatgagcattctgattttcttttctttctttctttcttttttttttttttttgatacggagcctcgctttgtcgcccaggctggagtgcagtggcgggatctcggctcactgcaagctccgcctccctgtttcatgccgttttcctccctcagcctcccgagtagctgggactacaggtgcatgctgccatgcccggctaagtttttgtatttttagtagagataggggttcaccagtttcacgtgttagccaggatggtctcgatctcctgacctcatgatccacctgccttggcctcccaaagtgctgagattacaggcatgagccaccacacctggctgagcgttctgattttctactttctcaccaatccttggaatctttttgtcttttacattttggttatttagtagatttgtggttataatgcattattttctagttgctaataattaattaatgtgagcaactttatttattggccacttggctatccttttttgagaagtacctgtttaaatcttttgcctgtttaaaaatttgcacattggtctttctctctctctttttttcttttcttttttgaaacggggtctggcctaatcacccaggctggagtacattgccttgatcatagctcactgcggcctcaaacgcctgggctcagaggatcttcccacctcagcctctcaagcagctgggactaccagtccacaccaccacacccggataattttttctgtttttttgtagagacagtctcgcctgattgcccaggctgatctcaaactcctgggctcaagtgattctcccagctcggcgtcccaaagtgctgggattacaggcgtgagtcaccatacctggctgaatttttcttaggtattctggatatggttcattggtcagaaatatttattccagatctcttctcccacttaatagtttatgtttttactctcataatgatgtcctttgatgagcagaggtttgtacttgtcatatacagcaggaaacggtaaactttttctgtaaaataccagatattttgggccttttgggtcatatggtttgtgatgcaagtacttgcttttgctgctattgtgtgaaagtagccacaagaaatacatgaatgtgaatttgcttcagtaaaactttacaaaaacaagagtggactacatttgacccgtggaccattatttgccatttcctgatacagaacaatttagtaaaatttttctgtgttgttaatactttttgtgttcttatagaaatctttgccttttttttttttttttttttttgagacggagtttcgctcttgttgcccaggctggagcgcaatggcgcgatctcagctcactgcaacctccgcctcccgggttcaagtgattctcctgcctcagcctcttgagtagctggagttacaggcatgcgccaccatgcctggctggttttgtatttttagtagagacggggtttctccatgttggtcaggctggtctcgaactcctgacctcaggtgatctgctcgcctaggcctcccaaagtggtaggattacaggcatgagccaccacgcctggccagaaatctttgccttttctgaagtcatgtatatattcttctgtattttcttcaagaagctttattatttatttattttgagatgcagtattgccctgtagcccaggctggagtgcaatggcgcgatcttggctccctgcaacctctgcctcctgggttcaaatggttctgctgcctcagcttcctgagtggctgtagctgggattataggcgcccgccaccacgcccagcctttttttttttttttttttttttttttttttaagatgaagcctggctctgtcacccgggctgaaatgcagtggcaccatctcagctcaccgtaacctccgcctcccggattcaagcgattcccttgcctcagccttcagagtagctgggattacaggtgcctgccaccacgcctggctactttttgtatttttagtagagacgtgtttcaccatgttggtcaggctggtctcgaactcctgaccttgtgatcggcccgcctcggcctcccaaagtgctgggattacagacatgagccaccgcgcctggcctattttttgtatttttagtagagacggagtttaaccatgttggctagggtggtctcgaactcctgacctcatgatccgcccgccttgaccacccaaagtgctgggattacaggcatgagccaccgtgcctggcctgttttacattttaaacttataattctttttttttttaaattcgctttttatttaattagtttttcttttttttttttttgagacagagtcttgctctgttgcccaggctggagtgcagtggcgcgatctcagctcactgcaagctctgcctcccgggttcacgccattctcctgcctcagcctcccaagtagttcggactacaggctgccaccgtgcctgtctaatttttgtatttttttttagacagggtttcaccttgttagccaggatggtctcgatctcctaacctcatgatcagcccgcctcagcctccaaaaatgctgcggttacagtcatgagccaccgtgcccgcccttaattaatttagtttttgagacagactctcactcagactgaagtgcagtggtgcgatcttggctcactgcagcctccaccttctggtttcaaccagttttcctgcctcggcctcgcgagtagctgggattacagacgtgcataactgtgcccggataatttttatttatttatttttgagacagagtcttgctctgtcatccaggctggagtgcagtggcacgatctcagctcactgcagcctgtgcctcctgggttcaagcgattctcctgtctcagttttccaagtagctgggattacaagtgcccgccaccatgcctgactaatttttctatttttagtagagacagggtttcaccatgttggctaggctggtctcgaactcctgacttacagtggtttgcttgttttggcctcccaaagttctggcattacaggcgtggggcactgtgcctagcctagggttgtattttttacctcgcatgattaccactttgacttttagttgtttcttttttttcctccctttgatttttgcacctggggatttgctttctttctaggaattcagctgctcatttaaaataatgcgtgttacttttacccaacatttctacatgtttatagtggtagagtgtaatagttctttagtatacaatattgctggagccagcaacacttttctcatctgtaaaatgggtgtaaaagagtaaagttcaggccaggagccgtggctcacacctgtaatcccaacactttgggaggccgaggctggtggatcacgaggtcaagagatcgagaccatcctggccaacatggtgaaaccctgtctctactaaaaatacaaaaattagctgggcgtggtggtgcgcgcctgcagtcccagctactgaggaggctcaggcaggagaattgcttgaacctgggaggcggaggttgcagtgagctgaaattgcaccactgcactccagcctggcgacagagcgagactcagtctcaaaaaaaaaaaaaagagtaaagttcatatgcttgttgtgacaagtaaatgaggaaataagtcaaaagtgcttcatgataaattctcagtgattggtgtcaatgctaatactttttgttgtctccaagactattacggtagcagtgacctatcattagaggtgctgataataatacaaattccaaataagtttaatagataagtaaatgtatggaatttttgacgtgtgtcattttattttgtgaggtataagaattctggaatttaaatgatgtatttttttctctttcaaccattttcaaggtgtgaggatgactttgtgatttcttgtgaactttcttggacacattctctgcttatttactacttcacatcccttttctggcacagtcatttattgactgatagacctaaacatagtgttagaaatgtgaatactcctttcatagaaacacgtttctttttaccaattgttagcactactttgtctttttttttttttttttttttgagatggagttttgctcttgttgcccagactggagtgcagtggcgcaatctcagctcactgcaacctccgcctcccgaattcaagcgattcctgcctcagcctctcgagtagctgggattacaggcatgcaccaccacgcccggctgattttttttgtatttttagtagagacggggtttcaccttggccaggcaggtcttgaactcctgacctcaggtgatccgcccgcctcggcctcccaaagtgctcagattacaggcatgagccatcgcacccggcctactttgtcttttatgaataaataaaggaataaagaaataaggaatccatggcacaaattattgtagtagatttatcttctcttttcttcttttttttttttttttggagatggagtctcgctctgttgcccaggctggagtgcagtggtgcgttctcagctcactgctacctccacctcctgggttcaagtgattctcctgtctcatcctcctgagtagctgggactacagacgtgtcccaccacgtccgactaagatggggttttaccatgttggccaggattgtctcagactcctcacctcgtgatccgccccccttggactcccaaagtgctgagattacaggcgtgagccgtagtgcccggcctagatttattctaagtttcattcagctcagcaagattttaggtgggctataaataagtagggtgaaaccacttatatatacccaggataagatcagattaaatttccaatagagtcagccagggatagaattgtttattaaaagcaattgggtcacacagttgagagtagaggcagcctgttagagttgactttgacccccagagtctctaattggagtgttcagctgttgagatactcatataaggcatcattttgctggctctagaaatttcagtttttgctacttttttttgtttgtttttttcagacaggactgtgatcatgggtcactgcagcttcagcctcctaggctcaactagccctcctgactcagcctactgggtagctgggaggtacatcctaccatgccgggctaattttattttaattattttctagagacagggtttcgctctgttatgttgctcagggtgttcttgtactcctggcctgaagtgatcctcctgtcccggcctctcaacgtgttagaattacaggtgcgagccactgcatccggctgcctttttattctttaggttttccaatacgaattaacaagtatttgctctaacatcctgtgcttttcatttagggagtgtttaagaactatactcattttgaattagggcagggcctcttcagcatgggggtttataggatggggctggaatgggagatacagtcaaggttcagtgaatgtctctaagaagtttcttgttcctatctccagctttccattacctgactttgatttctcacgttttcatttgggtgattgtgctactgagcttttttgagccaatcccaagtccgtttctatcccaaatccatttgtgtgcaagccgtaagaatccttgatgtatggataggccttgcccctgccagtaccattttattctgccacatctgtagaggtttgttgttgttgttgttgtttttgagatgaagtctcgctctgtcactcaggctggagtacagtggcgcaatctcggttcatcgcaacctctgcctcccgggttcaagtgattctcctgcctcagcctcctgagtagctgggatcacagatgtgtgccaccatgtcctgctaatttttttgtatttttagtagtaatggagtttcaccatgttggtcaggctgatcttgaactcctgacctcgtgatccaccctcctctgcctcccaaagtgctaggattacaggcgtgagctactgcgcctggccaaggtttttatctcgttgaacttcattattggaactagtacctttgataggttcatgagttccgtctattcctttttatttatttttatttttaaataatatagacaaggtctccctgtgttacccaggcgggtctcgaactcctgggctcaagaggtcttcctactgtggcctcccaaagtgctgggattacactacttttatgtatattttaccattggaaaattgaatgtcagttttgttttctttttttttttttttgagacagagtcttgctctgttgcccaggctggagtgcagtggcgtgatctcagctcactgcaacttccgcctcctgggttcaagcgattcttctgcctcagcctcccaagtagctgggactacaggtgcctgccaccatgcccagctaatttttgtatttttggtagagacagggtttccccatattggccaggctggtcttgaactccttacctcgtgatcagcctgccttggccttccaaagtgttgggattataggcatgaaccaccacgcctggccatctgttttctacttcattctcatcatctgtccctgtagtggctgaataaaagttactttgtcggccaggcgcggtggctcacgctagtaatcccagcactttgggaggctgaggcgggcggatcacctaaggtcaggaattaaagaccagcctggccaacctggtgaaaccctgtctctactaaaaatacaaaaataagcctggcgtggtggcacgtgtctgtaatcccagctactcaggaggctgaggcaggacagtcccttgaacccgggaggcagaggttgcagtcagctgagattgcgccactgcactccagcctgggtgacaagagtgagactctggctcaaaaaaaaaaaaaaattactttgtcttaagcctatatttggtaatgatttcatttttcaaatttaatatctgttgagaaattgaccttatttatatagatgttttattgttatggccagctcagtatatatttctgagtagcgtggatctctaattttaagtggtgtcaatatagttgaactgttgagaaaattcagattacctatgttgtcaggtggcacattgctgaatattggtgatagatttgaataagcactgttcctgtccacaaggaattcatattccacattaaatatatgaatcagtcatgtcactattatgctgaagtgcaatagtgattacatgcatggtttgaggagaacattttagaccaatctggggatttagggaaggctttctgtaggagaagtaagtctcattctactgtagtagatacccacctattacattagtctatttatttatttatttatttatttttgagatggagtttcgttctgtcgccaagctggagtgccctggcgcgatcccggctcactgcatcctctgcctctcgggttcaagtgattctcctgcctgagcctcccaagtagctgggactacaggcgtgcaccaccacacccagctaatttttgtatttttagtagagacatggtttcaccatgttggccaggatggtcttggatctcttgaccttgtgatccgtccaccttggcctcccaaagtgttaggattattggcgtgagccaccgcgcccagcctacattagtctattttaagatgtcagcactacagaattataatgactcgtgcattttcttttttttttttttgagatggactcttgctctgtcacccaggctggagtgcagtggcaccatcttggctcactgcaagctccatgtcccgggttcatgctattcttctgcctcagcctcctgagtagttgggactacaggcgcctgccaccacgcccggctaagtttttgtatttttagtagagacggggtttcaccatgttagccaggatggtctcgatctcctgacctcgtgatccacccgcctcggcctcccaaagtgctcggattgtaggcgtgagccaccttttttatttgcctgccccctccctctatccctctccccgccacctctctctctctctctctctctctctctctgtctctttctctgtgtgtgtgtgtttaatttagagggtctcactttgtgtgtgtgtgtgtgtgtgtttaatttagagggtctcactttgtcatccaggctggagtgcggtggtgtggtcacagctcactgtagcctcaacttcccaagctcaagcaatccatttacctcagcctcctgagttgctgggaccacaggcatgtgccactatacacggctcatttttgttttataatttattttatagatgaggtttcgctatgttgcccaggatggtcttgaactcctggtctcatatgatcctgcctcgttggcctcccaaagtgctggttttataggcgtgagccactgtgcctggcctatttattttttaaaattttatatatatttaattatgttagaatatctgtaacaaaatatgccatttaaatgatttttatttgttgtttgagatagggtctccctctgttacagtggcatgacatcagctcacttcaacctctgcctcccaggttcaagtgatcctcccacctcagcctcccaagtagctgggactgcaggtgcgtgccaccacgcccggctaatttttgtattttttggtagagatgggatttcaccatgttggccaggcttgtcccaaacttctgacctcaagtgatcaacccaactcggcctcccaaagtgctgggattacaggatactctttatttttatttattactatttttttttaaacagatgaggtctcactatgttgaccaggttggtcttctactcttgggcccaagtgatcctcctgcctcagcctcccaaaggtttgggattatgggatggagaaactatgctcacttctgtatctattaaacaataactttcattccttgtccctctttccttggcaaccaccattctgctttttgtctttttaatgtttgccacctatgtggttctttccagtatattattttgtagtaatagtttttagagaaaaaaatgcatgggtgtttctaataacacttcatcttatttagcctattcgatgctcagtttatattgtttttaccttcataatgtggaaattattcaccatttcgtttaatttgagctatatttttaatctgtaaagcacagatctcttgaattgtggcatagattttagctattatagttttatatagttacaccacatttttatggtcattaaatattataataggccgggtgcggtggctcatgcctgtaatcccagcactttgggaggccaaggtgggcggatcacttgagatcaagagtttcatatcagcttggccaatatggcaaaagtttgtcttttaaatatgcaaaaaacagaaaaaaaattagccaggcgtattggcacttgcttgtaatcccaactacttgggaggctgagatacgagaattccttgaacccagaaggcagaggctacagtgagccatgatcacccagctgtactccagcctgagcaacacagtgagaccctgtttcaaaaagataaaaaagtataataaaagtgttcacttacaatttttgcataatttatgtttttatttttattttttattttttgttgagacagtctcactgtgtcgcccaggctggagtgcagtggtgtgatcttggcaacctctgcccctgggttcaagcgattctcctgcctcagcctcccgagtagctgggattacatgcgcccgccaccatgcctggctaatttttgtatttttagtagagatggggcttcaccatgttggccgtgctggtggcaaactcctcacctcacatgatccacccgctttggccttccaaagtgctgggattacaggcgtgagccaccatgcctggcctaatttttgtatatttatagtcaagaatttataaggcgaagaagtccactatccttatatttctttttttcttttgtttctttgtgacaaagtttcacttccttgcccaagctggcctcaaactcctggcttcaagcagtcctcccttcctccctgccttctttctcaaccagagtactggggttacaggcattttctttggaaccattttgatttatcttttttataaaaaaatttgttttttgagataaggtcacactctgtcacccaggctggatttgtcaccatcacagttcactacagcttgacttcccatgctcatgcaatcctcctacctcagcctcctgagtaggtgggactacaggcgtgtgccaccatgcctggctaatttttatatttatatttatatttatatttatatttatatttatatttttttgagacaaattctggttttattgcccaggctagagtatagtggcatggtctcagctcactgcaacctttgcctcctaggttcaagccatcctcctacctcagcctcccagtagctggggctacaggcacactccccccatgcctggctaatttcttttgcattttttgttgagacggggtttcaccatgttgcccaggctggtcttgaactcctgtgctcaagccatctgcccgcttcggcctgccaaatgctgggattacaggtgtgagccactcctgcacctggcctaatttttaaattttttgtagaggtaggatctcactgtgttgcccaagctggtctcagactcctggcctcaagtgattctttcaccttggtgtctcaaaatgttagaattactggtgtgtagccaggcacgatggctcatgcctgtaatcacagcactttgggaggttgaggcgggcagatcacctgaggttgggagttcgagaccagcctggccaacatagagaaaccctgtctctactaaaaatgcaaaattagccgggcgtggtcatgcatgcctataatcccagctacttaggaggctgaggcaggagaatcacttgaacctgggaggcgtaggttgcagtgagccgagatagcaccattgcactccagcctgggcaacaaaagcaaaattctatctcaaaaaaaaaaaaaaaaaaaaattactgatgtgagccactgctcctggcctatatttagctttttaaaatctttcttttgacagactaattactcaaattataatatgtttatggaatttaaaaggaattcttttggggaggggtatggggtcttgctatattgtccaggctggttttgaatttctgtgctcaagtgattctttcatctcagcctcccaagtagctgcgactataggtgtgagccactgtactggctacaagaaagtagtttcacttcagtttatttcatttgatttttcttgagacagcatctcactctgtcatccagggctggagtgcagtagggcgatcagggctcaccgcaggctcaacctctcaggctgaagtgatcctcccaccccagcctcctggataggattgcaggtgtgtgccacaatgcacagctaatttttaaatttttttctagagactggatctccctgtgttgcccagactggtcttgaactcctgggcttaagtgatcctcctgtttcacgctcccagagtgttgggattacaggcatgagccaccatgcccagcctaatctacttttagaaaaatgtattgattcctcagtttattcaagaagatgtttaaggaggttgtttaattagtatttgtttatatatttgaatttataaaacttagaattaagacatgagtaattttgtcagaagctttatttttctcatgtgtaatttgtatcatttttaggcaaagtgtttcatggatttcaaagctggaggcgccttatgtcacattcttggggctgcttacaagtataaaaatgaacagggatggtaagtttttgtatttgtttgcatgttttgatcttaagttatttacttttaagtcctgtttccttgtgttagaaaatcctgtaagcacatgatgattaatgtgttttaccaagagccctaatttaccttgtttctacatccaagaaaaatatcaagcaaccacgtatttatttatttttgagacagggtcttaaaaataggaccaaccaaggctgttggcaaggctagaagtgcagtggtggaatctcaggtcactgcatcccgcgcatcagattcaagcaattctcatgccccagcctcctgagtagctgggactgtaggcgtgcaccaccatgcctggctaatttttctatttttagtagaaatagggttttgtcatgttggtcaggctgctctcaaactcctggcctcaagcactccacccatctcagcctcccaaagtgctgggattacaggcgtgagccaccgcacccggccacaaccaagtatttattagggaagtgatttcttatatttgatttttatagtaacaggtgtacattgttagcaaattagaaggtaggcttgccatgaaatgtgtgtgtataatgaactcatacattatatttgaagtggatagatagtatttttgtttgtttgttttgtttttttgagacttagttgcgctttttcgcccaggctggagtgaagtggcaccatctcagctcactgcaaccttccagtgattctcctgcctcagcctcctgagtaactgggattacaggcacctgccaccacatgcccagctaatttttgcatttttagtagagatggggtttcaccatgttggccaggctggtctcgaactcctgacctcaggcgatctacctgccttgaccttccaaggtgctaggattacaggtgtgagccaccgtgcctggccagatagcagttttaagagataaagttatctaggcctgcaagagtattccattttgctatcctcaggacagggataaaagaaatagagatctttgcctaggtcagtgttgtagatagattgagaatccctgcagatattcctgccattttgctcccttcagtcttttccccttttctagctgtctctcttggtactatttcttttttttctcttgaactctggagtttccatcagttactgggactagtgatgtcctgagctgtggggttgtcagggacatagttcacagggtagggttgggggagtggagtatattgtcctgaaattgtttggtattttcagttgagttagtggtgcacagtttataaccttagcatctttccaggagaatacacatgtaatttatatattttactttaaaagttaagctaacccaatactttatggttgggaagtgcaaataaatatttagatcaacaataaggacaagtgtgtaattaaataaattatttatatagtaaatagtaggagatacaaacttacatgtgtatttactgaaactttttatatatggatggtgtttaatagatattgatttggatcacctgaggtcaggagttcgagtccagactggccatcatggcgaaaccctgtctctactaaaaatacaaaaaaaattagccagacttggtggcaggcacttgtaatcccaggtactcaggaggctgagacaggagaattgcttgaacccgggagacggaggttgcagtgagctgagattgcgccactgcactcctgcctgggctgtctccaaaaaaaaagatattgactaaagtagcatgagacttgtttctttttgttatcagaggtagctctctgttttccagttctgtgtctagctctgatgttggacctctcacgatggtattccctatctaggagcaacggcatgtctctgtacttgtagagatggtttgtaccctactgttaactctgggttcccagttggaactcttttctgtccttggttcttgtttagcttttatcacaagtcctaacctggacacttgaggatagaataccaaagtgatatgatttttcctaggtcacatattgtggaacttgctttgtgtctgtagtttctgcacaatgaaattttttttttttttttttgagacatagtctcgctctgtcacccaggccggagtgcagtggtgtaatctcggctcactgcaacctctacctcccaggttcaagcagttctcctgcctcaccctcctgagtagctgggattacaggtgcctgccaccacacatggctaatttttgtatttttagtagagaccaggtttctccatgttggccaggctggtcttgaactcctgactcaggtgacccgccagactcggcctcccaaaatgctgggattacaggcatgagtcaccatgcccggccacagtgaaatatttttatctgaaatcacttgcagtagtttagaaagatacgtgtaatacaggccgggtgcagtggcttgtctcaaaaaaaaaggaagatatatgtaatacagtttccttaaaattaaaagtgggactaaaaaagacgtaaaggatagggttagcattgtcaggaataagaatttttccaagtcttttatgcagattgtgccagaattatttcctttcaggtatagttatgtgtccagtttcagtgtgcaccttctctcatctcttgtgcctcgcacacttgaagtgagtgcatattttagtaactccccactctgtttggatatctgaatactgacctgtcattcttgccccatgcctaacatgcctctcagaactttgtctgtgttctttaattgaacctcacagtctaggttgcatttctggctttaggtccaaagtttgctggttttgttattacggcaagcactattttcttcttatttcattgtggttctgctttcttactgacttctcagtagtctttgttttagtctctagtgacacgaagctctaatgtcatgcatatgaggttgaatgggaatacctggtaattactagcatatttgtgaagagactgtacagattaatattacagaattggccagctgtggtggctcatgcctgtaatcccagcactttgggaggctgaggtcagcggattgcttgagcccaggagtttgaacccagcccaggcaatgtgggaaaactcagcctctacaaaaaataggaaaattagctgggtgtggtggtgcatgcctatagtcccagctactccggatgctgaggtgggaggatcacttgagttcaggatgtagaggctgcagtgaaccaagattgcaccactgcactccagcctgggtgacagagaccctgtgtcaaaaacagaaagagagattacagaattgaaatgttaagtttgatctttctggatgtttctaaataggtaaaatcaatgagtgtcttatttatggtttttctcctgaaggataaaactttgtatagagttgaagtatagttatatgtaactgaaggataacaagtttgacctattcatggaaatccaaacggatctcccaaaggagagattaaataccaagttcaattaagtaatagagagttgactgttagtgcccacatgcccagagattaggacgttgtttattttttcctacagttctaaagagattgttacatgtttttttttttttcttttttgagacggagtcttgctctgtcacccagcaggctggaaccctatcttgagaatgtttatattaagttttgctttctaataatacagatagatgttcaagcttcaacccgaaagaggaatgcaaattagaactataatcattaggctggtgtggtggctcatgcctgtaaaagggcatcagaagcaaacttctaaaaggaaaaacaaaaatgcactgagccaaaggcaagacaacaatagaaccaaacagttttgtggggaagtgacaaaagctggcctcaaataaggagctttgtatgatgacagcaagctataataccctggaggccatccccacaggatggtctagtatgccataccccaaaagggtggcaaacatcatagtggtgccaggtgtggtaactcacacctataatctgagcactttgggaggctgaggcagaagaatcacttaagtccaggagttcaagactaacctgggcaacatagcaagaccccatctctattttttaaaataatagtaaaataaatagatatcctggaggcaattagagctctgaaaacaggtatacaagtatgaagaatgaggggtgaagaattgaagaataaggaaaggaaaatatatttgttattcattaaatggaagtgtatcgtaaagatactcatccttgtcttcacgttgagtagttggaggagtaagggaaaagagaaaggctgttcttgctttcttggatggtagaggtagaagaaaatccacatatgaatagacctcatttccagcctatgttgtttaagggtcaagtttagatattttgccatgtatttatttctcaaataggattttagaaagtgtaataacactaccattattacagatatgaaaattagcaataatttttaatattaaatcgttgagtgttcaaatttcccttatctcataaatgatttttatatcttatttgaattaatattcaaacaaggtgcagtgcagacattgcctttggttgatatgactaactctcttcgaaaaagttaaagttttctatctcttccgtctcttttcctcacaagtacctcccgctctactgaaacagttgtctcgtaggattgtccatgttttattagattttgcttatatgcctccagtttatcatttaacatggtcttctaaatttcttgtaaactggtggtagaagcttagtctgatttggttccttatctttttttggcaacaataataatcatagataatgttttattcttctatctggaggtatacaatatctggttgtttatgtgtgtagtgggcagacattgatgttcactgcctagagtcatttcattacaactttacaaagtcacaatattctaattttgaaaattagattgtaggtttttgtttttttttttttttttttgagtcagagtctccctctgtcgcccaggctggagtgcagtttatagtttgctctgtaaagctgcacattcttctagccagtagggctgtaaaggaaaagttttaaaaacctggccattgtcctcaaggtatctaatgagatgtctcactaacaagatagttctttgatggggctgtatcagcattgtgcacaggatgtattaagaacatgaaaggccggcgcactggctcatgcctataatcccagcactttgggaggctgaggtgggtggatcacgaggtcaggagttcaagacctgcctggcccacatggtgaaactccatttctactaaaaatacaaaaattagccgggtgtgggccaggcatagtggctcacacctgtaatcacagtgctttgggaggccgaggtgggtggatctcgaggtcaggagtttgagatcagccctgccaatatgatgaaaccccgtctctactaaagatacaaaagattagcagggtgtggtggtgcatgcctgtaatcccagctactcgggaggctgaggcaggagaatcgcttgaacccagaaggcggaggttgcagtaagctgagatcgccccattgcactccagtctggacgacagggcgagagtctgtcttttaaaaaaaaaaaaaaaaaaaaaaaaaaaaaaaaagatggccgggcgtggtggctcacatctgtaatctgtaatcccagctctttgagagactgaggtgtgcgatcacctgaggtcaggagttcgagtccagcctggccaacatggtgaaaccctgtctctacttattaaatacctgggtgtcgtggagcacacctgtaatcccagctaatcaggaggctgaggcaggagaatcgcttgaatccaggaagcggaggttgtggtgaatcgagatcacaccactgcactccagcctgggcaatagagtgggactccatttaaaacaacaacaacatgaaagaagataggcttagctttatagagcaagtgacttggggactgattctggaagtgatagtgtcaggcccattgagtggtagtgggtagcctggaaaggctatagagtttaaaaagaaagattggaagtgtggggaacatctccagaataaaatagcatgacatgtgagttaaaagtatgagctctggactcagactgcctaatgctaggtagtacctggtaatgattaagaaaattataactgggccaggcgtgttggctcacccctgtaatgtcagcactttgggaggctgaggtgggaggattgtttgagctcaggaatttgagaccagtctggaccaacatagtgagacctttggctttacaaaaataaaaataaagaacagttacctgagtgtgatggctggtgcctatggacccagctactcaaggctgaggttgaggtgggagtatcccctgagcccaggagttcaaggttacagggagctcttactgcaccagagcattccagcctaggtgacacagtgagactctgcctcaaaaaacaaaaattataactatagctaacatttattgatcagttactttatattaaacttaagcactgttctaatatatacctcatttaaccttcacaaaagcccacagtaagctgttatatttatgaagcagtggatccttgggttaacaaattgctcaagactaatgtagttttccacaatccttactttcagtcactaagctctactcctgtcctggatgttagtgttaaaagaattaaaacagagcaaaaacaaagtaggtattgaataaaaagtaaggagaaacaggcattagactttgtaaagattttaccaaatggaggtgacatgcttgggaacttaatgtaaagagacattggagaagagtttcaagtaaaggtaaatagatcagtgttaccacatttaggaaaacagtacttgttattcatacttgtgggtttgggatacccccagctatcaagtgatttcagattaagggatagtctctgctcttgactgctactgtggccagttaaaaattttatttggagaaaacttgtctgtttaaatcacaagtcttacagctgtattagaattaaatacccaagatgctttcctttatctaagagaacacagatactgctgaatttgaacaaatgattttttttttttttgagacggagtcttgctctgtcaccaggctagagtgcagtggcgtgatcccggctcactgcaacctccgcctctcgggttcaagtgattctcctgcctcagcctcctgagtagctgggattacaggtgtgcaccaccatgcccagttgatttttgtatttttagtagagatggggtttcaccacgttggccaggctggtcttgaactcttgatctcttgatccacccgcctcagcctcccaaagtgctgggattacaggcgtcagccactgcgcccagcctggatatgtggactacttttctataagatgtaagatgtcttagatttaaggaaaattagatagatatgtcatggaattgatacttcattttcactgaggtggatcttaatatctcttttataagggtgttgatactatgtattcttatgttactgagagaatgtctcacacattttgtagagttattttaattttcaaatctttctaactcatttgcatcgaattctaaaaccaagttttcatttgtgtttaagctgggagacaaattaactagggtttttctttttttttaggcggaggtttgacctacagaacccatctcgaatggatcgtaatgtggaaatgtttatgaacattgaaaaaacattggtgcaggtaacttggaaacttaggttatttaaaaagtttacctttaatatattttcagttttaagattggctggccaggcgcggtggctcatgcctgtaatcccagcactttgggaggccgaggcaaggcggatcacgaggtcaggagatcgagaccatcctggctaacacggtgaaaccccgtctctacttaaaaaaaaaaaaaaaaaaaattagccgcacgtggttccgggtacctgtagtcccagctactctggtggctgaggcaagagaatggtgtgaacctgggaggcggagcttgcagtgagccgagattgcgcccctgcactccagcctgggcaacagagcgagactccgtctcaaacaacaaaaacaaaaaaaagattggctctcaaaaaaacaaaaaaaaccacagattggctttattggattgccaaaagaacaaaggaagaaaatgttctgaaaggtattgttttattatttttatgggtgtttggggattagagctatgattaatcttgtctttaagagtattaaaatttatggtgagataatttatggtaattttcttcattaattttacctaatgtattgtttgagttgtctttattttattattttatttttattttctttgagacagggtctcactctgtcacccaggctggagtgcagtggtgcagtcagagctaggctcactgcagctttgaactctcgggctcaagtgattctcccacctcagctttccctgtagctgggactacaggcacacgccatcacacctggctaatttttttatatcttttgtagaaatggggttttgccatgttagccaggctggtctcaaattcatgaattcaagcgatttgcttgcttggcctcccaaagttctgggattacaggcatgaaccacagagtccggcctgccttcattttatttagtataagcactcttccatcctactgttcacttgattgaatattttctttggatttgttccatggttgtaccataaatatacatattatttctctaaatgtattataacttggaaaagagaatgcttaatgtccttatttgtgtttcctaatatgtttattgtttgataatttatggtgatcactaaattaaccttcctggggagaggtagctggcaaaaattcagttagatattattgttaacttaatatgtgaaagttgtttgtcccacagattcttagctagggaaacaattggatatgttttgtttgttgggtgagggttttcttcatgatttggggagttaacatacatgttttgccattgctattttttattttttttatttattttatttgattttatatatttattttttgagatggaatctcactctgtcacccaggctggagttcagtggtgtgatctcggctcactgcaagctccaacctcccgggttcacgccattctcctgcctcagcctcccgagtagctgggactacaggcgcccaccaccacgcctggctaatttttttgtatttttagtagagacagggtttcaccgtgttagccaggatggtcttgatctcctgacctcatgatccgcccatctcggcctcccaaagtgctgggattacaggcgtgagccacttgccattgctatttttaagattaactgtaatcccttccgtagctaaaaacactacattagaccattaaagtaaatttgggtaaaattggggaggaagattaatctggcaatctggtatggtatcttaatgaaaaagttgctgaatttctttaggtcatgcttctcaatattttttgtggcagaaaaggttatctgggggtggtttgtatattgcataaataatatgatattatttcaaaactaagagaatttgaaagtctgttcttttcatcctcagaacaattgtttgaccagacccaacatctacctcattccagacattgatctgaagttggctaacaaattgaaagatatcatcaaacgacatcaggtaatagacacaatcacttcagataataatagacacgatcacttcattttgtagttgtaagcctctaataaatgacaaccatagtaatgttttggattttttgatatatttgcatcaaaagaaatttttttcttgagttttttttttttttttctttttagagatgaggtgtcactttgttgcccaggctggaatgcaatggcactatcctagcatccttgctcactgtagctttggacttctgggctcaagagatcttccagtttttttgttgttgtggttgagagagtctcgcgctgtcgcccaggctagagtgtaggggtgcaatcccggttcattgcatcctctgcctccgaggttcaagtgattctcgtgcctcagcctccgaaattgctgggactacaggtgtgtgctaattgtatttttcgtagaggtggggttttgccatgttggtgagcctggtctcgaactcctgacctcgagtgatctccccacctcagcctcccaaagtgctgggattacaggcatgagccactgtgcccggccacaatggtttctcactatgttcccaggctggtcttgaattcctggcttcaagtcatcctccagcctcgccctcccaaagtattaggattgattataggtgtgagccaccatacctggcctctttttgagttcttaaagtaccagtgttttttttctctcccctcatctttagcttttagcctagagtagcatttaataaagtcattgctatggagtcgttagtcttattgtaaagtgtgcttacatagacctaaggaaactagtgtattatgtatcacagaaccctatatcacagagattataaagtcaaatagagttggtaacataattgttggtaagaagaaatgaagtattactttcaagtaatcctgtcttccctaaccccccattttatgtattctgttacatatatgatttaaaaaaaaaaattgaaggccgggcgtggtggctcacgcctgtaatcccagcactttgagaggccaaggcgggcggatcacgaggtcaagagattgagaccatcctggccaacatggtgaaactctgtctctactaaaaatataaaattagctgggcatggtggcatgccactgtagtcccagctactggggaggctgagtcaggagaatcacttgaacccaggaagtggaggttgcagtgagctgagatggcgccactgtgctcctggtgacagagcgagactccgtctcagaaaaattctgccccctcaagcttgctttgtcttgatacacatgtactagtactgtgttctgacatcttagccttcttcttctgacttcattttaggctgagactttgggtatttactacatgtaagtttgtgattacatgtgactaaactgtaattaagcccatcacatagtaagctagctgaggagacttacgtagaagataattttcctgaaacattctttatgtgactgagttttatggatccttagaattggttgagaagcctcatgaaatgtctttttttcctgctgcaaaagagattaccaattgtattatgttttagcatttagtaaaatatcttgcatgttctgaaagttaatgtttctaatactgcgtacaattatagattgagtacattcttcctcttatatatgacatctctctcaaagtgtaaggtaatataattattttatcatattgggcaatctgaagtccagttccttttttcactagtatcatggctttgaacagattccttaaacatctctcttttggaatatctttttattggattgactgtcaaatgcagtttaaagtatatgtggaatgttaccagggcagaagtagaacaaattaacctgctgtttcttgccttgaagctgaaattacctactctttttgtcaccgggtcatactggaaacattttatatattgcctacagtttatgctgaatatttagctgttacatacgtgtgtgtatgtctgtatatacatatgtgtatacatatatgtagatatacatacatatgtatatatatacacacacgtacatatatgtgtatacatgtatatatgtgcttgtatatatgtatatacaagcacatatgtgtgtatatatatacgtgtatatataccttttttttttttttttttgagacagagtctcgctgtgtcgcccaggctggagtgccatggcgtgatcttggctcactgcaagctctgcctcctgggttcacaccattctcttgcctcagcctcccgagtagctgggactacaggcgcccaccaccacgccttgctaatttttttgtatttttagtagagacggggtttcgatctcttgaccttgtgatccgcccgcctcggcctcccaaagtgctgggattacgggcatgagccaccgcacctggcccttgcgctgctaattttttattttttagtagagacggggtttcaccatattggaaaggctggtctcgaattcctgacttcatgatctgcccaaagtgctgagattacagtcatgagccaccttgcccggccttcttgttctttttttaacaacaggtgtgctccactgcccctggctattttatttttatttttgaagagacagggtcttccctaggctcgcctcaagctcctggcctcaagagattccccctgctacctcggcctcccaaagtgctgggattgcaggcgtgagccgcagaacccgccctgcagcaccaccccgcagccgccctgctcctttttttaaatggaaggtttgtggaaactgtgtcaagcaagtctgttggtgccattttcccaacagcatgtgcttacattatgtctgtgtatcacattttggtaattctcacagtatttcaaacttttttagttttttgcttgtttatttgtttttttttgagatgaagtctttctctgtcgcccagctggagcgcagtggtgtgatctcggctcactgcatcctccacctcccgggttcaagcagttctctgactcagcctcctgagtagctgggattacaggcacccgccaccacatctggctaatttttgtatttttagtagagacggggtttcactgtgttggccaggctggtcttgaactcctgacctcgtgatccacccccctcggcctcccaaagtgctgggattacaggtgtgagccaccgcgcctggcttacttttttagtattattatacatgttatagtgatctgtgataggtgctatttgatactattttaattgctttggtttagcacaacacccatagaagatggtgaagttaattgataaatgtatgtgttctgacttcttcactgactggccacttctctatctctctacctcttgtctagcctgcctattccctgagacccacaagtattaaaattaagccaattaataaccctacaatggcctctagctggtcaagtcaaaggaagagttgcttatctctcactttaaataaaaagctagtagtgatttagtttagtgaggaaggcatgacaaaagccaagataagctgagaacttggcttcttaagtcaaacagctaggtttttagtgcaaaggaaaagtttttgagggaaattaaaagtgggactgtagtgaacatgcaaatgataggatgcaaaacatgcttattgctgatactgagaaagtttcagtggtctggttaggagatcagagcagcccaacatttccttaagctaaattctaatccagaacaaaggcctaactctcttcaattctgtgaaggctgagagagagaggtgaggaagctgcagaaggaacgtttgaagccagcagaggttgcctaatgaggtttaaggaaagaagccgttttcagaacataaaaatgccaagttgaagcagcaagtgctaatgtagaagctgcagcaagttatccaggagatttagtaaagataattggtgaagctggttacaccaaacaacagatgttcaatgtaaatgaaatagtcttctattaaaataagatgctatttaggactgtcatagttagagaagtcaatgcctggcttaaaagcttcagccaggctattttggggcttaatgcagttggtgactgtaagttgaagccaatggtcgtttgccattctgacagtcataaggccctacagattattgtacatctattttgcctgtgctccataacaaaacagcaaagcctagatgacagcacatctatttacagtatggtttactgaatactttaagcccactgtagagacctactgctcaggaaaaacaatttcttttgaaatattactgctcattgacagtcacctagtcactctgttgcagatgtacaaggaaattaatgttatttccatgcatagtaacacaacttccattctgcagccatgttttaaggagtattttgactttcaagtcttgttatttaagaaatacattttgtaaagatagagctgctatagttagtggttcttatgatggatctgggcaaagtaaattgaaaatcttctggaacagattcatcattctagatgccactaagaacacatgcgattcatcagaggtcaaaatatcaacagtaacaagtttggaagacgtggattgtgaccctcatggttgactttgaggggttaaagactttagtagaggaagtaactacagacgtggttcaaataagagaactagaatttgaagtgaagctggaacatgtgactgaattgccgcgatctcatgacaaaacttgaacagatggaagagttgtttcttatggatgaacaaagtgctttcttgacatggaatctactcctggcacagtcgctgttaacgttgaaatgagaacaaaggattttaaatattacatacatttagttgatacagcaagcagcagggttttgaaagaaattctgctgtgtgtaaaatgctgtcagcatcgcatgctacagagaaatcatttgtgaaaggagtcaatcaatgtgacaaacttttactgttgacttaagaaattgccacagccaccttaaccttcagcaaccaccaccttgatcagtcagctgccagcatcattgaggcagtgtcctccagcagcaagaagactgatttgcttaagtctcagatgattgttggcattttttttttttttttgagatggcattttgctcttgttgtccaggctggagtgcaatggcgcaatctcggctcactgcagcctctgcctccggggttcaagggattctcctgcctcagcctcctgagtagctgggattataggcgtctgccaccacacttggctaattttttgtatttttaatagacacgcgtttcaccacgttggctaggctggtctcgaacttctgacctcaggtgatccacccaccttgacctcccaaactgctgggattacaggcgtgagccactggacccagccgctattgttagcgttttctagcaataaaatatttttaaattaaggtatgtacactgttttctaaaactgtgtaaacttaacttttgatttttgttttgagagacagggtctctctcactgtattgcccaggctaacgtacactggcataatcatagttcactgcaaccttgaactcttgggctcaaatgatcctcccacctcacctcctgagtagctgggactacaggcacaaaagtgccgggctaatttcttttttaatttgagacaaggtctcactgtgttgcccagactagtcttgaactcctaggctcaagtgatcctttcacttcagccttccaaagtgctgggattacaggtgtgagcagctgcacctggcctaaatgtaactttttttttattttttatttttttgagacggagtctcactctgtcccccaagctagtggtgccatctcggctcactgcaaactctgcctcctgggctcaagtgattcttctgcctcagcctcttgaatagctgagattacagacgtgtgccaccacgcccagctaatttttatatttttagtagagatggggtttcaccgtgttggccacgctggtctcgaactcctgacctcaaatgatccacctggctcccaaattgctaggattacagacatgagccaccacacctggccataaatgtaacttttatatgcatcaggaaactaaatttgtgcaactaattttgtaatgctttattacggtggtctgaaactgaacttgacgatgtatctgtgttacgcttgcacatagtcctagtttatggctcaaggccaggaatggcattgattcacttgaagtaatgataatttgtgatgactttggaagtaattttaagaagtaatagtacctgactgaacacagtggctcacatctttaatcccagaactttggaaggccaaggcaggcagctcacctaaggtcaggagttcaagaccagcctgaccaacatggtgaaaccccatctctactaaaaatagaaaaattagccaggcgtgctggcgggtgcctgtaatcccagctactcaggaggctgaggcaggagaatcgtttgaacccaggagacggaggaggttgcagtgagccaagattgtgctgccacactatagcctgggtgacagagcaagactccatttcaggaaaaaaaagaattagtagtacccatattactgatatggatacccagagagagagatctgtagagaactagctaataggtgctcgaattacttttctatacagcagtctaaactgtgtagacaattttttggtttattgttgttaatcacttttttttatttgactaaaaagaagcaagtcttttttatataaagtctataagtaaaaccatgcttttagaatttgtatggaatttgtatctggaatctcatagttcattgccatgtgctttatttttgtggtttttgttcatttgctttccagggaacatttacggatgagaagtcaaaagcttcccaccacatttacccatattcttcctcacaagacgatggtaagttagttttgcgttgtgaacagatgagctcatacatcataccaaatggattttatgtcatacccccaaagacttaaacagaataaccagctttttatttgtttttgttttgttttgaagatggagtctgtcgcccaggctggagtgcagtggcgcgatctcagctcactgccacctccacctcccgggttcaagagattctcctgactcagcctcctgagtagctgggaatataggcgcccaccaccatgcccagctgtaatatttgtatttttagtagagacaagaatttcaccatgttggccaggatggtggtttcaatctcttcacctcgtgatctgcccaccttggcctcccaaagtgctgggtttacaggtgtgagccactgcgcccagccaacattaacttttaaaagatgtagtagaagctgtgcctagaggaacatttatttctttatattaggaaaggagaaaggttagaaatcagtggtccaaacatctttctcaagaaattagaaaaacaacaccaaattaaacctaacgaaaaaggaaataataaaagcaaaaattaatgatgtagaaagtacacattagtgagatattcagcaatgtcaggtggttcttagactaatgagggctggacctggtgtctcacgcctgtaatcccagcagtttgggagtccgaggtgggtggatcacttgaggtcaggagtttgagatcagcctgaccaaaatggtgaaaccccatctctactaaaaataccaaaaattagccggctgtgctggcacccatttgtaaccccagctacttgggaggctgaggcaggagaatcgcttgaacctgggatatggaggttgcagtgagtcaagatcttgccactgcactccagcctgggtgacagaaggagactccatctcaaaaaaaaaaaaaaaaaaaaaaaaaagggactaataaggtggttaaatccgggtgtggtgatacgtgcctgtattccagctcctctggaggctgaggtgggaggatcacttgaggtcaggagtttgagactgtggcatgtgataattgtgcctttgcgtagccattgcactccaacctgggcaacatagtgaaatctcatgtcttaaaaaacaaggcctggcgctgtggctcaggcctgtaatcccagcactctgggaggccaaggcgggtggatcacctgaggtcaggagtttgagaccagcctcaccaatatggcgaaatttaaccaagagtggtggcaggtgtctgtaatcctagctactcgggaggctgaggcaggagaatcgcttgaacctgggaggtggaggttgcagtgagctgagattgcaccactgcgctctagcccgggcaagaagagcaaaactctgtcttacctaaaaaaaaaaacaaaaaacaacctattggtaaaagaggaaaatggccaaaacccaggttaaaataattaggtgaatggataaacaaattgtggtatgtacacacagtacaattttttttttgagatgtagtctttgttctgtcacccaggctagagtgtagtcatgtgatctcggctcactgcaacctccgcctcctgggttcaagtgattctcctgcctcagcctcctaagtagctgggattacaggtgcccaccatcatgcccagctaatttttgtatttttagtagagatggggtttcaccgtcttggccaggttggtctcgaactcctgacctcatgatccacctgcctcggcctcccaaagtgctgggattataggcgttagccaccgtgcccggccagtttttttgttttaaggtggagtcttgctgtgtcacccagaatggagtgtagtggcgtcatcttggcgcactgcagcctccgcctcctgggttcaagcgattctcctgcctcagcctcccgagtagctgggactacaggagtgcaccaccacacccagctaattttttttgtatttttagcagagacagggtttcaccatgttggacaggcttgtctcaaactcctgacctcaagtgatccaaacgcctcagcctcccaaagtgctggtattagaggcgtgagtcaccactcctggtcccacacagtggaatattattcagccttgaaaaaaaaaggaaattttaacacatgctaataacatggagaaataccatatgattccaattttatgaagtacccaaagtagtgaaattcattgatactgaatataacatggttgttatcagagactaagaatttgaccaccttagatgaaatcatacagaatttgtgtttttatgattaatttgttttgcttagtgtaatgtcttcaaagtttattcatgttacagcatgtgctagaatttcctttttaagcctggctaatgctccatcagggagttgctgttcattgggtgtagggttttagtttcataatgtacagagagatctggagattggacatgcaacactgggtgtacctaacagtactaaactgcttacttataaaatggttaaaatggtaaattttatgtttaccgtcttaacagaaagcaagcaaaacactgattaatagaataaagcattggcaataacaataataatgatgaagcaatccaaatagagttaaactctttaaaagcgttccaccatgtagagctaaattgttgtttccactgttttcctgtttgttttctatatccatacatattggttgcctttcagcttcctgactgggccatgttctctctttatttttattttttaaattattttacattattattaaatatattagagatgggtgtctcactatatttcctaggctggtgttgaactcctggtatcaagcagtcctcccacctcagcctcccaagtaatattgtttattattttttaataacaggctaattgagatataatccacataccatgaaattcaccttttttttttttttttttttgagacagagtctcactcttctacccaggctggagtgcagtggcgtgatcttggctcactgcagcttccgcctcccaggttcaagcgattctcctgcctcagcctcctgagtagctgggattacaggcatccaccacgacacccagctaatgtttgtatttttagtagagacggggtttcaccatgttggccaggctcgtcttgaactcctgacctcaggtgattcacccgacccagcctcccaaagtgttgggattacaggcatgagtcactgcgcctagcaaaattcaccattttaaaatgcacagttgggctgggcccgatggctcatgcctataatcccagcactttgggatgctgaggcaggcggatcacctgaggccaggattttgagaccagccttgccaacatggtgaaaccccgtctctactaaaaacacaaaaaaatagctgggcatggtggcgggcccctgtcattccagctatttgggaggctgaggtgggagaattgctcaaacccaggaggcggaggttgcggtgagccaagatggcatcactgtgctccagcctgtacaacagagtgagactccatctccaaaaaaatatatatatataataataataaagtgcacaattgaaaattttttagtatatttacagttgtgcagccatcactgttaatttcaaaatgttttcatcactttaaaaataaacccatacctgttagcagtcactttcccttctcccacgttagtccttgacaaccagcagtctactctcttgctgtatagatatatttgttcaggtcatttcgtagaaatgaaagcatgatgacatacgatctcttatgtctcactcttttcatttagcataatattttcaaggtgaatctgtttgatattgtattccttttttattgtggtaaaaaacacataacatttatcttaatcatttttacatatacagtatagtagtgttaagtataaacatcttgtcgtgcaatagatttttttttttttttttttttttttgtggagacagtctttttctgttacctaggctggagtgcagtggtgcgatcgtggctccatgtagccttgtcctcccaccccagcctcccaagtagctgggactggtggtgcacaacaccacacatggctaatttaaaaacaatttttgtagagatatgttgccaaggctggtttcaaactcctgggctcaagtgatcctcctgcctcacttagcctcccagtgttttgggattacaggcgtgagccactgtgcacagtcacgtgcaagagatctttagaactttttcatctggcagaactgatactctgtacccattaaacatctctttttctctttcccctagcacagggatgtccagtcttggcttccctgggccacattggaagaataataattgttttgggccacacataaaatacagtaatgctagcaatagtggatgaacttaaaacacacccagaaaaaccataatgttctaagaaaacttatgaatttgtgttgggctacattcaaagccatccttggctgcacgtagctcatgggtcttgggttggacaagtttgtgctactgcttttgactaccattctgctttctaagagttcgactactctagataacctaatataagtggaatcatttagtatttgtattattgtgactggcctattttacttggtacagtgtccttattgttcattcatgtcatagcatgtgcctgtattccattatatttgtataccattttttatgtattcatacttagatggatatttaggttgcttttgcattttgactattgtgaatactgctgtaatgaacatgggtgtgcaagtatctcttcagcatcctactttcatcctactttattttgggcatatacccagcagtggaattgctagatcgtatggtaatactgtttttaattgttttgaggaccctttcatagctgctacatcattttacatactcaccaacggtgcgcaatggttccagtttctctgtatttttgttaacactttttattttctgttttgttataatggtcatcctaacagataaaaagctgatatatcattgttttgattttcattgtcttgatgattagtgacattgagtatcttttcatatgcttattggtcatttgtatatcatctttggagaaatacctactcaagtacttttttcgtttttcttttttctttttattttttaattttttgagacggagtttcactcttgttgcccaggcctaaagtgcagtggtgtggtctccgctcgctgcaacctccacctcccaggttcaagcatttctgcctcagccactcaagtagctgggattacaggcccccgccaccatgcccagctaatttttgtagttttagtagagacaaggtttcatcatgttggccaggctggtctcaaactactgacctcaggtgatctgccgccttgacctcccaaagtgctggggttacaggtgtgagccactgtgcctggcctcctttttaaattgtttgttgttgttcagttgtaggccttttaaatttttttttttttaagacagaatttcattccgtcaccctggctggttgcagtgagctgagatcgtgccactgcactccagcctgggcaacagagtgagactctgtctcaaaaaaaaaaaaaaaaaaaaaaacccaacaaaaaaacccaattctgttcttctatctaagctaatttcaattattatattaactgtatgatatgctaattattaactgtattttacattatactaattattatattaactgtgtatttttattttctgtgttcttgttgctctggcatttgatgacctggggagagattgcccttttgagggctagctaatttctgaagataataacttgcctaggagcacatctttcatatgtaaaccaaccaatctgagtatatagctgtaaccgtctccttatctaactctcacacaccaaaccagtatttccccttttctaaatcattccagggcgaggtaccaggcaattagagacaacctctgtaccccagtgtttcttgcaattattcagtcatccccaccttaaactgttactctgccctgtgttaccttttctgtggaaaccccaatgcaggctttggcttaggcttccccttgttcctgtcttctacctcttgactattgtgatgcctctgcagtggctctgcatggtatgttattttccttcttttgggatatataagtaattcatctttcaatggcattggccttactcttttgtcattcagccatacttctataaattcatttttgggtataaatttataatacctgggaagagagcgagcttacatctcacaccttttgttgtttctgctattggaaaatatttcaaataattaaaaaaattgtcttgataaaaatcaaaaatttttttggccaggcacagcggctcatgcctgtaatcccagcactttgggaggccgaggtggtagatcacctgaggtcaggagtttgagatgagcctgatcaaaatggagaaaccccgtctctactaaaaatacaaaaaattaggcatggtgtggcgcatgcctgtaatcccagctacttgggaggctgaggcaggaaaatcacttgaacccgggaggcagaggttgtggtgagccgagatcgcaccattgcattctaacctgggcaacaagagtgaaactctgtctcaaaaaaaaaaaaaaaaaaaaatcaaaatttgtatcaaaagtcagctgtggttaggaaagataccttttcttctttttcataaaggtgcatagtctttgataatggactcagtattctgaaaggcagcttttactagttagaacaccaccaagacacacttaacaggacaggacaggttagtttaggtagtcgggatttagaaagatcctctggccccttttcttttttcctctgccatgttgagttaccatgttagggaacagggcctgattctgtcattttcaccttttgttttgagatggagactcatttttgcccagcctgaagtgcaagagtgtacttattaatagcccattgcagcctcaaactataatgctcgtgatcttcctgccctagcctcctgagtagctgggagtatagatgcacaccaccatgcctagctatttacttttatttttaaaattttttaagagactgaatctcactttgttgcccagggtggtcttgaactcctgggctcaagtgatcttcctgcccctgcctccaaaagtgctgggattacaggcatgaaccaccacacctggccccctttcactttcttttaagatagttaggtgagtcattgtatacttcaaaaacagcacaggtatgagggcttcatggctttattcagtgaaaatgaggctatatcttgttaaaatctgcactggaaagtaatttttacttggctaatttacttagatctgtttgtttgtttgtttgtttgtttgctgtgggctttaagggggcttacttcagaacttctctcttactattaggcgtccattttctaagctaaattcagactaccaaagaagcacatgattaccagtgctgaaatgtggaggtaatttaactgtgattagaatactaagaatcactttattatataatttgcacttatctttggaaaaaatttttgaaaaaaagtctacaatatgtaatcacattgcttacactcttgttgggagggctaacaggtatgaggcagtgaaagaatagtaaaaatagtatttttggtaaaagctttgatgtagcactttacagcttataggacatcagaaaaagggaatctagaggaagcagagtagttagtaaaactttcatcaatgagatgaagtacggtttacatcttgaaagatgtgtaataattgctaagcctcacagaaagagggatgagaggttcaccatgggaagtgaaacattaaataatatggtgattattattttgatagaagagagaggggaggctggtgggtgaatgggatgggagtattttaccgcagtggataattggttttgtcaagagtgatggatagtagacctacagtttggaaagtcagaaagactgagaaatttccctttaatctggtagatagtactcaatttgaaaactttttctttccaaaccagcaacagcatgttcgaaaaatgttgttcgttagcaaactaaaacatcttagtaaaaattaaggctaaaaatcatagtttctttattattttgtcagtttgagtaaagttgtttctttttctcttccagaagaatggttgagaccggtgatgagaaaagagaagcaagtgttagtgcattggggcttttacccagacaggtaatgttcatatgctgtgagacctggtataaagatttctgtgaaaggaaggcacatttatttatagttttattttctgaatagtgacaatttgttgctttgtgtttagtcatttttctcacttatggagtcttttattgactgttttcttatttaaggtacaaaatttaatgaggtcaccattaaatggtgaatgaataagccataaatggctttatttagctttaaaaaaaactgatatcaaggctgggcacagtggctcatgcttgtaatcccagcactttgggaggctgaggcagtggatcatgaggtcaggagctcaagaccagcctggtcaacatagtgaaaccccatctctactaaaaataaaaaaaattagccagacgtggtggcaggtgcctgtaatcccagctactcaggaagctaaggcaggagaatcccttgaacccgggaggtggaggtttcagtgagccgagattgcgccgtttccctccagcctgggcaacggagtgagactccgtctcaaaaaaaaccaaaaacaaaacctcatatcttttatgtagttgccaaaaaagtctgtgtggtattaggttgctaatttatatttgtttcttttaagaaatgaattttgccgggcacagtggcccatgcctgtaatcgcagcacttggagaggccaaggtgggtggatcacatgaggtcaggagttcaagaccagcctggccaacatggtgaaactccatctctactaaaactataaaaagttaaccagacatggtagcgcacgcctgtaatcccagctactcaggtgtctgaggcatgagaatcacttgaacctgggaagcggaggttgcagtgagccgagatcatggcactacactccatccttggtgacagagtctcactctgtcttcaaaaaataaataattttttttctagtgtttattactgatcagatttttttgagacagagtcccgctttgtcgcccaggctggattacagtggcacagtcccgactcactgcaacctccacctcctgggttcaagtgattctcctgcctccatccttcctagtagctgggattacagatgccccccaaccatgcctggctaatttttgtatttttagtagagacggggtttcaccatgctggtcaggctggtcttgcactcctgacctcaggtgatccacccaccttggcttctcaaagtgctgggattacaggtgtgagccaccgcgtccagcctgatcagtttgcttttttcaaaaactacttatgcgaaaccactaaggatgaaattaatttatgttgaaaattgagttttctcatcagaaatttatttgcctagtactgttgtggctttacatgttataacccatactagtttcagtatctacagtatgaataacgagtattataaacaagagctagatattagtgaaaatagtggggccgggcgtggtggctcacacctgtaatcccagtactttgggaggccaaggcgggcggatcacgaggtcaggagactgagaccatcctggctaacacggtgaaacccccgtctctactaaaaatacaaaaaaattggccgggcatggtggtgggtgcctgtagtcccagctacttgggaggctgaggcaggagaatggcatgaaccccgggggcggagcttgccgtgagccgagattgcgccactgcagtccagcctgggtgacagagactccatctcaaaaaaaaattttttttaatttattaaataattatttaatattaatgcctgcatagtgcacatggaaatagggataacattgtttgtactatatttttctaaacctatagtagagcagttttagtatttatttcattcttgtcatgtaaagtggagattttcattgtgttttctacaggtctagtcagtcttctttcacctactttttttatttttatttttttattttattttttcataagttattggggtacagttgatatgtggttacatgagtaaattctttaatggtgatttggtgcacccatcatccgagcagtatacactgcaccttatttgtagtcttttatcccttgcccctaccccccacttttttttaacctcttcttctatctacttctcgtcttctcatattatttatagcaaatcccaaacaccatttgaatcataagtgttttagtatgtatttaaaaagaaatacattctctctttaatttttttcagatggagtcttactctttctcccaggctggagtgcagtggcgcaacctcagctccgcctccctggttctagcgattctcatgccttagcctcctgagtagctgggattataggcgcatgccaccacacctggctaatttctgtatttttagtagagatgagattttgccatgttggccaggctggtttcaaactcctgacctcaggtgatccacccaccttggcctcccaaagtgctgggattataggtgtgagccaccgtgcctggccttttttttttttttttttttttttgagacaaggtcttgctctgttacccaggctgcagtgcagtggcatgaagacagctcaagtgatcctccaacctcagcctccctgggggctggcactacgggcacgtgccacccataggtgccttattttttaattttttgttggcgggggcagggggggtgctctgtatgttgttcaggctggtctcaacctcctggcctcaaactgttcaaagtaataataccattgtcatcttaaaaaaacccaaacagttccttaatataaaatatcatggctgggcatgatggctcatgcctgtaatcccagcactttgggaggctgaggtgggtggatcacttgaggccaggagttctagaccaccttgggcaacgtggtgaaaccttgtctctacaaaaaatacaaaaattagccagtcatgatgacacgtgcctgtagtcccagatacttgggatggggctgaggcaggaggattacttgagccccagaggttgaggctgcagtgagctgagaccgtgccactgcactccagcctgggcaacagagtgagaccctgtctcaaaaaaataaaaataaaaatccagtcaatgttgtcaattaaatgacacgattgattgattgatagttgtttgaattagaatttagataaaatctacctgttgggattagttggtatatttaagtacttttctgatttatagttttataggttcttcctctgtcttcatgacctcccctttcttaaaaccttactggttttaagaaaccagttggtttgtcatgtttcgtttaccacagtatggagtttttcaatggcagcactatggtttatttgaacggattactgtgttctctgtatttcccttaaattggtagccggatctaaggttagtcagattccattttaattggggaggaacaagactattgcatatatgtgtattctttatcagtaaacataaaacatcaggttttgcattgtttttattagtctatttaagtttattttgcttgtaattatatttttaaaagaaggaagtttgtctttagattcattcaacattttaaaagtatatacaatctttttatgtagttcgagttaattacaactaaatcaagtcagctttgtaatcagtctcatgtgaaccataattgacaaatttaagtgaataacttcccctcccctaaggattagttttttactttttaaaaatatgttgcccagactggcctcaaattcctgggctcatgtgattcttctgcctccttactaactgggactacaagtacatgtgactaggcccagcttatttttaaaacatcatttgaataagttctttctgtaaagcactcccagtctaaaggcttcaagtcagtagtccttgcatccaaaaacaccttttaatatttcagcaactatataggaaaaggtttgccctttgaaacccttcaatggaaacttaaatttatgatgacaagctacataagtatagagttggtataagttccaaaataacacattttaagaccatagcctgtttgctcactttttccttatgtatcgaataagatgtggcagctggctcaggttttgtcttaaggagtcttgttaattcactttttaaaaattaactatggcctgtgccctcacttctccccacatttcaatttctaatcaagactggaagagtataaggttgggttttttttttttttttttttttttgagatggagtctcactctcacccaggctggagtgcagtggtgcgatctaagctcactgcaaactccacctcccaggttcatgcgattctcctgcctcagcctcccaagtagctgagattacaggtgcacactacaacgccccgctaatttttgtattttttaatagaaacgggatttcaccatgttggccaggctggtcttgaactccttatacttcaggtggtccactgccttggcctcccaaagtgctggaattacaggcgtgagtcactgtgcctggccaggttccatattcttttgaactgacctctgaatggtgactaaaaggaagctaatacttgtcatcatactagatgtcatttggtttcatagtttactggtcagtatagtgatattcacagtgttttattttggttaaaattttgtgcctattttatgattttgttggagtaggtggtctgatttatgtcagtgagttcttgttgataaagaggctccttgagcaaagagatgtgaagaaataagagagtaagctatatggatatctggacagtgagggagcaatctgtgtagagtgtatgcaggcttagtagggaatgttggaataatgttatcaaagcctgtgtggctcaaatataacatgaataaggacagaagagcaggaaatggggtcagagtctctgtcagataattagatcttgaagccatggcaagccatcgttaggttttttactttcactctgatagggtgagagcagttggaagtgttggatcagtagagtgatgtggactgacttagttttcaaaaagatcacaatggctatgtgaaaaattaactctttgagagaccaagagaccaatggcagaagcaggaaaaccagtgagcagagtggaggggtaagaattagatagattctagacatacttttgaagttagagctggtcacatttgcagttggtttgattacaggatgtgcttgagaatggaatcaaggctgtttccaaggattttggcgaacagcaggaaggataaagttgtcattactgaaatggaaatgattggctagagtacatcgctggggccagggtagcattgcaagttgagctttgagtgttaggtttggaatgcttgttagatgttctacacaaggagatgtggagttggctgttggatttatgagttcagaatacatgggagagtgctgatataaaatttgaagtcatcagcgtatatttggagttataggaatgaatgaaattagcaagggagaaggatttttccaaaaactgaacccaggaacttttggaggttgaagacatttgggactaagaccagaaactgacatggaaactgaagagaggctggtgaatataaggactatcaggtgatagtactttcttggtggccaagtgagggaaatgctttgaggaaagaccaagcagctgtttaaaattttttgatcttagtcttgaacttcgggtttagcaatatatacgttactggtgacctctacagaggagctttcttggcagaatagtaaggacaaaagtgtctgataagtttctattaatagattttagtagtatttcttttagttttttgttttgttttgttttgtttcgagatagggtatcactctgttgcctagactgaagtgcagtggtgtgatctcagttcactgcaacctctgcctcctgggttcaaacgattcttccacctcagcttcctgggtagtggggactacaatcacatcccaccatgcccggctaatttttgtattttttggtagagacgcagtttcaccatgttgaccaggctgggattttagtagtatttctaaaacatgttcttattatttgtaaaagtctttctaatgaattacctttgactctaatttgtttttctcattttgattcctttatagctatgatacttgggtccatagtaatgatgttgatgctgaaattgaagatccaccaattccagaaaaaccatggaaggtaaatgatttaacaaaaaaaatcttacaataatctttttaaaattttttttgagatggcgtctcactctgtcgcccaggctagagtggagtggtgcgatcttggcttactgcaacctccgcctccgggttcaagtgattctcgtgcgttagcctcccaagtagctgggactataggcacacgccaccacgttaggctaatttttgtatttttagtagagacggagttttactggattggtcaggctggcctcagcctcccgacctcgggtgatcggcctgcctcagcctcccaaagtgctgggattacaggtgtaagccatcgtgcctggccaaaaaaattcttacaataatctaatagctcttctcagctgttttctacagcagtctctctaaggagatacagaatgttggtttccctttcctgtcatccatttacaagatacgtacggccatgaagactttattatctaggtcttagatgaaatgtctgcagtgcttgatgtttgaggagaatccaaaggcaggtcagattgtggtttgtgagagaggagtgtgaggagtagagttgaacatcactgatgatgtcatttgggtagcttggaagcaatgcctgtgtgacttttagaatgatacagacttactttattaatcatttctaccataatgtaataagagtccatacattgacttttaatcaacttttgatgtggaaataaagtttatggggcatggtggctcacacctgtaataacaacactttgggaggctaaggcaggaggattgcttgaccagcctgagctaccaaaaaaaaaaaattatctgagcataatgtcaagtgccctatagtcctagctacatacttggaaggctgaggcaggaggattgcttgagctgaggaggttgaggctgcagtgagccgtgattgcaaccacttcactccagcctttataacaagttaagaccctgtctcaaaacaaaaaaattaattttacaagttgcaagagtagtacaaaacaaagcactacttggtacccttcttccagatttatcttttatttatttatttatttatttatttatttatttatttattttgagacggagtctggctctgtcgcccaggctggagtgcagtggcgcgatctcggcttacggcaagctccacctcccgggttcacaccattctacctcagccttctgagtagctgggattacaggcgcccgccaccaagcccggctaatttttctttttttagtagagatggggtttcactgtgttagccaggatggtctcgatctcctgaccttgtgatctgcccgcctggacctcccaaagtgttgggattacaggtgtgagccattgcgcctggcccagatttttctgtttttaactatttttggaaattaaatgttgaaattatactatcatctaatagtaaaggagtaagccatgtgactcatgagccatgtaatgttgtgaagtactactgaaggatttttagacatctatttccctgtagattatagtatcagaactgggaatgattacttaactatggtatcacattattaggaaggaaactaggctccacaagttaagtagttttacccaaggacacatggacttttgtattattttgacatgaaggtattttttatgagagagataacaaagcataggacttgagagctcagggagaacttagtgcaaatccaagctttgcctctaattaggagtgtaaatagtcagcttactaaaactgtttgcccaagttttctgatttggaaagccagagagtataatacccgcattatttcactgtgcttaggagagttaaatgagattatacgtgtaagatgttcagcatagtgcctgacacaaacagttgttagctgtcacatactcctctaacattctttctcaggagatttctttcaaggatttctcagtagttaaaggattatcagtgtgaaaattcagctcttttaaaaaaaaaaggaagcaatgtatacacatgtttctcacactttggaaaacactattttgacatttattttctaaactatcagttaattaacccttttatttagcacagtcctattttttttttctaactagcttaagcctctatttatatactctatttatttatttagttagttagttagttatttattttgagacggaacttcattcttgttgcccaggctggagtgcaatggcgtgatcttggctcactgcaacctccgcctcctgggttcaagtgattctcctgcctcagcctcccgagtagctgggattacaggcatgtgccaccaccttaactaatttttgtatttttagtagaaacggggtttctccttgttggtcaggctggtcttgaactcccgacctcaggtgatctgcccgcctcagcctcccaaagtgctgggattacaggcatgaaccaccacgcccggcctatacactctatttattctgctctatttatactgctctgtttatacactcttcccataatttgtccatttaggagtcttttcaggttacattattggaggctttatttgtcttggacaggctgttaatttggtgtttctgtatattactgtgtaactatagttttcaagggagaggaggcgtgtagtcagatgggtatcattcttaactcaaggtacttgaaaggcatatcccaaataaccagtttagtagctctttgaaaacagggagtttagattgacaaattactaggaagttcatattgttttctagtcattgccacagtgtatcttgtttttacagtgttctagaaaggcttcataattgtaatctgttcttgactgaacatgttcatttcaaccaacactactccaacttaaacctccaccatgacttgagtttttctgtacaaggaagaattttctagtgtcaaattccagttgtgcccccattgagaaatactgttggataatatggaatgttatatgggttaggcctgtggtttaagtatctatctatatgtatatatacatctacatttgtacgtccacacaacctttcattttattcttactcagaagcatgaaattaaacaagggaggtggccatataaaggactaggaagaacccaccatctgactgtcacttttccattcctacctagagcaccatgtgtacatgatggggcaggtgatcggcctctgcgaatgtgctctgtcatcaacacttagagtgttgttgataaacccaaagacatccttcgtgcctaaagcaatgactgattttggctctgtgctgttgaatgtttttatcagtgattttcatgaacataaggatgaaatgattaagcaaaacaaatttgagggactttgctatcaaaatctgggtctagtataaattattgatgctttcttgttctctttaatatggaataaaaatagagatgattaaattacaactcacatatcattagtagtatcacattattaatgttttatgcatttgaggctttgaaaataaatcagcttgtttccttctcaatactgtaaaaccttgagtgattttgttatttatgtagatattgatgctttgatatggttttaggttcatgtgaaatggattttggacactgatattttcaatgaatggatgaatgaggaggattatgaggtggatgaaaataggaagcctgtgagttttcgtcagcggatttcaaccaagaatgaagaggtattttctttggcacagtttctcatcattaagtctgtcttcttggcctaaatgttattaaatcttcatcagtaagctgtcatatacaaaccacttaggaactttcacatctgcctgatggctgatgtgccatcaggtgaaaattccaaagtggctgtaatagccatctcagaaacaataacctcccaaaaagtggtatgaaaatcttaaaaggttattaagatttaaagtggcccatgcagaagggtagtggtatagctgattttgcccactagatctgaagtgtaatatcacagcagaatttaatgtagctgttggttttcctatgcaaaactcattttgtttagtatgtatatatattttttgagacagagtcttgctctgtagcccaggctggagtacagtggcactatctcggctcactgcaacctctgcctcttgggttgaagcgattctcctgcctcaagcctcccaagtagctgggattataggcgcttgccaccatacctggctaatttttgcatttttagtagagacagggtttctccatgttggccaggttggtctcgaactcctgacctcaggtgatcagcctgccttggcctctcaaagtgctgggattacaggcatgagccaccacacccgacctgtttaatattcttaaataactgttaatccacagatggtagttagtgtaaagtataggccttaaacatgttaacagttatagttcaatccacttttctgagggtggaggacttgacattttatatcatttaatcttttaagacgttcagttgcttagatatttacccatgattccttgtaaggcacaagttgtggaaggacaacttgtgtggtaggtgtcactagaagacgacttgacactgagaagaaggtgtgttagtattgggtttgtgatagcttttagagacttctggttccttttcctggggtgttgttttacttttattttttatttatttatttattttttgagacagattctcactctgttgcccaggctggaatgcagtggcgcgatctcggctcactgcaacctccacctgctgggttcaagctatcctcctgcctcagcctcccaagtagttgggactacaggcacgtgccaccacatctggctaatttttgtatttttagtagaaacgggatttcaccatgttggccaggctggtcttgaactcttaacctcaggtgatctgactgcctcggcctctcaaagtgctgggattacaggcatgagccaccgcgcctgacctgttttactttattgaaaaatcttagagatggatattctttgaaccactgacatgcagagtacagtactttcatacctatttcagtgctgtgactttactatgaaaaccttactgtttttcacattaattttttttttcccttgacaaggggtctcgttctattgcccaggctggagtgcagtggaatgatcttggctgaatgcaatgtctgcctcctgggttcaagtaattctcctgcctcagcttcccaagtacctgggattacaggcacgtgccaccacacctggctaatttttttattttcagtagagatggagtttcactatgttggccaggctgatcttgaacttctgacctcagttgatccaccggccttggcttcccaaaatgctgggattacaggtatgagccactatgccttgccaatttttaggaaaaatattaggaaacaaaaatattaaatgactgggcccagtggctcacacctgtaatcccagcactttcggaggccgaggtaggaggatagtttgagcccagaagtttgagaccagcctgggcaatgtagcaagacctcgtctcttcaactgataaaaaatttagagaaaaaaaagaaaagaaaaatgttttacagttgagtctttgtcatacctttttacttgcagttggttgtcgtttgttttggaattggactattcaaaattttttttttccaccactgtcttatggtgctgaggactcttcatattctcttattttaacctttccagaagatatacttacatatttgctttccctgaatatattttaatccaaggcttttttgtcattaggaatattccaatttctatattacattatttaactggccagttcatacccatttctgttcagatttagtttgtttgtttattcatttatttttaggaggttatatagaaatggatatttgttaaaaaattaagggttgggcatggtggctaaagcctgtaattccagtactttgggaggccagggtaggtggagtgcttgagcccaggagtccaagactagcctgggcaacatggcaatacgctgtctctgcaaaaaatacaaaaattagctgggcatggtggtgcgcaactgtagtcccagctacatgggaggctgaggtgagggggatcaattgagcccaggaggttaaggcttcagtgatccgtaatcacttgaatttgggtagtggaggttgcagtgagctgagatcgcgccactgcactccagcctgggtgtcagagtgagaccctgtctcaaaaaaaaaaaaaaaaaaaaaaaaaaaaaaaaaagaaaaaaaattcaacttcagatttactgtatcattcaaaggtgtatatcctttagatttttttcaaactgctattacatactcataaggtgtttaagcttctcagtttgatgctatggagcttctgaatggaaatacagttgtaaggaataggatggcaacagagaaaattaatgtttaattcatggattttttcattttagcatgagacagaatctcattctatcgcctaggctgaagtgcagtgttgcgatcatagcacactgtcaccttgaccttcggagcacaagctatcctcccggctcagtattctgagtaattcgggccacagacgcacacccctacatccagctaacttttttttgtttgtttttgtagagacaaggtcttactatgtttcccaggctggtcttgaacttctgggctcaagcattccccccgcctcggcctcccaaagtgctgggattacaggtgtgagccaccgtgaccagcctaattgatgttttaattttagattatttacttatgcctctgatgcttttacctaatctagtactgataatttaggtgtttttttctttatgatagtctattttattaaattggtagttgctgtatgcaggcttacttttgtttgttgatcttaatgtcttgcaactttcctgaacttgttcattaggtctggaagctttttttatgtataaaattgtatcatctgcaagccgggatagtttttacttataaaggttgactttttttttttttccttctttgagacggagtcttactctgtcacctagggtggagtgcagtgacatgatcatgattcagtgcaacctttgcctaccgggttcaagcagttctcatgtctcagcctcctgagtagctgggagtacaggcatgctccaccatacccagctaaatttttgtatttttagtagagatgggctttccctgtgttggagaggttggtcttgaactccttgcctcaagtgatcttcccgcctcggcttcccaaagtgctgagattacaggcatgagccatggcacccagcctagacattgactttaaatcatgttgccatcttgcttaacatttcttatgacatgaagttatcttctgtttattttagagattaagaataattcctataatgctacattttcacaggatcgtttggcctgtctttgtattttgtcagtttagtagagtgtatttcacatttttccagtagttattgaaatacaattctcacctcaaaacagaatgtgaacagtagcagtttttagttgtgcagggtttcagcatgtctgttatagcatagtttgaataactgatagccgatatttccattgatgatatatatcacctgaaaggtcagggaaagtttcttgattactggtgttcctggatgattaatgatattctttttatttgctctgaactaaggatatgctgttgtctttgtgtgtggagattcaccttttgccaaggatttgtagaaactgaggagcaaagatagctgatacttatttccatttacttcttcctagccagtcagaagtccagaaagaagagatagaaaagcatcagctaatgctcgaaagaggaaacattcgccttcgcctccccctccgacaccaacagaatcacggaagaagagtgggaagaaagggtaagaactattacatgattcaaagggcattaaaacaggccggacgtggtggcttacacttataatcccagcacttttggaggctgaggtgggcagatcaactgaggtcagtagttcaaatccagcctggccaacatggtgaaacctcgtctctactaaaaatataaaaattagctgggcacggtggtgcacgcctgtcatcccagctacttgggaggctgaggctggagaatcacttggaatttttttttttttttgtatctaagtatgtattgagaagcatgactggtaagaagtttaagacattatattcaccatgtttagtgtctccttttctgattttaccacttgtcccatttgtgatcaaataagctcatagaagagatgaatatgtggctgcttgatgttctgcaaagcatggcagtacaacgcctggttcagggctacacttttgtacttagtgagctttggttgaatgaggattacgatttctactgaatagattgttttgagggttaaatgagactttaaagcctttgcacattgcctggctttaaatacacacttaataaatggtaaatagtacttaataattaattggtatatattaagttacataatttctggtttgcctagcttaaaatattttcattataatttttatagtttagacttggcaagacaattatggtttgtaaattgattattttcatgtgacagtcaactttttggatgttgattgaagtgtaaagatacaattgacatctctcctgcagcttccttatatagactttcctctctaccctagttggcatttctgttcccagaacatgccttgaatcgtattatttcctgaagggtagttatgacaacactcttactaatagaagtctttagggacatttaaaaacctcttagtttcatatattattaagcaagttacactcatcaaaaaacctttaaaaacttagtttttgagcccacacatattatgacatgaaaattgaaattataaaaatagatttttcgttagctgtttatggggtaactattttttatagttcgttttttttttttttttttttgagacggagtctcgctctgttaccaggctggagtgcagtggcacaatctcagctcactgcaacctctgcctcccatgttcaagcgattgtcctgcctcagcctccctagtggctgggactacaggctcgtgccaccacgcccagctaattttttttgtatttttagtagagacggggtttcaccacgttggtcagggtggtctcaatctcctgacctcgtgatccacctgcctcggcctcccaaagtgctgggattacaggcgtgagccactgtgcctggcatacattccttttatatatgtttaacatttcatctttttttttttttttttttgagacagggtcatgagccaccgtgcctggcctacattctttttatatatatttaacatttcatctttttttttgagacagggtcttgctctgttgcccagactggagcacagtggtgcgatcttggcccattgcagcctccatctcctgggctcaggcgattctcctacctcagcctctggagtagctgagactacaggtgcgcaataccccacccagctaatttttgtattttttgtagagatagtgtcttgtcttgttacccacactggtctccaactcctggtctcaagcaattcttccacctcggcctcccaacgtgttgggattatttgcgtgagccaccacacctggcctgtttcttacatttctaatctgaatattgttgttgctgttcagagattttggaactacatgagatctttgcagggagcgcactgtcaactataatgagataaaatggggtgccaggacaccagtggttattgaaccaagatgtgatctctaggaggcatgaggctcacagtggtgacatataccctctactctgaatataacgcataccagattgagttctctaaaatatatgtatgcatgtactttaatggaatacatttgccttgtaatgaccacgccttttctcattttacatttctccttagagttatgttaaaaatatacttagaaaatattttgaaatctgttttcccaacttttgtttcattcatctgcactgtatgttttcttcccctttaagtattttatctctctgctgcctttaggtttataggcttttaaaaaaatcatcatgcagcacttgtctttcaagttgcctgcttggccctcttccaagtgtactctccttccttttgtttaaaaaataaataaataaaggccgggtgcagtggctcatgcctgtaatcccagcactttgggaggccgagacgggcggatcacgaggtcaggagattgagaccatgctggctaacacggtgaaacgctgtctctactaaaaatacaaaaaaaattagccgggtgtggtggcaggcgcctgtagtcccagctactcaagaggctgaggcaggagaatggcatgaacccaggaggcggagcttgcagtgagctgagatcgcgccactgcactctagcctgggtgacagaggaagactctatctcaaaaacaaaaacaaaactcatcatgcgatttttatttggaaaaaaattttcctttatgtatcctattcaacctaagccaatatgtcatccctcaaagggaactttgagcattcgctctgcactgtagaactcaggctggcccagcatgctgtttcagacagctttttctccatttccactctcacttcacagtgcagtttagattgctacccagtacttcccaaagcaagtgtgtttttcttttcttataccttttggccattattctacatcctgaagcattgtctttctttattattttatttatttatttttgccagacaagatcttgctctttggcagaaaaaaaaaatgataacaaataaattaggggtttaaattagtataataacatctgctgaggaataaatgaataaaaataataattaaaacaagacagtgcttcaggatgcagaataaaggctggagggcagtggtgcagtcatgtaaccttaaaaccctgaggtcaagcagtcctcctcagtggctaggactacaggtgcatgccaccatgcccggcttagcattaaaaactttttggaggccgggcgtgatggcccatgcctgtaatcctagcactttgggaggctgaggtgggcagattgcctgagctcaggagttagagaccagcctgggcagcatggtgaaaccccgtctctactaaaaatacaaaaaaaaaattagccggtgcgtgattgagcgcccttgtaatcccagctactggggaggctgaggcatgagaattgcttgaacctgggaaggaaaagattgcagtgagctgagatagtgccacttctctccagcctgggcaacagagcaagactgtctcctacccccgcccccaccaaaacaaaagaaaagaaaacaaaactttttgggccaggagccagtggctcttgcctgcaatcccagcactttgggaggccaaggtaggaggatggcttaagtttgagatcacctgaggcaacatagtgaaaccctgtatctagaataaattagagaaagaaaaatagtctgggcatgatggtgtgcacctatagtctcagctactcaggagcctgaggcaggaggatcacttgagctgaggagttcaaggatgcagtgacctgtgattgcaccactgcattccagcttggacaacagagtgagaccctgtcttaaaatttaaattttttgttttttggtagagatggggtctcgccctgtttccgaggctggtctcgaactcctggcctcgagcaattcttctgccttgcccttccaatgttctgggattacaggcatgagccaccacacccagcccttacctcttagtgaattgttaaacaattctcaaggttcagcttaactctgaccttcagtccttacaatctctctatgatgtattttcttggtacttttattcatttctctgcactgaaatataatacttctatcgtatttctctctgtatgaatcatgttatgtgaggtaaagatttctgtcctatatcccttgtaatccctaaaggtaaagaatcatcactggggttttttttttttttttgagccccctgacatttattagttttaaaattaataatgatttgattgaatttttggtgcaagagcagtggaagattttatacaaaagaattagtactatatttagggattctacttgtagttcctgatatttggatgataaaagggccattaaaacacaatggtacgtatctttgatcacatatgtgattgcttataatcttagaatatatcatatttccttagcagttgttattttattacactaatttaggtcccttttgtgatactgcccgcaattgtctagtaggattttttgcccattttttatgcctgttaacttttatttttcttttattggctggttagatgtaatttgggggaagttatctaattttttctttttaatgtttgccttttttatttttaaaaattcttttagatggagtctctctctgtcacccaggcaggagtgcactggcgccatctcagctcactccaacctccaccttccgggttcaagcgattctcctacctcagtctgctgagcagatgggattacaggcgcctgccaccatgcccggcttatttttgtattttcagtagagacggggattcgctatgttggtcaggctggtctcaaactcctgaccttagtgatccacctgcctcggcctcccaaagtgctctgattacaggcatgaaccaccgcgaccgacctactgtttgtcttttaaagtgatcttgagcatatgttctacaaataatgaaggtgtacaacctcagaaactgtttgctatcagtagctataatcagtcttgtttatatttcatatacttgtatgttttagccaagctagcctttatgggaagcgcagaagtcagaaagaggaagatgagcaagaagatctaaccaaggatatggaagacccaacacctgtacccaatatagaagaagtagtacttcccaaaaatggtttgtattcttctgcatgagagtgttagatttaatttagtcattctcagcaataccatgggatgattcattgcttgctgtgggtccacagttctcgactttcaagtatgaatagattgtcccttttatggatatctttttttaattttctttaatcatttgagtagttttactctttgtttatagagaaaacttacagcgaccaaaaacatctttaatttagtaatgttttaaaattaatggtttttaaattgcaacagaatcacattcatatgaaaaagtggaatacgtacctatatatagtttaacttattgaaatctctagggaatgctttatgtggatgcaaatttgaagttctctggtaatgaatttcttctaagtgtgatgaaccttagttaccagttatgtaaattctggcctaacttctattcaatgtaattaaattcaaagtgggctgggcatggtggcttatacctgtaaccccagcacttggggagaccaaagcagacagatcacttgaggttaggagttcaagaccagcctggccaatgtggtgaaaccccatctctactaaaaatatagaaattagccaggcatggtggtgcgtgcctgtaattcccgctactccagaggctgaggcagaagaatcacttgaaggaggttgcaggaggcggaggttgcagtgagctgagatcataccactgcactccagcctgggcgacagagtgagactcagtctcaaaaacaaaaacaaaaaacaaaaaacaacccaaaatgttctttattgataaggtattttttattgaccattaaatgtttgtgtcctcagtgagccagtgatcacattttcaaaaaataagctctagcatacttcgaaaagtaaagacctatgataggcattttatgatttattagccttcttcacccatctttgtgggagcagcttgtaaataagagactatatatatcagttggtgaattacaggtctcatactaatcatccaagtttatagaatttcactgaaatctagaaagtggagatttaaaatttggggactagaaactaagtcattaaagttattggtaggtttttttttttaatatactttattgaaatgaaataacaggaggaattagaaccttttctggttattaggagatgaattacagttcttcaaaacagcctaagatgaaggattgtagtaaattatatctcttttttattttactattctgtgagcatgaaaaataatgaaaaagtagaagaaaaaaatctaggatttagattaagatgtatatgaagcatataaccatctctcctgccctaaacttgtacagtgacagacagaaaagagtattaaaaaaaagcctaggaaaaccagaacattatttttcattattgagaaatttgtaaaatataggaagctatctggatctaaaagtaagatgagttactaaaactcaggaagtatacggttaaaaataggagaagactatatggtttatatggcactaaacagagcaattgataagtctgtatgatttatctggcactaaacacagagcaattgataattaagatgggcactgggtgtatatatgtatatacatagatatatacatgtagggcaatatacatatgtatatacctatgtatagacatatagagcaatatacatatgtatagacatatagggcaatatacatatgtataagatgggcactggatgtatatatgtatatacatatgtatatacatacagggcagttaagaatactaggagaagctagactcatcagcgttggtctgtatgtattttgcactcagctgatggtgtgttgtctggtcgaaggctaaagcactaacgctgaaggtgacaaagatgcaaggaaaatgtcccaagcagttcttgaactccagatggagggattaaaggataaaaaaataataagcaggagaattagtacttgtcctttttattggttttctgttttctagtgaatttataaatttagcatttgatttttctgaatttaagtataaccagttcaagcccctattcacagttgcttggattttcattttcttaacactttttttttggaggacaggtgctcttaacttttcttgtgtcctaagaaattttttgcctatattagtgttgcaaatgtgtttttctgtgttttcttgtagaaagcttatgccttctgcttttatagttaggtctgtgacccaatttaaagttgtttttgaggatgttatgaattaagggttgaagttaattttattccccacataggtatttagttgtttgtataccatttgctgaaaagacactacttctcacattgaactattttgctgcctttgttgaaaatcatcacacatgtctacatttagattcagtattctattctaaccatctcattgtacttaataccacagggcctgagttattatagtttttttttttagtaagtattgaaattgagtaaactccttcaacttttgttcacatttttcaatattgtttttgctattatagctcttaggttttccatgtaagttttagcaccagcatttaatgtaatttttcctcttctgtggtttgtatgttttattagaggtctttcacattttgttaaatttatatctcattttttttgttactgacagtgtaaatttttccacttattttttcctagtatgtggaaagagaattaatattccttaatttttggccgtgtattctattgctttttaaaaaatcatgtattctggcacttttttgtagatttcttaggattttctattacacaaacctccaattatattatacctccactgtaattttcaatagcggtttagaaagcagacatttttgcttttttctctgtcttcgaaagaacacatttatattttaccatggtgtgtgatatcacacaatagatgtttcatcaatttcaggaagctttcttcctggatttttctgagtttttatgaatgaatgccaaattttgataccgttcttcagtatccactgatgtaatgatatttctccttttaatcagttaatattatttaattgtaagatttttgtagtggttgaatcaactttgcattcctggaatttacctcatttgatgacattgtatttttttttttaatgtgttggctatatttgattgtttaatatactttaaaaggattattttagtctgtatttgtggaggatatttatcttttttttttttttttttttttttttttgaggcggaggctcgctctcgcccaggctggagtgcagtggcgcgatctcgactcactgcacgctttacctcccaggttcacaccgttctcctgcctcagcctcctgagtagctgggaatacaggtgcccactaccatgcctggctaatttttttgtatttttagtagagacggggtttcaccatgttagccaggatggtctcgatctcctgacctcatgatccgcccgccttggcctcccaaagtgctgggattacaggcgtgagccactgtgcccgtccagatattgatctttaactttctgttcttagcattttctcatcaggttttgctgtcatggttatgctggcctcataaaatgagtttggaatttttttttttttttcccttaagagtcagggtcaaggccaggtgcagtggctcacacctgtaatcccagcatttgggtaggctgaggcgggaggatcacttgaggccaggagttcaagactagcctggccaacaagttgaaaccagagctctactaaaaatacaaaaattagcctggcgtggtggcgcatacctgtagtcccaggctactcgggaggctgaggcaagagaatcgcttgaacccgggaggcggaggttgcagtgagccacgatcacgccagggcactccagcctgggcgacagagccagactccatctaaaaaaaaaaaaaaaaagtcaggatctctcgctctttcgcccaggctggagtgcattggcagtcacgtcttgctgctcactcaagtgatactcccacctcagcctctcgtttcagctgggatacaggtgctcaccaccacatttgcttaatttttattcattgtagagacacggtcttgccataccgcccaagctggtctcaaactcctgagctcaagcaatctaccctcctcagcctcccaaattgcaagctaccatgtctggcttattttgtagttaattcctaattaaaatctatggcagagctggacatggtggcctttccctgtagtcctagctattcagtgagaggattgctggaaaccaaggacattgaggcttcagtgagccatgattgcatcactgcactgcagcctgggctaaggagtgagaccccgattcaaaaaaacccaaaatcattcactgaaaatctagtctttcgaaatttattcacacttggctgggcgcggtggctcatgcctgtaatcccaccactttgggaggtcaaggcgggtggatcacctgaggtcaagagttcaagaccagcctggacaacatggagaaaccctgtctctactaaaaatacaaaaaaaaattagccgggtgtggtggtgggtgcctgtaatcccagctactcaggaggctgaggcaggagaatcacttgaactcgggaggcagaggttgcagtgagccgagattgcaccgttgcattccagcctgggcgatgagtgaagctctgtttcaaaaaaaaaaaaaaattattcacacttgttttatttcacagcatatagtctactttggtgaacctttgcttatactacttgaaaaggacatatgttgtgccgtttttgagtctagtgttgtataaatttgtttgtgttttgtttttttgttttgttttgtttctgagacagagtctcgctctgttgccgaggttggagtgcagtggtgcaatctcagctcactgcaacctcagcccccaggattctagtgattgtcctgcctcagcctcctgagtagctgagattataggcgcccgccaccacgcctggctaattttttttgtatttttagtagagatggggttttgccatattggccaggctggtcccgaacttctgatctcaggtgatccacccgccttggcctcccaaagtgctaggattacaggcatgagccacctcgcctggccccccccccccctttttttttttgagacagcgtcttgctcagtcacccaggctggagtgccgtggcataatctcggctcactgcaacctccgcctcttgagttcaagtgattctcatgcctcagcctcccgagtagctgggattacaggcatgcaccaccacgcccggctgattttttttgtatttttagtagagacggggtttcaccttggccaggcaggtcttgaactcctgacctcaggtgatctgcccacctcagctgcctaaagtgctgggattacaggcgtgagccacactgcgtccaactttttttttttttttttttttgagacagaatcttgctctgttgcccaggctggagtgcattggcatgatctctgctcactgcaacctccgccgggttcgtgtgattcttctgcttcagcctccctagtagctgggattacaggtgccttccaccatgccctactaatttttgtatttttagtagagacagggtttcaccacgttggccaggctggtcttgaactcctgaccttaggtgatctgcctgccttgtccttccaaagttctgcgattacaagcatgagccaccgcgcccggatgacaaagtaacttttattcaaccactacagggacagatgctgagggtgaagtagaaaacaggcattcagttttccagtgtatgattttatgcataatatagcattgttttaattgagatatacttcacataacattaaattaattattgtaaagtacatacttgcattgtcacccagactggaataacagctatgcgatcataactcactgcagacttcacctcctaggctcaagcgtttcttgtgcctcagcatccctggtagctaggacttacaggcatgagccactacacccagttataagggcattaatcctgttcttgaggggcctatcctcctgacttaattattttccaaaggccttacttctaaataccaggacactacagttgggtttcaacatacgaattttgtgagcacacattttttcccgttactatgtgtttagctcatcaaatatgtttagaatcactgttacataattgaggttaaaatgtaagaaatttagcactttaaacaggttttttttgtagggggagaaagtatttaccatttaacaaaggactagaatcctaaaaatgtataaagaatctgaaccccttagactaaattacatagtatttaccgttgattatgtcagattggtaatttgttagaaataaatacatggccaagaagtgtgtgaacagatggtcagcctcacttaagaatatgcaagttcttcaaatcactattttcatctataagattttcaaaacctaaaaggtagatggaaaagtgtgaaagttttgaggaatgagtactatcaaatgctgttgatgaaagtgtaaattaatgaagacattcaatgcaatttggctgtggttttttgttgttgttgtttttgagactgagtctcgctctgttgtccaggctggaatgcagtggtgcgatctcagctcattgcaacttccacctcccgggttcaagtgattctcttgccttagcctcccgagcagctgggattacacatgcgcaccaccatgcccagctagtttttgtattttagtacagacagaatttcaccatgttggccaagctggtctaagactcctgacctcaagtgatacacctgcctcaacctcccaaagtgctgggattacaggcatgagccacctcacctggccttggctgtgtttttaaaattttaaaatgtgtacctctagttgcagtgttttatttttagagtttatcttaaataattgcatgcacccacaaagataattacaaaagaatgtttttgaacagtgaaatattcaaaataaacatggtttccatcagtgtagggctggttaacttacagtccacctatggacacagtggacttgtaaaaatgaaagaaatgtaatgtaatttaaagttcttacatggaaagaaggtccgtgctaagaactaagcacagtattgataacatttacatagagttaaaaaactctcaggatatattttgacatccatgtggatgtataaaagatattcgtttggccggacgcagtggctcatgtctgtgatcccggcattttgggaggctgatgcgaatggattgcatgagctcaggagttcgagaccagcctgggcaacatggcaaaaccatgtttctataaaaaatacaaaaattaactaggtgtggtggcatgcgcccatagtcccaattacttgggagcctgagatcaaaggatcgcttgagcctgggaggtcaaggctgcagtgagccatgatcgcaccactgcactcaagtctgggcgacagactgagtccctgtctgaaaacaaactaaaaaggtattagttcttccttaattttttttaaaagaatgaatggattagaagtgagaatcaaaacaaatgcatcataaactttaataaaaaaaacttttgtggaagggattgaaagattgttttcatgttttgttgagtattttgtattgtttgcttttatgatgaaactatatggtgcttgggtaatgagaatatagtctgttaaatatttcatagctgggcttatgatttttacctgaaagtgtattgaatggtgttgcagttgtagtgagatgcatgtcgtttaatcatgtcctattctgttttctttctaaaaagaagtacaacttttcccacataaacataactcttttttttctttttctagtgaacctaaagaaagatagtgaaaatacacctgttaaaggaggaactgtagcggatctaggtaagcacctaaaatctatacactggtctgtgctttctgtcttgaatatgtcatctcctttgatagtctattcttccaaggtcttgttctgttggtcaggctggagtgcagtggtgtaatatagctcaccacagctttaaacttctgggctccagcgattttcctaccttagtcttccaagtagttcggattataggcacacaccaccatgcccagcttgatacactccttcttttcttttttttttaagacggaatctcactctgtcacccagggctcactgcaacctctgcctcctgggtttaagtgattctcctgtctcagcctcctgagtagctaggattacaggcttgcgccaccacgcccagctaatttttgtatttttagtagagacggggtttcaccatgttcaggcctgtctcgaactcctgacctcatgatccgcctgtctcggcctcccaaagtgctgggattacaggcgtgagccaccgtgactggccgatactcctttcttaagtgagacttgtgcttagccactacaggatattagctgtggcttattcttagtgccattatgatttggtttgctactgttgtaagagagttaatttcctgtgatccattgttgccattcttagtgatctccccctcttggagcataatatttttgtacaaactagggaaggtggtaataatataattgaataagaatatgagttttaaggaaatagttctaattaaagtactttttcaaatgtcactgaaagaattgtttttgtaacagtatgcaaaatgatactgtattgttagaacaaaaatctgtggagtgttaatactttgtaagccaaattaaagtttctaagcagtataaaatgagaatgacatcatcctttcctagtatttccaagtcttagagtacattttcacaagtaaggtataattcttgagtgattttgcaggagaatagaaaagagtataatcacttgttctccttaaacattaaataggggtagttttaaacatctttgttctggagagttgtagatgagacattaggcttgatttcttttcttcacttgtaaaggagaacctattgttttcagtatttactaaaattttgactttacggaactttaaacctgaaagggattttcaagatcttttttagaaaatgagatgtcagttctatcttctaattaaggaattctgtatttgaataaattgcagtcattattattttttgagacggagcctcggtctgttacccaggctggagtacagtggcacgatcttggttactgcaacctcctcctcccgggttcaagcaattctcctgcctcagccccctgagtagctgggactacaggcacgtgccaccacgcccagctaatttttgtattattagtagacatggggttttaccgggttggccaggctgatctcaaactcctgacctcagttgatccacccacctcagcctcccaaagtgctgggattacaggcatgagctttcgggcctggcaattacagttattattgatggcagatacgagtgggtattttggagagtgatccatcaactgtaaatttttgttctcagagctgttgtattttgttttttgttttgagacaaagtctcgctcttgtcacccagcctggagtgcaatagtgtgatcttggctcactgcaacctccacttcccaggttcaagcaattctcttacctcagcctcccaagtagctgggattacaggcgcctgccaccactcccggctaatttttgtatttttagtagagacacggtttcaccatgttggccaggttggtcttgaaatgctgacctcaggcgacccacccacctcggcctcccagagtgctgggattacaggcgtgagccaccatgcctgaccagagctgttgttttaactgctctatattctgccttatatgctacctcatcaaatataggtctttctttcattcttcaggtctctgaaggagattcaggtgtttggtgtggagcatattttctcacatctgaaaggaggaagagaacatttattgaatattaccattcaataatattagggatattattaatattagggatcatatataatttaatattatcagaagtatcttcccattgagtaccaagactactttggggaatgaaattcgtcagactaaaaatgtgtaatttgagtaatgggagagattattaagtcaaactaacagtttctagtaagaggttggttatgctatggtttaccattgtccaacggaccaagtgtttgtttttggcagccttacctagatttctttctgttagttacttcctacataaaaatagtcactatgcagagctgcagaactcctactggtaattaataccatattatttcacatccagaatcacctattccttgttagcaagtatttgtgactaactcacacattaagccaccgtgtccatctctgggtggcatgagtagttgtcaggtcttgttctacatgtgtttgcacttcactattaaactgttttgttttattgatgaggaaatggagatttaaagaggttcagtaacctctttccaaatattttgcagaaccccgatttgggtcctggtcttactttcctgccaatgctttgtatcactgcacttggctgttgtggtttgtctattttgctcagcctttattcatgttcatagtggctttctgttttgtgaagttaccaagccaatccaactggaggccctttgatttggtttcttactttttgtggaataattaccttgtctttctcatctcttaacatttcagcttaaaggccaccttttcagagacaccagtttacttgctctgaagtgtccacctacccacttcctctctaatatgtttatgtttattctttgtatagcatttttcaaaatctgataaatttctgtttatttttgctatgtcccgtaccagccaccaaaagtgttggtattataggtgtgagcgactgcacccaaccctttttcttttcttttcttttttttaataagagacaagatcttgctctgttgcccaggctggacttctactccttgccttgagtgagtctcccacttcagtctccagagtatctgggactgtagatgtgcactgctgcacccagcatcccatgttctttttgaacttcatcatgccttacctagtgccagcggtcacagtagtgataaaaagcttaaatattacaggcatataataatgtaacttgttgttctttaatactacctctttcctattctgtactggcagttttacttttcattgtggaaatcaactgtctagtttacaaattttacctgggctttctttcatgctaagccctctatcctcagaaggcattgtcttactaagattagtaagggattggttatcacccgtttttttactcatcattctttactcacttcttctgaaacccaaaatgttgttattttagcaaaactcaggagacaagaatcgtaatcaagtcctgtatctgttattaagatcatgactatgatattagctcaagtagtaattaattgtaaattccccactgtttgaaatttttaatgatctttgctttgaatttctaattacctctgtgcttctgtgtagaattctaatttagtgaattattcagagtgattttgctttaataatgcactatttcattccttttctctgtccagtatcagttcttagaccattaattttccaaataacccaaagaacatttacctgtttttaaaatgaattgtgtgttttggttttgcagatgagcaggatgaagaaacagtcacagcaggaggaaaggtaacaattcagttaagcctggtgtgagagagcttctctaagggtcctgtgtaccgaacagtagaagcactgaattggacataacccaatttttggactatgaagcccttctggtttttgaatttttttttgtttttagtttttcccctaaggaaaacaaatacaatataagaaccatttctggaaggtgtttttgttagttttttcttttgagacaggctgttggttctcactgtaaccttgacctcctgggctcaggtgatccccctcccacctcagcctcccgagtagctgagactacttgtgtgcaccactacacccaactgatttttttattttttgtagagatggagttttttatgttgcccaggctggttgcgaactcctgggctcaagcaatctgtctgcctcagcctcccaaagtgatggcattacaggtgtcagccactgcgctcggcaaaatacttgactttcttggaccccaagattttacttagaggaaatttttgtcctccctgctagtgtccctcatgtgctgtaatttctagtttcatactcccctggttgcaaggtaatattcagtgccgaccacagtatttcagatgttatccgacagtgcagatgagcaggggccatgtgttgtcttgatttttctcactgccatttctattgatgcagtgtagactttgaatcatactttgacctttcttgagccttattgcgagctacttcctgctttatgaattctgctgtagcgatacctcaatcattatgcttttggaacatgttagatttaaggtaggatttaattttttaaaaataaacggcgtcttgtttactcaggctatcatgtttgactgtgtgattaacccccaatcttcttgaaataatttccttaacttgctgaatatagattttttttttcatttgcaaagaaattccctaagatgatccttatcattgttgtatacattcaaggatgaacatatgcatgacaggatttccggaaaagtatttcaagaaactcttttcttatgactcttcacctgtattgttcttatgattaaaaaaaaaaaaaaatcaaagttatttagtcaaagagccacttctttttgttttgttttttgagatggagtttcgctcttgttgcccaggctggagtgcaatggcatgatctaggctcaccacaacctccgcctcccgggttctagcgattctcctgcctcagcctccggagtagctgggattacaggcatgcaccaccacgcccagctaatttttgtatttttagtagagacagagtttcaccatgttggtcaggctggtctcgaactcccgaccttaggtgatccacctgcctcggcctcccaaagtgctgggattacatgtgtgagccaacacacccagccaagagccacttattaatgaacattacctgtgcaaaaatatgtcattatttagagtaaatagagattggcacctatgacgtcagcattttggaaagctgagatgggaggattgcttgaggttaggaattactatgctggcgtgagccaaaatcctgccactgtgctctagcctgggtgacagtgcaagacactctttttttaataaaaagtgctgagtgcagtggcttacgtctgtaatcctagttctttgagaggcccaggtgggagaatcacttttagcccaggagttcaaaaccagccagcacaacacaaggatactctgcatcaacaaaaacttaaaagattagcttggtgtggtggcacctgcctatggtcccagctaaaaaggaaagtcaaattccttcgttttaatgccaaagataagaggatttgaagccatataccagtcgtttatatatcttaaaaggattagaggtagtgtctctaaagctgtctcccacaatgtcatcttccttgttgttttctgattgaagtcattaaaacttatactgttggccttcattaattgcaatgccagcctcttcctgttttttctgaataagggaaattttttgtctcctaatgatttgtaaagtctgtaacacaaaaatatattaactaaagccaaaataaaaacaggtgaacattgagaatattttttgctagcttctgtgatttgggaaataaaatttgttacccttgtcatcgttagtatcacatttgtattcaatatcatttaagtaataactagagtccttggtgttttcatgctttaaatttattcctttttactattcttatagaaactgttataggtagtaacactagatcgtcacttcaaatactgtaacaggagatttaggttgaattaagaaaaaggtagaaattaaattgtggaaccattgtaaaagaaaactgattcaaaatttgggtttttgcttattttatttttttttgaggcagggtcttgcctagactggagtgcagggcagtggtggaaacacagctcactgtagtcttgacctcccatgctcaagcaatcttgctgacttcagcctctaaagtagctgggactacaggcatgtaccactatgtccagctaatttctaaatttttagtagagacaaagtctgactatgttgcccaggctggtcctgatcttttggtctcaagtgatcctcctgcctcagcctcccaagtgttggaattacaggcatgagacaccttgcccagcccataatttggtttcttaatagaaaataatttcattaggttacaaataataaaatcaccacagagagaaaattgtaaaacatttcaatatcaaaaaaagtatttaaaatacgtttaaatgtatgcaataaaaatgtgtatcaagtaaacatttacttcagattaagtaaaactggacaaggaagaagcaagctattatggaacgagatctgggttatgagttatttatttagtctgaagtcctgtgcattgaaacagactttcttcaatcaacttgttaatcttattatgagagacctaccttctctgcattgattccctcatcatcataaatgagcaacaaaaccttatcagctggctaccttgtaccttaaatactgtgaaaggttgtttttacttgaaatttgtttttcaaatatctgatcgaatcggggagcttcattttatttaacctaacaactgaagtgtaagagatgttatatatatctctctctgtagttctttctttctttgaactttgtcttcttttctataggaagatgaagatcctgccaaaggtgatcagagtcgatcagttgaccttggggaagataatgtgacagagcagaccaatcacattattattcctagttatgcatcatggtttgattataactggtgagtggaccacttccatctgtgagcatggtactgagcagtacaagaactttccttgaaatcaggttgtgcctttctgcccatgttccttatcagaaattactatcactttggatgaagggagatggagagtgatttttatctttggaatgtgtttgtgttttttgtttgtttgtttgttttgttgttgttgagacagagtcttgctttgtcaccctggctagaatgcagtggtatgatctcgactcactgcaacctctgcctcccggtttcaagtgattctcttgcttcagcctcctgagtagctgggattacaggttcccgccgccgtgccaggctaatttttgtatttttagtagagatgggtttcaccatcttggccagggtggttttgaactcctgacctcgtgatccacctgcttcagcctcccaaagtgctgggattacaggcgtgagccaccgcgcctggctcgaatttttttttttttttttaaagaaaaacaattcagggattgaaactagattttgttgtaatttaggtttgtaaaattttgtaagcttgaatctaactcatttagaatcagctataattcaaacaagcaaatacttgagtagtagtataaaatgttttaaattattataaaaagtttttagttacttgaaattaactctagattaaaaatactaactgaaaatttccagaagtaaacaattcataattttccgttgtgtgttattctgagtagtgggatgaaatcttgcagtttcatgccaggagtatgaatcatccttttttttcaatgtagacacactgtacatgctacccacctgttagtcatttagtatccgtatcagttattagactagctgtcaagggatttcagtgcttctgttcaaggaacccctattttagttagtggccccaatgcatagaagtagtgatggtgatagttcggatacgccaaagtgaatgtataaagcgcttcctttaagtgaaaaggtgaatgtttccgacttaaaaagaattgtgtgctgagcttgctaagatctatgataagaacaaatcttctgttcatgaaattgtgtataataaattgttatacttgttcttttttattattggtttttgttaatctagtcctgtgtctaatttataaattaaactttgtcataggtatgtgtgtgtttatgtgtatacgtaggaaaaaacttaatggccctgtccacagtttcaggcatccattgggggtcttggaacacaaactccacagatatgaagggactactttatataaaggaaaaaaattgcccagcatggtggcttatgcctgtaatcccagcactttgggaggccgaggtgggcagatcacctgaggtcagcagttcaagaatagcctggccaacctggtgaaaccccgtctctattaaaaatacaaaaaaattagccaggcgtggtggtgggtgcctgtaatcccatctacttgggaggttgaggcaggagaatcgcttgaacccaggaggcagaggttgcattgagccgagatcaagccattgtactccagcctgggctacaagagcaatactctgtctcccaaaaaaaaaaaaaaattactacccaataatagctttattttaataggaaatattttaacatcaggaggcttttaaaatataaatcctggcatgtaaaaatgtttaagaaaacagacctccttagcatcgtctctgatttttacagcaagcactgtggcatgcttcgagcatagttggatgtaactggagtactgtcttttttttttttttttttttgagacggagtctcgctctgtcgcccaggctggactgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgtggtctcgatctcctgacctcgtgatccgcccgcctcggcctcccaaagtgctgggattacaggcgtgagccaccgcgcccggccgagtactgtcttttttattgattgcttatgagatgtgactatttaatattagaatgatttttgtttgtctttttgtttgtctgtgcctcgactgttttgttgttgttgtttttttaaaaacataaataccagaacttaccactccaaatagatgttagcatctttaaggtacctttacaggaaagttgtctacattgctgatgctgccattactcaaaatcttgggtttttttgtttctgtttttttgagacggagtctcagtctgttgcccaggctggagtgcagcggcgcaatctcggctcaccaccaggctggtctcgaactcctgacctcaggtgatccacccaccttggcctcccaaagtgctgggattacaggtgtgagccactgcgtccggccaatcttggggtactttttataccttttgcctgctctcaatgattaccgtgttatttttaaaggatgaatgtgatttttaaaatccatgtatgtccagaagtctttttggagacaatttaaaagaatatagtcagtgatccacttgatatgccttatttttgtctgacatcattctgtggctcaaatattgagactttcctgagtacatttaaaaccaactgaataggccgggcgcgatggctcacacctgcaatcccagcacttttggaggccaaggcgggtggatcacgaggtcaggagattgagaccatcctggctaacacggtgaaaccccgtctctgctaaaaatacgaaaaaaaaatgagccgggcgtggtggcgggcgcgtgtattcccagctactcaggaggctgaggcaggagaatggcgtgaacccgggaggtggaacttgcagtaagctgagatcgcgccactgcactccagcctgggcgacagagcgagactccgtctcaaaacaaaaacaaaaacaaaacaaaaaacgaatgctatttctggatgttttcagtaaatacaacctggaacagaataagtgcatatctttgaacatcagtcttcattacatttgttactctctttaattatttttaaacatttggaagtgtctcagtcttgttatctttgcaattatgtgtttaacattcagaatttttaaacattcacaattttgcttttggctcacaataaaattatgtttatgtacttttaatgtagctttttgtcagctgacaccaatttttatatcataaacaattattaatatatgacatactaaatagtaaacagtaaattacttttaaaaaacatattctatctttatatatttttgctgttttaattattccaaaatagtgagttgttctgttaaaattgacaaactttaaaactcgttagtacaatggcctaagaggacacacatgagaaaccggcattctttttctctaaaattagataaagggggctggtgctatggctcttgtctgtaatcacagcactttgagaggctgaggctggtgggtcgcttgagcccaaacatagtgatacccgtctctacaaaaaatttttttaattaaccaggcgtgatggcacatgcctgtagtcccggctatcctggaggctggggcagaaagattgcctgagcttaggagttctaggttacagtgagctagctatgatcttgtcactgaactccagttgttgtttgttttttttttttttttgaaacggagtcttgctctgtcccccaggctggagtgcagtggcgcgatatcggctcactgcaagctccgccttccgggttcacgccattctcccgtctcagcctcccgagtagctgggactacaggcacccaacaccatgcccggctaattttttgtagttttagtagagacggggtttcaccatgctacccaggatgagaccctgtgtcttaaaaaaaaaaagtgtgtgtgtgaatttctttttaattaaaaaataaaattagaaaatggaaaatcattacagtaaataactatgtaagattatagtttacagaaacgttttcatttgcctgatcatctttgcatgtcacactacatgcagttaaataatagaaatactagttatgatacagaattttttttaaaagtgggcctttcctaacctgtaacaatgaaaacattaggagttatattagaattatgtaattagttccttacggttattcttttaagagtcattatatatatttatatagcattaatccatcttagaaattatctttctagaagtttgccggtaattcattgtatttatagtatttgaccctacaaatccaatttaatttaaatgttaccaaatattcaaaaagtgaataatttgaattatattcccagaccattgatttgctctttgccgtgcaaccactacttaacatgttgcatatctggaaagtcactgagaaactaaaatgtcatcaggaagaaacacacacttatattagcagcagaaactttgtgctagatatacagtttgttctttttttactgttaggcctgatcattttacctgatctctgcttatgacctgtaacatgtcataaaattattagcgtttgcatatattgttaaaatgtacttctgtgatattattaaaagcaattgatagtgaaatttttaaaaaagtaatatatctccccagcacctccaccaaaaataaaaactaaaaagttattaatttatcacagtgtttctgagggctggacaaaggctcatttatgttaacagcctgagaagctgagactagcaaattcattgtctctactctggtcatttgtttcatcagtttgttgccatgccgtgccagctcctttgtttttgtcaccatttttcaaagaattcttcatatcttatggcttcttatctagttatgttgtattatcccaaaaaataataaaatgtatagttttcagtgtgtcgatagtagttttttagtttggttatgggaatagaaaaactacagtaagtactgggagtgagaaagagaaagctttccttaacttttttgtatgctgttaatacatagaaactagtgtaagccaattaattttggcaagcagtactcaggttttggatttatcacttttacttagaatatttaatgattttattcttttaaaaagaacactccggccgggcgcggtggctcacgcctgtaatcccagcactttgggaggccgaggcgggcggatcacgaggtcaggagatcgagaccatcccagctaaaacagtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaagaacactcctaaatctttttttcttcttcttttcagtattcatgtgattgaacggcgtgctcttcctgagttcttcaatggaaaaaacaaatccaagactccagaaatgtgaggccagtgttttagaaaacttgtttatttgcctgtgtgcggtaggggctcttcaagcatccacctgagttccttattgctgattcttggaagtttgcaaatactcctttcagaacagtgttcatatctcatttgcatagcattccatggtacacaggaaattgtatctagtttcgttttttgttttggggggttttttttggtgtttgtttgagacagggtctcactctgttgcccaggctgttgtgcagtgtcatgatcttggctcacagaaatctctgccccctgaactcaaaggatcctcccatctctgcctcttgaagtagctgggactacaggcacatgtcaccacacttggctgatgtttatttatctatctatctgtttattttttggtggagacgggggtttcaccatgttgcctagagtattcttttatttctaaaccttgaactatatgcacatcaactcttagagttaaagtttggattttaaaccaatttttactataatgaattcaggtctatcctcacaactttctttttctttcttccttttttttttttttttttgagatggagtctcgctctgtcactcagactggagtgcagtgttgcaatctcagctaactgcagcctctgcctcctgggttcaagctattctcctgcctcagcctcccacgtagttgagactacaggcatgcaccaccacacctggctaatttttgtatttttagtagagattgggtttcaccatgttggccaggcttgtctcgaactcctgacctcaagtgatccacttgcctcggcctctcaaagtgctaggattacaggcgtgagccaccaagcccggcctgtcctaacaactttcaacttgtgtgtgaatgtatgttttggattgtttctattcatccaggagaaaatagaatctttatcttcctgatgtgtgactgctaattaaaagagagatatgatgatatagctgcatgtgaatggagcttaattgcataaaggatttttgtggttttgcattggaaatagaaaaactcttattggaaggaagaagtttggccggaagtactttttgtctttccctggtgattcatcagtatatacttctggaacccttgtccctatatataagtacatatctgtcaatactgtacataccctcccatgtattaatcagggtattaatctgttactttttttttttttttttgagacaaagtcattccgtcatgcaggctggagttcagtggtgtgatcttggctgcctgcattttgttttctttgtgtgccaagaactgttgctaggtctcaaagtccttaacactcttgttgttaagtactatattttgtgacagaagtccttagtatctgctgtaacagaatctcaatttctctctccatttttgtatgttcttttctgaatttggtctcatggattctacttattgccccgccgtgatctcccttaaagaactgctgtgagaaattacatagctatttgcagagccaaatccacatgacatgtgtgaaatacagaagtgataggcagcagaggttgagagcatagattgaagagctaccacactggcagcattgaattctggctccatcagttaccaaccctgtggctaggacatattctctaacaactcagtgtttgtttcctcacccataaatgggatgatagcagaccctacctgcaatatagagcgattatgaggattcaattgtcagacatacattgcttataacagtgccctgtacacagtaaagtatagatatgtggtagtgaggcagatagcctatgtaaccacgtgttagtttccaattctgcagttaactaccaccatgaccaagtttgaatttatgttacttcacattaatgtcattagattacttgttgttatacattaataaacagttgttttgcatattcgtggttctaaattcactcataactttaaatgtgcaatataatatcaatgttttttatgctcttgtcttaatttgttgttgtatttttaaggaatctgaagatttttgagtttctaagtaacattgtttctgagaggatacatgtccaccttatgaattttgccattgctttttagatacttggcatatcgaaattttatgattgacacgtatcgtctaaacccccaagagtatttaactagcactgcttgtcggaggaacttgactggagatgtgtgtgctgtgatgaggtaaactgtttgactttttctgagacatttaactgtaggaatttacttatgcatgctgtctaatgtttgcttgattaaactggttgtttcaactgggtaaaacacctaattttagttatgccatttaggggttgattatattttgtttcctttcatttcattcaatttaattattttatttttattctattttattaatttaattttattgtcaagatggggtttcacagtgttgccaaggctggtctcgatctcctggcctcaagcgattctcctgcctccgcctcccgaagtattgtgattgcaggcatgagcactgtgttcagcattagaggttgaaaattttaaatatttaatttaggctgggtgcagtggcttacacctgtattcccagcacttcaagaagccaagatgggcggatcacctgaggtcaggagttcgagcctggccaacatggcgaaaccccatctttactaaaaatataaaaattagccaagcgtggtggcacatgactgtaatcttagctattggggaggctgaggcaggagaactcaggagacagagattgcagtgagctgagatcgtcccactgcattccagcctgcgcaacagagcaagattgtgtctcaaaaaaaaaaacacaaaataaaatatttaatttagccttctagattttacagttcacattttaaattttttagtcaaatcataaaataaccagggatggagtggattcaggttgggagtggataagctctgcgccctagctctgccgaaattaaaaaaaaaaaaaaaacggccaggcatggtggctcacacctgtaatcccagcactttgggaggccgaggtgggtagatcacctgaggtcaggagttcgagaccagtctggccaacatggcgaaaacccatttctactaaaaatacaaaaaattagctgcgcatggtgatggtcacctgtaatcccagctacttgggaggctgaggcaggagaatctcttgaaccaaggatgcggaggaggttgcagtgagctgagatcgcaccattgcactccagccttagagacagagcgagactctgtcacgaaaaatgcggatttttttaatgtgtgtatttggtctatgtgtgagttcttttattaccatggacctaaatgcgtattcgtgctctcatttctgtgattgaaatgattaggctttgtaataggtttgggggtgctgtgttatcaacattacttgtggcttgtagaaattgttcgtcacataacaaaatctgtcaagtagtttgtgatgtttgacagcctgctgagcacatttactggttttattgtttctgttttttaatggcatgatgatgatagtaaaagcacatgaagttgattctttagattttaactttccgagctttattctttagggtccatgcctttttagagcagtggggactcgttaattaccaagttgacccggaaagtagacccatggcaatgggacctcctcctactcctcattttaatgtattagctgataccccctctgggcttgtgcctctgcatcttcgatcacctcaggtaaattaatgttgacttttcatcagacctggatagtaacaaatggccatttatagcatatctatttagaaacaattattattatactataatgctattattagtgctatttctttgatccttgcttgtgtgtgtattttggtgtactgtaaatattacagtccaaaagaatatatagtgtttaagttaatgctgtcccaccaatcccaagaccgaatgccttactctgtcaaattattaatttacttttatatgcataaaagtaaattatccttctgtcatcaaaaagacactcataagtaagcagatgatgcaaaatcttctttcccttccttcaatctgtgttctagaaatgtgaagcaaagaaatctttataacttgtcctaagatttgtaaagtgtatatccatatatacattatcaaaacagattatgtcaaacaaattatatatagcattaagttggattcacaggaacctaaggtataaattttgtcccattgtgaaatagaagatagtaatgaaaatttgttatcctttctgggatttaaagggacaccaaaatgtgacttatatgttgaatttttgttagaagtatagtgtagaagtgtgggtatttattgttttttgtaggaaatccaccaagagtggtttaagtgccaatattaaactttttttttttttttgagacggaatcttgcactgttcccccggctggagtgcagtggcatgatcttggttcgctgcaacttccacctctgggttataagcaattctactgcctcagcctcctgagtagctgagattataggcacgtgccaccacgcccggctaatttttgtatttttagtagagacgggtttcaccacgttggtcaggctggtcttgaactcctgaccttgtgatccgcctgcctcggcctcccaaagtgctgggattataggtgtgagccacggcgcctggcccaaacaaatttttaaaaacatttaccctcttgactttaaagaggctaactcagccatttatcatttatttgactcaggttcctgctgctcaacagatgctaaattttcctgagaaaaacaaggaaaaaccagttgatttgcagaactttggtctccgtactgacatttactccaagaaaacattagcaaaggtaatttttctaatcacacatgggctgcaatccagcacatcttagtccttctaagatacatctaatgagctttctactcaaatctgatggtatttttaaaaacaattatgatttatcttaccttttatattcctatatgacttagtagataggtattttaaaaataacactattagagaaattcgaggggaaaatggagaatttgaagagagaattagaatctgtaaaaagaatcatgaatattttagaactgaaaagtatacttgaaattatttgataggtttaataacgactgcatacagcagaagacaggttagtgaactcagagacaaattagtagatatattgaaactaaagtaccaagagaaaaaattggattgaggtagggaggggccaggacaaagagaggagagtggaacagatatgtgagatagagttcaggctggacacggtggctcacacctgtaatttcagcactttgggaggccaaggcaggaggatcactggagccccagagtttgagaccagcctggacaacatagcaagactgtgtctctattattaaaagaagaaaaagaaaaatgaatgatacagtccaaagaattaatgtttatcattagaaacccataagagaatgaatggaggaggagtgatacttgaatatataatggctaaaaagacttcagaacaaataaaaagataccaactcacaaaacaagaaagacagagccaggccaagctcaacactttgggaggccagggcagtagggttgtctgaggccaggagttcaagagcagccttgcctctactgaaaaacacacacataaaaagaacagatccaaatttatatagagagaagaccacactcgggtacattatgcttaatttcttaaaaactaacatcttaaaagcagacatggagggtgggggcgagggtagagaagaacatattacattcaaaagaacaataataaaactgatagctgacttttcaacaaaaatgatcaaagccaaaggacatttttaaattggaaaagaaaaactatctatctggaattctctatccagtagacattactttcaaaattgaaggtgaaataaagacgtttgtaggcattcacaatgtacagaagttatcgctagcacacagtataagaaaagtaaaggaatgtcttcagcatgaaggataatgatcccagatgaaagcacatgactccatgaaggaataaggagcagagaaaagggtaatctgtgtggttaaatataaagtaatacaggttgtttaaacaataatatttgggatttataacgtgtagaaattacaagaatggcagaaaggcagaaggagattaaattgaataaactgttacaaagtttacattatttagaaacatgacaaaagtcctgattcagggtaaactataatttgacacaacagtttgggacctgactggatctaatggaagaataaagagtgatagaaaaaaggtcaacatgtgagtcagtataaaagacatcttctggccaggcacagtggctcacacctgtttttgttaatacaaaattcagatccaagaaaaactaacctatggttacagaagtcagactagtatatacttttgtgagtggctatcaattgagttttaaaggagggagccttttgggttttgatttgagtattattacattgtcatataagttaaattgtgtcaagttttatactaatttgtgtattttattgtgtatgtatcatacctccagaaatacaaaagaattttttgttttgagactgagtttgcccttttctcccaggctggagtgaagtggcgcgatgttggctcactgcaacctccacctccacggttcaagtgattctcctgccttagcctcccaaatagctgggattacaggcgtgtgccaccacgcctggctaatttttgtatttttagtagagacagggtttctccatgttgactaggctggtctttgaactcctgaccttaggttatccacccacattggcctcccggtgtgctctgattacaggcctgagccactggcctgccccccccccacccttttttttttgagacagagtctcgctctgtcgcccaagctggagtgcggtggcgcagtctcccctgcaacctctgcctcccgggttcgaccagttctcctgcctcagcctcccaaagtggtgggattacaggtgtgagccaccacacccggctttttttttatttttatttttttaaagagagaacatctcactgtgttgtcctggtttgtcttgaactcctgagctccagtgatcgaccttttttaccttccagagtgctaggattacaagcatgaaccaccatgctcagcctaatacaagaaaaaaatattttaaaatcatatgaaagcttcagcagtcattttgtgggctctaatgaggcttatattgtagagccaattgttatcaagagaggaaacgggctgggcatggtgaaaccctgtctctactaaaaaaaaaaatactgaaactagccagacatggtggcggctgcctgtaattccagctactcaggaggctgaagctcgagagtcgcttgaacccaggaggaagaggttgcagtgagccgagttcatgacactgcactccagcctgggtgacagagcaagactccatctaaaaaagaagaagaagaagaagaaacattgacttaagtctgtggggcagaaaaaattctttctacactttgtggctgagaagtggagaaatggttgttgaggacctatcctataaatgtctgtgtctaggttgtagagatcttccttatatttgctcaggttttgtttcttcagaatttagattaaatgttaatgaattttgttcttcttggggctccaaatctgattggtgattacctctgattttggttttttaaaagaacctttggttatcttaaagtaatccttgcggggctggacgcggtggctcacacctgtaatctcagtactttgggaggccgaggcatgcggatcacgaggtcaggagatcgagaccatcctggctaacacggtgaaaccctgtctctactaaaaatacaaaaaaattagccgggcgtgttggcgggcgcctgtagtcccagcggctgaggcaggagaatggtgtgaacccgggaggcggagcttgcggtgagccaagatcgtgccactgcactccagcctgggcaacagagcgagactccatctcaaaaaaagaaaagaaaagtaatccttggggacctgagctgtatattctgcgttatagatacaggcatcttttctttctcacaaagccatactgtaggagtttaattcttagttctgcaatgcttaggtcaactgtttattctttagttcaaagactacttatttttgatgcattatttttttttgtgcaagtgaacagcgtatgtcagaatgctatgaattgaatgccccagagatgtagcaaatcagggtttaattttgttgttgttttatttttgttttttctttcttccttcatacagaatgtaatttttttcatgcagtgtgtagcactaatgcactgagagttttaattatctaaactgagaaactttattgacatatacaggaaaatcacagattgtagaaatgtttatttattaaatggtaatctctcaaaatagagttttgagagagggaaatatgttagaatgtatattttgaattagtaatgtttatagctgcatgatagtatcagctatactacaaatcaagtcccctgaagatgagtgaatgcagcagggtctgcagataaagaagtatgaattaatcaattaaattttagtttttacacaagccagtctcacttctgttatactcacatcgtcacatgaatcataaactataagggactcacatggaaaaggtgattttgagtttagggactcacttggagattctttcataattgagaaatgttttaaaatgagataatatgggcttattgcagttggaatcaagaacctgtcagtgttttacgtgtgtagtacatctgatccttgaatcgtggaagaagtagtctcttcaagttattaccaagatgtgtactatgtttgtgatattacagctgatttatggtatgcagtaaaacaatatgcctttttagcttgccaaagatactgttaagtatcaaaataatagaaataacatatccaaatagttatgggtccttgtttgacagcaggaagtcttttttggttttggtttttgtgtgtgtttttttttttttttttttttttttgagatagtctcgctctgttgcccaggctggagtgcaatggtgcggtcttggctcactgcaacctctgcctcctgggttctcttgcctcagtcactggagcagctgggactataggcatgaaccaccactctcggctaatttttgtatttttagtagagatggggtttcaccgtgttggccaggcttgtctagaactcctgacctcaagtgatccacccaccttgccctcccaagggctgagattacaggcaggagctaccacgcctggccagtctttgaaataagccagcatttcttatagaagtttaggctccttaaagtgttttattcctgttagtcaaagacttaccatgatagtttgcgtaacacagtcccctgagcttggaaaggaattctactgagctccatcttcagcatttaaaaatgagcaaataatttctgattttgtttccttagagtaaaggtgctagtgctggaagagaatggactgaacaggagacccttctactcctggaggtaagcagattaatgcatatgggatgtgtgctaagattctttgactagcattttattttgttttgttttatttagaggcagggtctcgctgtgtcacccaggctggagtgcagtggcctgatggtagctcagtgcagcctctacctcccaggctcaggcgatcctcttaccttcagtcctgaatagctgggactaagggcgtgtgccaccatgcctggctaatttttgtattttttgtagcaatgggctttcaccatgttgtccaggctggtctcaaactcctggactcaagcaatcctcccaccttggcctcccaaagttctggcatgaaccactgtgcctggcctgtgactagcattttaaactcacctatagtattctgttttaaaaagtgtccactggagctcaaaactcaatcacaaatgtgttttcctttagaacagccatcatgctttgatagttgatacttaaatccttttctgtgtctccatgtagttaggtattgagatgattaaattgataatttttatagattcattgaggatgtttaagtgaagctaattcctaatcacaaaataagttgtgaatgtgtgacaattagaaataaagtgactactaagacaattggtgtcattgcctggatttatcctaagatgtcgctgctccttttgcaccatgaatgcaaatgtcaacataatgaaaaaggcagtagtgtcttagtattatcaaggaaattgtttgacatcgcagtcctcctaaaagagcctggtgccctctgggttcccagaccacatagagtggacttggtgacattttggttgctgtactgctttgatggtttttcaggttgttccaatagttgtaattactgtagaagtatcattggtgcatcatcaaactatttccatttcttttttgtattcctcttttactttttcttgctgttttctggttctccccccaaccttatctttctctgttgtgatcaaaatcaaaacaatcccttgttttgtgtttttttgcctctattttaatatattctcatatgcccattcagtatcagtgatacgcagagagctttgctgactcactttttacttatttatttaactatctttcctatggtactgactgactcactttcaatttcaggactattttgtatagccatatctactagattttaatattaattaaaatgaaccgtgttttcagtacttgtgggtgactataaacacacttttgtattgctattttggaatctttgggctctggagagaaagtaagttgtataacaatgactggagcaacagttgttctttttcctgctgcacattgatgctggaacttttctcctttttcacatttaagattagtaggtagtaaaagtgaggtaagaatgactgagctactgttgacactaaagacatccaagaaaaccacagtattacacaacagtgcattttctctccttcaggtggaatctgtgaagtgtttgatttttcttttaatcttgcaattcagtcaacaggaattgtttgcaataacacaaagagaaataaaagacttctccacatcagtgtttaccactaacatcttcgatttatatagtttatttagagatacttaatagcttaagaatatgaagtcagatgagtatttttaaatggatttataatcaaatatagtctctttctaataaatcgataaatctggtagactcattggggtttgctgttttcaaaatagcatcgtaccttttttttttttttaagacagggtttttctcccttcccccatgctagtgtgcagtagcgcagtctcagtccactgcagcctcaatttcccgagctcaggcgatcctcccagctcagcctctcgagtagctgggactacaggtgtgcaccaccatgcctggctagtttttttgtatttttaatagagatggggtttcaccatgttgctcaggctggcatactattttattaaacaaatataccacacaggcagcattccaaatatttatcgtattcttgagcacacccctttgatttttaaaagaccttgtttcataaagtcttttatcaaagcacagcttttgggtaaatgctgaaggttaatatctggttatgttcatttccttgttatcttattgtaaatattggaggcaacatttcaattttggaaatagtcaaagtggaatgtatacgatagatgaaggaatgcagtttgaaaaagaaaaatctttaatcggtagaaatgaaggataatgtaaggttttatattaacgttttaaaaagaaattactctgtaagatcaagatgatgatggcctgtttgaataagacttcagttgtaaaaaggtgtggggaatttctacttgaaaatatgtcattagaatgagtaggcctataaagtctaaagtttgaggtaaaaaaacaaaacagcacaacaagaataagtagctataaaaggccatgacagtctttatggaagtttgaaattctgttgatataatcagggcaccagaatgaaagagagataatggagccactctattccacagtgactaaagaattttttttcaagttaatatatatgtacatgcgtatctatatatatatgcacatatttatttatttaatatagaggcagggttttgctatgctgtccatgctggtcttgaactcctggtctctagtgatcctcctgcctcagcctcccagagtacttagattacagacgtgagccactgtactgggttcacagtttcttttttctttgagaaggaatctcactctgtcaccaggctggagtgcagtgacatgatctcagctcactgcaacctctgcctcctgggttcacgcagttcttctgcctcagcctcccgagtagttgggactacaggcacgcgccaccatgcccagctaatttttgtattttcagaagacacggggtttcaccatgttggccaggatggtctcgatctcttgacctcgtgatctgcccgcctcaacctcccagagtgctgggattacaggcacaagccaccgcgcttggccttcacaatttcttttaagtccacaactgattgcagtattcttcctgttcatttataattattcttgggcttgaaagtgacaagacttgaatttgtgagctcactgattctcccgtgatagctctagtgtttgtcatgtatgctttgctttctcatgctatttattttcccttagataattaatagacataaaggctatgcctgcaaagaaaacttgtaatttattaacatttatttatcactgtaagagtttctctctctctcttttttttttttttttgagacggagtctcgctctgtcgcccaggctggagtgcagtggcgtgatctcggctcactgcaagctccgcctcccgggttcacactattctcctgcctcggcctcccaagtagctgggactacaggtgcctgccaccatgcccggctaatttttttgtgtttttagtagagacgaggtttcaccatgttagccaggatggtctcgatctcctgacctcgtgatcggcccacctcagcatcccaaagtgctgggattacaggcgtgagccaccgtgcctggcccgagtttctctcattttttatgccagctaaataataggaaacatagcattagaagatattcagtaaccaacatgaaagatttcctcacagtgtgcatacactttacatactttttcttgatgcaaaacccaggaaatatatcattctatgtacttttgaactacactaagatgcatagtaaatcttctattaaaaaacttttcttaaggacagagatgtccaatctttggcttccctgggccacattgggccacacataaaatacactaacactaacaatagctgatgagcttaaaaaaaaatccccccaaaaaatcatagtgttttaagaaagtttatgaatttgtatgggccacattcagcgccatcctgggccacatgtaggctgcaggccacaggttggacaagcttggtttagctaagagaaccttttttttttttttttttaattaggaaaacagtctgcctttttacatttgagagccatagcaaagtcagatttatttcttggtttagttcagtttcctgtggtttgagttcagtaaactttattaggtattgtgttttggacactgacagacactgcaggtagagatctgtagaacacaatctgtacctttaaggaattcatagtctgcttaagtgacagagaaagataaaacacaaagcttgaatgcggaattcccagctttatgattagaggtatgtccagagcacaagagctgtacagaggagttgctttgcaaacaagccaggtagataagacataatgaacaggcttctgggaatggtatagctgtgttggtcctaaaacatgatgtttccagtgcagaacaaatggttcataggcacaatacctagtaggaatagatcagtggggcctgtgtattgttgaaacgtgaagagtagggaatagggcgggagaagtaggcagtgtcctgatcatgtttggcttaatttcataagataatgacacataataaaatagttttaggcaggagagaaagagtgttttatgtaaaacatatttcaccctagcagcgtggagaaggatgaaattactatagaaaggtaattataataatcgatctatgaggctgagatggaaggattgcttgaggccaggaattggacagcagcttgggcaacatagcaagaccgtgtctcacaaaaaaaaaaaaaagagagtgagtgagtgtatccaggttaagtaatgatgaagacctgaacctgggttatggcaggatgaatgaagctgttttgtagcattataagatacttactaaaaactttcattgaatcatcctccttcctggccagtgtgtcaccgcattattctcttttcaaaacatcactttaatttgcctctcttattagcattattatcagttcctaggctcagacatttacagattctcaactctgtgctcttctggatgctgagtcttgcttggattttgtatctcagaagtttccccaactccacctttattctggaaaaaaacttgatgaactttcttattgttccctggcgaaaggaacatgaaaaaatattttttaattaaaaatttcattggaaaagggcatgatagagcatgtctagaaaatccctatttataattagaaacataatacagccccagtagatatatttctacttccgtggacccgagtgagatttatttttcttttttcttacaatctggatctttcaaaaagtaattccttctcgaactacctgaggttactgaatatccagaggaaacccagaattagcctagtttttcaagggatttaatgtgtcaggccatttgctggcttgggttttgagaagtcctctaccattccagcagaaatgaaagcctgagcagcagttggaacccagagttaagaattaattgatgtccaggtgcagtgtttcacacctgtaatctcagcactttgggaggctgaggcgggaggattccttgagttcagaagtccgtgaccatcctgggcaatacagtgagaacatgtctctaaaaattaagaaaaaaaaatctttgaagtaaaataattaactgaaaaagtaaacatggagacaactattgttatagaaagctcaatctcacagtgtagagcagcaaattaggctctaatgcaaggtttttcagttggagcattcaatattgacatttgggccagatttttttgttgttggggtggagggttcatatatgttttacagcatacatggcccctccttgctgttagataccagcagcacttctccagttgggtcaaccaaaaatgtctgcagacattgccagtgtcctcaagggggcaaaaattacccttcattgagaaccatggtcctggagagaatggtgtgagagtagcaacttcagtatgccactaaataaattctttttatccaattaattcctcaacattcttagcaccacatagttgtggttttctttctactgttctatccgtttttccctcggagactccttttactctttttgttggtttctttcaggattttctctgaaaaaataataaattataaaactagaaatgtatgtagtttataaattttagaatcagtttatcaatttctactaaaaagaagcctacttggagtttgactggaattgtattgaatctgtagttcaacttggaaagaactgacatcttaatactgagacttctaatgaatgaacacaatatatctcttcctttatttgggtctttgagttctctcatgttttactcattctagtctgttgctcttatacattctttattatgtttattcctcctaagtatctcattatgctatttaagacagggtctttttttttttttttttagagtttattaagcaggggagtggaggggagatgtggcacaaatagaagtatgtaacattcaaacaacagaaactaggatttttgaaaaaactttcagttacagttacgcaaagggtcacttcctcccccaacgacgcatgggcctctcaaaggagaggagggagtaagtcccatggtagggccagtgcttgctcctgggttttggaatcatttctgcggagctttcaaagccagaccctgggctcagggttgagacttcatagcggtgacagctagacccagcaagatggctgtgaccgtgaaaccctgggcggcgatccaggtgcacatcatgagctgagagcgctggctgttgccccggtggaaggaatagaggctgtaggtgagggcggccgccgtggccaggcaacctatgggtaccaccgggttctcgtgggtcttgtgaaggaacttttccttgaaactctctggattcctgtaaacagtggggctaagcccctcaatgactgggggcttcgatggttcaaaggggacctctggaatcacagggccggagtcgccatgtctgggccacagcagcaggagaaaatcgcgacctaagacagggtcttgctgtgtttgtcaggctggccttgaacccctgggctcaagagatcctctcgcctcagccccctgagtagctgggagtacagatgtgtgccactacacccagcttttatgttattttaaatacttttttcttcctatttaaaattgttcattgctattatgtatggaaatatagttcagtttctctattgcccttctatcctgtgactttgctcagctattcagttttagtacttttttttatagcttccttagaattttctacataaacagtcatgtctgtatgtattagtaaaaaagcccttccttccttccttccttccttccttccttccttccttccttccttccttcctcccctcccctccccacccctcccctcccctctcccctcctctcccctaccctcccttccctcctttccttcctccctccctccctcccttccttccctccctccctccctccctcttttcttttgtttcttcttttctttctttctatcactcttgccgcctaggctggaatgcagtggcacaatctcggctcactgcaacttctgcctcccaggttcaagcgattctggtgcctcagtctcctgagtagctgggattacaggcacgcaccaccatgcccagctaatttttgtatttttagtagagatggggtttcaccatgttattggccaggctgctctcgaactcctgacctcaggtgatctgcccacctctgcctcccaaagtgctgagattatacgcgtgagccaccgtgcctggactactttctttacagtatgcatgtcttttatttattttacttgcctgattgaaaataatctaaggaaaccatcaaatctttctatttatgcataaatatttgcattaattttttttaaaaaagctatctaaagaacttctaatattacacattactttcttgttacctgacatgaaagcatctgttttttctgtcttaggccctggagatgtacaaggatgattggaacaaagtgtcggaacatgttggaagtcgtactcaggatgaatgcatcctccactttttgagacttcccattgaggacccataccttgagaattcagatgcttcccttgggcctttggcctaccagcctgtccccttcagtcagtcaggaaatccagttatgagtactgttgcttttttggcatctgtggtggaccctcgcgtggcatctgctgcagcaaaagcggctttgggtatggacttccctaaaccatctcctcaacagaaaaactcagtttatcccaatttaaatattaccagccgttacattcatttcttttaatgtaaataacaaaaatcagatattacctgtgaaagataccatattctttataaaagtattacaatatttggctggacaccaaattagctgggtgtggtggcacatgcctatagtcccagctacttgggaggctgaggcaggagaatcgcttgaacccaggaggcagaggttgcagtgagccgagatcgtgccactgcactccatcccctgggcaatagagcaagactccgtctcaaaaaaaaaaaaaaagtattacaaaatttttaagtaatgcaccttaaaattaagagctttaggaattggagggacagaggttttttattgtgtattttgtgattaatttagaatttggtgtaactagcaaaggaagtcatttaatattcatgggttacacattaattgtaactagaactttgtcacatcatagaactctttcttggttttatggatgtttaatccttgctgtttttgtttttttgacttattaatctagtaagcagttaaaatatggacagcagttttgattattactggcataagttgaaagatctcttatttcaaggctctgtgatgtgtaggagaaaatgtagaaccatagaatttcattattattactattttttgtctcatttagtcctctcatttttctggtatagagggactgagagcctgaagaggttgctacacctaagacaataatactgtgttgggtttcctggtggtggttttacactgaagcaaatttttgtgcaaagttagattgctgttccatttttattcttgaaccagaggagttttctcgggtccgggaggaggtaccactggaattggttgaagctcatgtcaagaaagtacaagaagcagcacgagcctctgggaaagtggatcccacctacggtctggagagcagctgcattgcaggcacagggcccgatgagccagagaagcttggtgagtcactgctgcttttaagggacagggttaatatatgtttgtattcctgtcagtttactcaaataattgggtttacttgcactaaaaagtgagtacaatgatcagtataaacttgtcttttaagattagtacatgattttttttctcttgtctgtttcttttggtagctagaactaaaaaattatcttgtaactgttaatggtattacagttgtgaattatctggttgctgtttgtagatccaggttttgaatagacagatacaagaatactgaaagatgcatggaactgtaggtgaaaaaaagaatattgaaaggacttatgattatgttaatttatatgttgctgagtgggtttaaattcattgttttgggggtttttttagctgaggaaaaattcctgtaacataaaattcctcattttaactgcttaaaagtatataacctagtagcttctgctatatttacaatgctgtgtgtctatcaccactatctaattccagaacattttcctcatcccaataggaagtcacatacttattaagtggtcactccccattccttttgctcttcagctgtggtacccactaacaatctgctttctgtctctatgggtttgcctattctggacatttaatataaacagaatcatataatatgtggcctttgtgtctgcttctttgacttagcataatgttttcaaggttcttccatgctgtagcatgcatcagtatctcattcttgtcagtgctgattatttctttgtgtggatatacccaattatatttatttgtcagttcatggacatttttattgtttccactttttttttttttttttttttttttagacagagtcttgctctgtcgcccaggctggagtgcagtggcgcgatctcagctcactgcaagctctgcctccctggttcacgccattttcctgcttcagcctcccgagtagctgggactacaggcgcctgccaccacgcccagctaattttttgtatttttagtagagacagggtttcaccatgttggccaggatggtctcgatctcctgacctcgtgatctgcccgcctcggcctcccaaagtgctgggattataagcatgagccaccgcacctggcctattgtttccacttttatactactatgaaaaatgctgctatgagtacttatatacaagcttttttgtgaactaaggattttcacttcttttggttgggtgtatacctaggggtagaattgctgagttatatggtaattttgtttacctttttgagaaactgccagcctgtttttcatagtggctataccattttatgttcttacccgtaatgtataacatttctaagtttttcatgtccttgtcaatacttattttccatttttacctgtaatagccaatctagtggtttgatgttggggtttgtatttgcattgatgactaatcatcttgaatatcatgtgtttattggccatttttatgtctgccttgggaaatacctactcagattcttgcccccccccccttttttttttcttagtagactttatgtcttagagcagttttaggttcatagcaaaattcagtagacattacagagtttctgtatactgcctgactacccctacatgcacagttttccccacgatcaataccagggtggtacatttgttatagttgataaacctactttaacacatcatcatcaaccacagtccaaagttttagtttattctgtaattgattctcacatgttgaaccaccctccctttttgttttttggtttttattttgataaatccgacatggcctttgtaaataatccatttaacatgctatcagatttggtttgctagtcttttgttgaagatttttgcatctgtattcatatattgtttatagttttcttttcctatgatatctttatctagttttggtattacggtaataaccagcctcaaagaataagttaggaattgttcttttttttttcttttttttttattttttatttatttatttttatttttagaaaagtttgaggagcattggagttaattctttaagtgtttggtaatattcactggtaaagccatcgtgtcctggacttttcttactttcttgattactgattctgtctctctctctcattttttttttttttttttgagacagagtctcactctgtcacccaggctggagtgcaatggtgtggtctcagctcactgcagcctccgcctcctgggttcaagcaattctccctgctcagcccctggagtagctgggactacaggcttgtgccacaacacccggctaatttttgtgtttttagtagagatggggtttcactgtgttggccaggttggtctcgaactcctgaccttgtgatccacccgcctcggtctgccaaagtgttgggattacaggtgtaagccaccgtgcctagccctcattctgtctcttgttataattctaccaagatttaaacatttcttaatgagtcagttttggtagtttgtgtcttataggaatttattcgtttcatgtagattatctaatttgttggcaaaaaatttataacaacaaaaaggggaaacaactggaatgtccatcatctgatatgtgataagcaaaatgtggtatatccatacaatggaatattacttggctgtaaaaaggaatgaagtgtttacatttgccacatgatggatgaattttgaaacatttggtaagtgaaaagccagtgaaaatagccaatatattatatgattgcatttataagaaatgtcctgaagagggaaatctataaaaacaaagtagattaatggttgctctgcataagcggaatggaggattgggggttgatagcaaaaggatatctctttgaagtaacgaaaatgttttaagttttaccatggggatggttgcacgtatctgttgatatacttaatttaattgacttgtactccttcaatgggtgaattttatattatgtgaattacatctcaataaatgggtgaattctatagtatgtgaattatatctcaaagctatttttttaagttcacagtgttctctcataactgttgatagtaatgtcctcattttcattactgattatagtaatttcatccacttgcttttcttgttttaaagtcagacaagataaaggcttgtcaattttgtctcttcaaagaaccagcttttttgtttcattgattctctgtttttctgttctataatttctctccactctaatcgtcattttttccttctgcttgctttgggttaaatttgcttttttcctggttgttttaaggtagagtatgttatttgagatcttatttagtaatgtaggtgtttacagctgtataaatttccctcagcactgcttttgcgacattctataagttttgctgtatttatttatgtttccattcttctcaagtactttgtaatttcttttttttttgagacagagtttctctgttgttgcctaggctgaagtgcagtggtgtgatcttggcttactgcaacctctgcctcccaggttcaagccattctcttgcctcagcctcccgagtacctggattacaggcacccgccaccactcctggcttatttttgttggtgtgtgtgtgtgtttttaagtagagatggggtttcactatgttggccaggctcatctcggaactcctgacctcaggtgatccacctgccttggcctcccaaagtgctgggagtacaggcgtgagccactgagcccagcccctgtactttgtaatttctgttgtgatttcttctttgacccactggctattttaagaggatgttattgtgaattttcataaatttgtgaactttaaagattttcttcttttactgatttttagttacatttcgttgtaatcagagaaggtaatttgtgtgatttccgtatttttaaattaagacttgttttgttgcctaacatgtggtctattctagacaacattctttgtgcatttgagaaaaatatgttttctgctcttattggatagggttgttcaagttgtctacttccttgtttatcttttgcatacctctctcctttattgaaagtggggtattgaaatctccaactattattgttgaattatttcttccttcagttctgtttttgctttatgtatttagagactctgttgttgcttatatgtttataattgttacatctttttgatgtattgaaccttttatcttttacagaatgtcctttttgtcttatataacgttttgtgtcttaaagtctatcttacctgatattagcgtgccatttcagatgtttttaggtttgtttacttttgttgttgttgttgttgttgttgagatggagtctgactctgttgcccaggctagagtttagtggcatgctcttggcttactgcaacctcagcctccacctcctgggctcaagtgatcctcctgccttagcctctcaagtagctgggactacaggcgcataccaccatgccctgctaatttttgtatttttagtagagacggggtttcaccatatttcctggctggtctcgaactccttggctcaagtgatccacccatgtctgcctcccaaagtgctgggattacaggcatgagccaccatgccagacctggtttctgtttacatcgatttacttttccatcttgttactttcagtctctttgtttcttggtatgaaaagtgcctctcttgtagactgcattgtcatcattggatttgagaagttgagacttaggttctacctttctttctacccttcatagccatagggctttaaaaagcaatttacctttgctggttagctctgaattatctcatctgtagaagaacaggtattattagatactttctgtaatgtattgtttactagtgctgttttatgatgttagaaaggagacatttttgctattaaggacttaattacctgtttctctttaatcagtcttaaagaggagtgaaattaataaagcaactttatacgtagtaccggcttctcaaatggaagtgctcttacataagaggctttttttttgaaatggagtcttcctctgtcacccaggctggagtgcagtggcgtgatcttggctcactgcaacctccgcctcccaggttcaagcgcttctcctgcctcagcctccctagtagctgggactacaggtgcgcaccaccaagcccagctaatttttgcatttttagtagagatgggaatttagcatattggccaggctggtctcgaactcctgaccttgtgatccgcccgtctcggcctcccaaagtgctgggattacaggcatgagccaacctaaaaacattattgtctctgtaattatttgtagtatattcccagcattttttacattgttcattaatatttttcttttctatcattatgaaactatgtatgtctggtgattaaagaactataggtgtcattttgcctaattatttccatctttatctcactggtatgaaatttatatacactgtgctttagatacagtgattttcatttgtctttttaattattattattttttgttttgagacagagtctcgctctgtcacccagactggagtatggtggtgtgatctcaactcactgcatgcaacctccacctcccaggctcaagcgattctgctgtctcagcctcccaagtagttgggattacatgtgtgtgccacgacacctggctgatttttgtatttttggtggagacagggtttcaccatattggccaggctggtctccaactccttacctcaagtgatctgcccgcctcagcctcccaaagtgctgggattatggacgtgggccaccgtgcctggcctattattattttttttgagacagtgtctcgctttgtcacccaggctggagtacggtggcgtgatcacagcccatcacaacctctgcctcccaggctcaagtgatttctcccacctaagcttcccaagtagctagaactacaggcacatgacaccattgctggctattgtctttttcatttactcttagaataaagataataggaagtaaaaattaaaattgctagctagtgctctacagaacatatcatataaacacctagtgctcccttcttggcagttcaagtggatatcagtgaggtcctttcaaacctaaaatcttaccattttttatgagtttgcatagggcctacccctgttgttctctctactttgtttgaattaagtgccagtctagccatctcattttgcttatatggaaacattttcagattaatgaagcctcttatccctgctgctggggtttggatatggtttctttgtcctcaccaaaacttatattgaactttgatccccagtgttatggtgttgggaggtgtttgggttgtggaggcctatccttcataaatggcttggtgctattcttgtagtagtgaatgagtttccactctcactcttggggaattggattagttatcccagtaatggattcattcgcctcagagtgggttgttataatttcaggaccctcctcaggtttctcttcttggtacacctgtctgcgtctcctttgacctcctctgccatgttgcgacacagaacaaaatcctttgctaggaatcggggccatgcccttgaacttctaagtctgtggaactgtgagctaaataaaccctttttctttataagttatctagtttcagataggcttttatagcagcagaaaatggactaagatcccagtcctctgcgcaaattattgttctaactcttcttaacgttggttacacctagagtaccaactctttgatttaaaagcaatttgagagtatctataattcttagtttgaaaattaacttattttctttttcttatatggagactgaaattagcaggcgaagtcacgtctctgttcttctatgttgattctgcaccaccagacagtacccagcataggctggaaaaacctggggctaatgaagcctgggtcttaatttcctaaatgtttttggtattggttcatttgtagggtcttttggttctctgtggttatggagttgaaaaaacattggcagtcttatttgattcagtgagatttgtgtactttgccaaatgagggatgtgtttttacatgtatgttttgaaaacacattttggtagacgataccatagagcattagtggctatgaaataggttgcaaatttagccatttctagtttagtgggttttgaaacaagactgaagtatctagcaaccttggtttctttggggctggattctcctgattcattagtgaatttatggtttgtggagcatgcagaggttagactgctacaggaggcacatgagactacaagggctgacctttgagtggcattaacagtaaaattcattcacggtatctggaagtagcctcccagttaacttctttcaagtgtgttctgtactcactaattgcagcaacagaatttgggtcctcttataataagggtaaggaaaacagaccataacataaatatttcaaatgagttgagaataggtccctgtaacttatgctggactattatagataatatgatttatattggattctgacaaatggaataaattgaaaaacagcaaatgtttctcccttgggaattggctcaacaaaattgtagtaggaagtcaacagtatgtctcttacgtttcatgtcacaaatactgccttattgcatagcacactgatttgaaaccgagtgatataggattttacttagcaagataatagtgtacttgggtggtgggttcatggtactatttattgtgataatttactgtgttacaaatgtgtacacataggtattaactatggtaaaatcatactatagggaaaataagcttccttaagaaatatagtacttgttttgggttcctgtcattaacctatctaacatttcattgtgaatttggataagaaaagaaatatatgatgtatatggtgaaatgaaagtaaagcggccgggcgccgtggctcacgcctgtaatcccagcactttgggaggccgaggcgggtggatcatgaggtcaggagatcgagaccatcctggctaacaaggtgaaaccctgtctctactaaaaatacaaaaaattagccgggcgcggtggcgggcgcctgtagtcccagctactcgggaggctgaggccaggagaatggcgtgaacccgggaagcggagcttgcagtgagccgagattgcgccactgcagtccgcagtccggcctgggcgacagagcgagactccgtctcaaaaaaaaaaaaaaaaaagaaagtaaagctggatgaacactcaaaacacctcttacatttatattttaagtgatttcccataggaattatttaggaaatgagtgttttcttatgagaagggtcttcttcagtccatctttttaactatggtcactcaccaagaactattaatttctgtacatttatatattttttgtttttcattgactggaccattctaggcatacaaaaaatacttctgagtacccatatttagtccacattgtatagggatttttgattggccatttgagtttcttttcaggagaatcctttggaggaagtaactttttttttttttttttgcaaaagcaaggaaactgaggcatggagaggttacataagtgtgtatctgaaccagaaatttaacctaaatctctctaatcccaaagctctacttctcttcattgtagcaggctgccagaagtaaaatttgtagatgtgtctgtgtggttttcattcattgaacaagcatctttaaaggcttaatagctccaaaatactattccgtcttagatactatgggaaatataatgctgaagagcccaggccctcttgagaacttaacacctgtctcctgaaataggcaaatgcatcaggcagagcagctgtggttgacttcctctatatgccactgaatgccaacaaaacccacagaagcctgggtgctgtggcttatgctcgtaatcccaacattttggcaggcaggagaattgctttaggccaggatttcgagaccagcctggtcaacatagcaagaccccatctctacaaaaagtaaaaataaaaaaattagctgagcatggtggtgcaaacctgtagtcctagctactcaggaagacaaggtgagaggatcacctgagcccaagctacagagagctgtgatccacactactgcattccagcctaggtgactaagcgagaccatgtctcaaataaaaaccaaaaaccttacaccaaaattcagtcagtgtcattcagtgcatgagcctgtgccagagaagctttcttggacataatcacaaaaaatcaaactcagtgtatcatattatcacatcatttctttgtgttctggatgctaggatactggtaaacaaagtaaaccaaaatttctcccctttatattttatatttatagagtgtaagatggacagcaatctaatcaaataagtaaaacttaacgtgtatagatgtaattatatatgaagagtatgttggctgatgtgctatggtgaaaagcaaagcagggttgcaaggatatgagtaaagtgtgggaattacaattttaaatgatcagggaaagtctcattgagaaagtgacttttgagcaaagatgtaaataaggtgagcaagactgctatgtaggcatccagtgtaagagtgttcccagtattggcagaagccagtgtaaagccccctgggcaggagctacctggcatacttgaagaacagcaaggaggctcatgtaaagttataatagctcgattggtgggggaggggaggtcatatgagatgttaaggtaatttgtgggctattgtaaaatattaatgtttaagtctttatgcaaagtggagcaagtggagcagtttgaccaaaagagtgtcagagtctgacatatatatttgagacagggtttcactctgttgcctagactggagtgcagtggcacaatcttggctcactgcaacctctgcatcctgggctcaggtgattctcccacctcagcctccccaatagctgggaccacaggggtgcatcaccacaccttgatttttgtgtgttttttatagaggcagggtttcgccatgttgcttaggctggtctcaaactcctggactccagcaatctgcctgccttagcgtcccaaagagctgggattgcagacgtgagccaccacacctggcctgagtctgacctatattttttcaagtcttactgtaacttttcgattgagaatatacccccatgtagaagttgttaaattgatttattatgcagataacatatttgattttcaaagaaaattttcttcattgcatcactaaggcttttattaaaaagctctataaagattttattaaacttttctttatttatttttatttttttttaaagagacagggtcttgctatgtctccctggctggatacagtggcatgatcatgattcactacagccttgacctcctgggctcaagtgatcctcccacttctgcctccgagtatctgggactacaggtgtgcaccaccatccctggctaattcttttagttattgtagagacagggtctcactatgttgcttagactagtctcaaactcctgagctcaagccatcatcccaccttggcctctcaaagtgctgggattacagtcatgagccactgcactcaacccaaggccacattttatgcttgtgttttgctaggattacaggtagatatttttttacatgacttggaaactaaacaaaatcgcctatcttgtagtttgtttacttacagcaaacattgataggatagcacagtgaaatcttgtatacctactagttaggttcaactttttgatatttatttagctatctaaagaaatgtttttatttttttcttgaataataataataataataattattattattattattattattttaaacagagtctcgctctgtcgcccaggctagagtgcagttgcacgatctccgctcactgcaagctccgcctctggggttctcgccgttctcctgcctcagcctcccaagtagctgggactacaggcgcccaccaccatgcctggctaattttttgtatttttagtagagacagggcttcaccgtgttagccaggatgatctcgatctcctgacctcgtgatccgcctgcctcggcctcccaaagtgctgggattacaggcgtgagccaccaagcccggcctgaattatttcaaagtaggttgaagacattcgatgattctttgtagcctaaatagtccaccatgtatttcctaaggataaggacattttcctacatcagttatttaatacaatgaattttagtccctttttgggacaccagccctttccctcaagagagttggaatgtacttgtacattcaagggctagtcaagggtttctcaaaaatcttttattgttaccctcatttatatttcctgatctcaagtattagtttcatttcttttgctactgagtggatttactgtctgcatctcaattctggtttggacaggttttgagggattgagttaattgaagtgttttccttacaagttgatgacttttggtaaaatttaatcacaaatagaataatcaagagtttttaaaaatatatcaatgagtagattgtctaccgagctccttaacagcctgtggaatacaggtttcccatgagtacatcttgagccagttgtcacagctctgtgttaaagaacccaactaatggttcctagtttttaagaaggttaaggactaactagtctctagaccattatgagattaagataatcctgaaataaataataccgaagaagtaactttctaagaacatacagcccagaaatgactgttagaattctcgcctcagatgctattcatagcttataagtagccttgctcttctcaccatgaggatttccataacattatttttaaagtcaggcacttctaaaacaccatgtgtgaaaacaccctaggccaatgcatgtaagaaaaatgtggaaccatatttgatcatcagacttacatcacgtggagtgggcttctctctttctctttgttatatttaaagggctctttcaagtatagtaaaaacatattgaaatatagactcaaacttctgaatagctcataattggacatttaatttctaaggactgactagggtttacgtgactttcctgatgtctcatatttattaggtagtaggatgtatattttcaggaagaaattggcttttgttacaaaatataactgtctgcctttgggggattgtttaatcaaatcaggcattttggatatttgagatattccccttgctgtgggcaagtcatgtcatgcgacatacagttaatactctactaattgaagctattttttgtgctacacatacatgaaaaaaataattttagcatttggtgggttggcaatagagtgaagcatagtattatttgtccatggaagactctacacaggaagggctataagaattattacacaggagccaggtgtggtcgctcacaactgtaatcccaccactttgggaagctgaggtgggagaatcatttgggctaaggagtctgagactagtctgggcaacatactatagtgagacctcgtctctacaaaaaagaaaaaaaacctagccagatatggtgacacacacttgttgtcccagctacttgggaggcagagatggaaggatcgcttaagcccagaagttcgaggctgcagtgagttctgattgtgccactgtactccagcctgggtgacagaacaagactctgtctcttaaaaaataaaaaaatgaattcttacaaggggacatgtaatttttgatggaggaatgcttcacaaaaaaaagtagtatttgagctgaacatagaaaaagaggtttataaggccgggtgcggtggctcatgcctgtaattccagcactttgggaggctgaggcatacagatcacctcaagtcaggggttcgagaccagcctgcacaacatggtgaaaccctgtctctactaaaaatacaaaaattagctgggtgtggtggcgcatccctgtaatctcagctgtttgggaggctgaggcataagaatcacttgaacccaggaggcaaagactgcattgagccgaggtcatgccactgcattccagcctgggcaacagagtgagactctgtctcaaaaaaaagtaaaagaggtttagaatgtcagtgagcagattcaagaaagtatttgattatgtaaaacagtgtgattgaagtcacagaaacagaagtggaaagttattcagagaatgggaaataaactagattggccacaatacaaagttcaaataaggacatggaaagaatagcctacaaaggtaggttgtagctagattatagagattgtgatgccaaaggttgtgagcttggactgtgtattgctggctttatggaaccttgcagttaaatatagggaatgacgtgattagtctcacataagtattgactgggttcctgccatgtgcttcattctgttcttgacaagacagaaatctctgagactaagttctcccaagtttttggcctcaggactcctttatactcttaaaagatatccaggagaacccgaaatgctttagtttatgtggattatgtctgttgatgtttgctatacagatggttcttggctttcaatgggattacattctgataaactcattataagttgaaaatatgtcaaaaatgcatttaatacacctaacctaccaaacgtaacttagcctagtctaccttcaacatgctcagaacatctacgttagcctacagttggtcaaaatcatgtaacacaaagcttgctaacgtattgaatatctcatataatttatggaatattacatcaaaaatgaaaagcagaatgatcatgtggatattcagattatggtttcaacagaatgcatcgcttttgcaccattgtaaagctgaaacaccatgagtcaaatcactgtaagtcaggtaccatctgtaatataaatcaagactgaggaacttttgaaagaattcacgagtgcattcttttcgctgtctgaccgatcatttcattgtgcatcatgcagcctctaaagtgtcagactctaaatctatgtgagaatgagaatgaaaaggcaaataacatcttagtgttattatgaaaatagttttgaccttaagtagaggctcatgcagaagaaacacagttagttttgcttgggtccattagggaagtcttcacaaagaatgtgacattttatacaggaacaaataaggaaaaaatgaaggtaggtggcatattctggaatgaatgccaagaggtctgtggggagcaggtactctggtcaagtgcatgcaactctggagatggctgggggactgattttgaagggttgttaccttgcagacattgggaagtcatcagaaaatagaagtagcatgattcagtctgtttttgaaaataactgctggcagtttacaaatgaagtgcagaaaatggagggtggttcctgccaaatagtcgtaattcatgattattacacacttatattaaaggcagctatgtggcaaacatttaaatctcttctccaatatgcctctcccagttatttcagcctgttaggaaataattactagacctttcttcatactgtttttgctaaccatgttattactagaatgtctttggcacgggacccactagtttaagttatatgccttcttgtttaagtcgtttaatcctcttttaacgctgcagacatgggtcagattacacatttttggggaaggatttttaacctgttggtttatcaacaataacaaaatgacatgagatacatggagaggctgcagcctcctaagtgtttatgattcagaccagaatttagaccaaagagagactttttcttttttcaagagatataagagatttaaacaaatattttgtggaatagaaattgttttacatactgttccacatagcatcttgagaaatgcacaacaaactattaaattatttattttttttagagacagggtcttgctctgttgcccaggctattcttgaactcctgggctcaagtgatcctcacgcctcggcctcccaaagtgctggggttacaggtgtgagccaccacacctggccctatcattaaatccttaacagacatcaccttaaaagtccgagccaggtctgagcaacatagcgggaccccatcttaaaaaacaaaaacaaatgcctgagcattgtctctggatttttccacttatagagagtctgtctctatctgtactattatcatatagatattaatattatgtaacttcatcttggaaccatagctaattaaagaattgatttcaaatttggcttgccttaccaatacagaaagtgggtgtgtcatccttttggaatgtggacctacagatggtgtgtagtcatttcaaaagcagatatctttgcgagacaaaaaatcatattgcgtttctcccacattatacttattcagtctctgagccaactcagtcaaggtgacctaattcatatttatttacaagtaatttgtgcttaatctgtcatgggattagaaagaaattttaaaagtaacctgaagtttgggggttttgtttgtttttaataaacaaggtcttactctgtcacccagtgtggacggcagtggcacaatgataccctgctgtaccctcaaactcttaggcccaagccatcctcctgccttctcagccaggtagcctgtaatttttatttcagttttatttaacttcaattttactcattttaagaagattgaacctttatcttcatctaatgtctgctcatactcactgtggggttgcatatttgagggttggtttttttttttttttggtgggggggacagggtctcgctctgtcacccaggctaaagtgcagtggcatgaacacagctcagtgcaggcttgacctaggatcaagagaccttctgggatcaagcagtcttctttcacagcctcctttgtagctgggaccataagcatgcgccaccacgtccagctaattttttgtagagacagtgtctcactttgttatgcaggctgttctcaaactcctagtctctagtgaaccaccacacccagcctgagatattttcattgatggagttgatagaaattattgactaattgctattggaaggtgagagagtgaagaaagtcaagattgggttgactccccccaccttgccgtttcatggaataccaagaggatgatacagttaataaagatactgagaaatacagaaattaatctttcatcctcatttcctatttgcataaaaccaaccttttaaaatttttagtttttaaaaaagttattcttggctgggcacggtggctcatgctgataatcccagcacttttgaaggccgaggcgggcggatcacttgagctcaggagttcgagaccagcctggccaacctggtgaaaccctgtctctactaaaaatacaaaaattaaccaggcctggtggctgacacctgtaatcccagctactcaggaggctgaggcacgagaatcgcttgaacctgggagacaggggttgcagtgagctgggagcatgttactgcactcctgcctgggtgatagagcgagactccagctcaaacaaacaaacaaaaaaagtttttcttttgagacagtgtcttgttctgtcacctaggcgggagtgcagaggtacaatcatagcttattgcagtctcaaacacctaggcccaagtgatcctcctgcttcagcctcccaggtacctgggactacaggtgtatgccgctgtgctcagctaattttgtttttcattttaatttttttctgtgtagaggtgggcttttactgtattgaccaggctggtctcgaactcttggcctcaagctgtcttcctacccctgcctccgaaagtactgggcattacaggcatgagccactgcacccagccttaatttttatttgtttagagacaaggtctccctctgtcacccaggctggagtgcagtggtgatcatttctcattttagccttgcacttctaggctcaagcagtcccttttcctcggcctcccaagtagccaggaccaccgtatcaccatgcccagctaatttttaatttttttatagatatggaatctcgctttgttgctcaggctggtcttgaattgctggccgcattcctcccacaccagccttccagagtgctgagattataggcgtgagcttcccgtgccttgcattttggggttttttataatcccatctgcatttaatttagttttttgttccgctctcttcattattgtattatagtgtgtcttaatgcaggttatgtatttaatttgaaccaagtattagaacattaccaataatttgaatcattctgttccttccatatcttctctcactttccctttcccagcactaagcatcttgaattttgaatcattctaaatactgtgaaaataacttttatcacaaacataaatgtacttaagcactgtgtgacatgtaattttgtttttaaagtttataaaacatggtatattcagactttatttttttcttggacctctaaatgaccgtgtcagacttctgagacttgcttttttttttcttttttgttcactccatattatgtttttaagatttattcatgtggttacattatgcatgtagccatttattttcactgctgtaaaatcctcttgtgtgattctaatccagtttaattatccattctattattgaatgagcagtttgggttgtatccagtggtttctgtgttacacatgcatgtactgtcttgcatgtgcctcacagtgcacatacacaggatttcccttagatgcattgctactcaaagtgtgattggtcgaccagccgacacgccaagataaggagcttgcatcactgagcttgctgtctatatcatttgtcactttttcttcagatgaatttgtccgtgaaggaagagtagtgaacattcttgaatattgaactttgaacacttcttgctcaactccttattttgtggtggacgggttctacgagtaacaacattttaggaaattccagttatttatttgtttgcttgctttcagacagggtctcgctctgccacctaaactgaagtacagtggtgtgatcaaagctctctgcagcctcaacttcccaggctcagcagtcctactgagtagctgggactacaggcgtgcaccatcatgcatggctaattgttttttgtttgtttgtttgtttcttatagagacagagtctgacaatgttgcctagagtggtctcaaactcctggactcaggtgatcctcctgcctctgcctcccaaattgctgggattataggcatgagccaccacacgtggcctggaaatttcaggtttttttcccaaagcatatgtactattttacattccaggcagcaccacttgatccagtccttcctggtgttagactctctgctgatctaccaagcgtaaaatgacatttcattgtggtcttctattaggtttttgttgttgttgttgttgttgttgtttttgggacaaagtctcgcccttttgcccaggctggagtgcagtggcgcaatctcggctcactgcaacctctaccacccgggttcaagccattctcctgcctcagcctcctgagtagctgggattactagcatgcgccaccacatccagctaatttttgtacttttagtagagacggggtttcaccatgttggccaggctggcctcgaactccttacctcaagtgatccacctgccttggcctcccaaagtgttgggattacaggtccgagccactgcaccgggcaaaacctagtatcttttcttatatttattggtcatatgtacttctgtaaagcaactcttcctgacttgcttacttttgtatagtatttgcctttttctttatagatcttatgtactaatcttttgcaagttactacactacatgttttcttccattttgctacttctttcttcttttttttggagtcttttaatgaagaggagaagtccttgattttaatagttatatgtttcagggatggatgcgatagctcacatctgtaatcccagcactttgagaggcagaagcgattggatcgcttagggctaggagttaagaccagcctgagcattacggtgaaactaccatctctatcaaaaaataaacaaaattagccagacacagtggtacacgcctgtaatcccagctactcaagaggctgaggcgggtggatcagttgagcccaggagtttgaggctgcagtgagctatgtctcgccactgcacttcaacctgcattacagagaccatttctcttaaaaatgtacataaaagtaatttttaaaaagtgatgtttatcatttttatcctaaatgctttttgtgtcttgtttaagataacattcaagttttattttttcacgtgtctttatctagattttttttgttagcatatcaaaatgtagcagttggttttatatggtagttttatagctcactaccttcctaaaccctatcattatttctaataaattttctgcagatctttgtatgtagacagttttagtctgtgcacattttaactattttcttttcagctttccttttattccttcttttttcctttgaaacagggtatcactctgtcatccaggctggagtgcagtggcaaggtctcagctcacttcagtcttgacctcccaggctcaggcgatcctgctccctcagcctcctgagtagttgagaccaggtgctcatcaccatgcctggctcgtttttgtatagtttgtggacacggggtttcacagtgttgcccaggctggtctcaaactccttgactcaagtgattcacccatcttggcctcccaaagtgctgggattacaggcatgagccaccacggccagcctaatttctttttcttaattgactgtgttggctttggcctgtatgacaatattgaagggaaatagtaatatttgtattcttgtcttgctcttaattttatatagagaatactgttggcatctttcagcaaagaatgttatttgttgtaggatttttgagaacagccttctggagatcaggaaccttccatgtagccttgattttccaggagcttataatggacagtactgagttttgtcagatacttttcaatgcatttaattaaataggtttgtagagtactaatattaagtcatccttgatattactctgtctagtatagattttcttgttaaacatattgctctattctttttttttagtataatttgcttagtttttcgtttgtgattacaaatgagatttagcctagtgtcgtctaatatttcttatccgttgtccctgtttgatttgtgaatcaaagttatactggtatcatagactgaggtaggggaattccctctttttctattctctaggaaatattatgtaagattgtaataatcttttccctaagagtttggtagaattccccagtgtaaaacatctggacctgtgtatttttaagttttatagttgtttcagtttttctgactaatgtaaagacaattcaggacttctttttcttctggaatcagtttgataaaaataaatttttagtaattttcccatttgatctaatttttaaattttacttggaataaagtttttcagaatatattatcacttcctttttgaccttgttctgtcatgagctttctttcatccattcctcatatagtttgtttatgtcatctctctcttttcttcatcagttatatttatcatttttattcatcatttgaaagaaccaacgtttgggaatattaattctcttgtatatttttctaaatctctagtgtattttttttctattttctttttttccatccctactttctatattgttttcttttttcactatctcataaaggacatggagctcatatactttgagcctttatttcttttctgatttaagcctaaggctttacgttctctgtaattactacttttacttcccacaattaagtttccatgcatagagaagtttatttttatattttaaacatctaatttcattgcattgtggttggagaaattgatctgtatggtagtggttatttgaaatttgttgaggactcactttgtgacctaatttgtgatcactatttttaaaatgttgtgtgagcttgaaattaatgtgtattatcacctaattgatggatgtagaattcagcatgtgtacatttgtaccatctttctgtgttcatatctgctctatatcttattgagaggtgtattcaaatcctttatgatgatgtttgtctttgtttcttccctgccactctcagtttttgcttatacggttggttggttggttggttggttggttggttggttggttggttttgagatgtagtctcactctgtctcccaggccggagtgcagtggtgcaatctcggctcactgcaacctccgcctccttggttcaagtgattctcctgcctcagactcctgagtaactagggctataggtgcacaccaccgcacctggctaatttttttgtatttttagtagaaacagggtttcaccaagttggccaggctggtctcgaactcctgaccttgtgatgcagccgcctcggcctcccaaagtgctgggattacaggcatgagcggccatgcctggctgcttacacagtttgacattagtttattaggttcctaaaagtgtagaaaattaataattttctcatatttgaaataataattttctcatgtaatttattgatatgtgcttctgttatactgtgctggtttgtgtcctgtctagccaaaatgatatcctcttgagatttcagtgaatatctgggtcatagtgtttccccagtacctgagtcaaaatacatacttgtcaggcatctgttaaataataatgaattatttttattttgcctttatattttaatacatacagaaaatcgaaaatcctaagcagacagcctagttcatttctacaaattccagacctagaaacagagcgttaccagcaccctaggacctcccctttcccaattgaatctgctttctgtataattcaccccttccccctgttaaccactgttctgagtgctgacaccatagattacttttcacctgtttttgaactttatcatacagtgtgtgttgttttgtgcctgacttcttttttcaactgtatggctatgatattcgttatgtattactgtatatatttgtatttcagacactctcacagctgtataataatagcttttacctttttccacattggagtacttgttcttattcttttacttgtagaaggagctgaagaggaaaaaatggaagccgaccctgatggtcagcagcctgaaaaggtaaagtctcacagcagtaaaaccacagatagcatgcctttcagaccataatggtttgttttttgggtgtttttgagtccctcttaggggactctaaataattctatcagctacttggactttgctggtttaaggtatagttctcacaggatataatataggacatttttcatttgttcactggggaggtgtattcactccctatcctcttcttttatattttaaacatctaatttcattgcattagaagaagaaggaatatgaatttcccacaaaagaagagggaatatgaatacacaagttgggactatgaatacaaaagttatggttcttggctgggcgcggtggctcacgccgtaattccagcactttgggaggctgtggtgggcggattacaaggccaagagatcgagaccgtcctggctaacatggtgaaaccccatctctactaaaaatacaaaaaaattagccaggcgtggtggtgggtgcctgtagtcccagctactcaggaggctgaggcaggagaatggcgtgaacccgggagagacagagcttgcagtgagccgagatcgcgccactgcactccatcctgggcgacagagcgagactctgtctcaacaacaacaacaaaagttgtggttcttgtgaatatcgaattttaaggtttgagtcctattcttgtgccaggagagaatgacagaatagtaagtgatttcctatgagggctaactgcctgcagaagaatcttaagaaaagaatgagaagatgacatatgaggtaggttttaaagagtaggtagaactataaagattgaaatagaggttagaaaatcaaagattcccactagttggagaggagagacactaaagccagtgtgtgaagagcttcaaagtagccagtgtgttagtggctcaatctctcttctgtaggagactgtaaatgcatgatgggtgaggcagaacaggaggttacaaaggtcaggatgtgggcctttgtattccttttttttttttgagacagagtctcactctgtcgcacaggctggaatgcagcaacgcaatcttggctcactgcaacctccgttttctgagttcaagcaattctcctgcctcagcctcccaagtagctgggattacagccacgcgccaccacatccagctaatttttgtatttttagtagagacgtggtttcactatgttggccaggctggtctggaactcctgacctcaggtgatccacccaccttggcttcccaaagtgttgggattacaggtatgagccaccacgcccagcctctgggcctttgtgttcctaatactgttactgcacatagggatcagtcagtcactatttgagtgaatatatataagccaagattgaaggtcttgattatatgtggtattctaaaattgtatatagttaaggggagggtgagggtaataatgaaattgattatagttcctgcattattctaaagacgatatttgtacttcacatttttaatttcatttaattcctaaaagagtctcagctgggtgtggtgtgtcatacttgtagtcccagctacttggaaggttgtaggatcacttgggaggctggaggatcacttgatactaggactttgaaaccaccctaggcaacatagggggaccctgcctctaagcaaacaatatagcctcatgaagtcagtgatagtcagttgcggttttttcagtttctaaagcatgatcactgatgttctctcatggttcttcctgaaattattagcagatggctgtattaaaagactttgtcaacttttccagcagcatttcaacttgcttctttgttgatggtgtgacatttaaatgctcttaattctttaaatcaatcagtaattattaagtacacacacacacacacacacacacacacacacacacacacacacacacatatatatattttgttgtggttgttgttgtttttgagatggagtctcactcttgctgcctaggctagagtgcaatggtgtgatcttgggtcactgcaatctctgcctcccgggtgttcaagggattctcctgcctcagtctcctgagtacctgggattataggttcccatcaccatgcccggctaatttcttttttgtatttttagtagagacaggatttcactgtgttggccagctgatctcaaactgctgacttcaggtgatctgcctgcctcagcctcccagactgctgggattacaggcgtgagctactgcacccggcccggcctgtttttaatcaacaaaaatatcagttaattcccttcacattcctctgggcatggtaacccttgctttatagcagagtatgcagagagggcagcgactctgtgctttggaggaacatcttgtgagcactcaagtgttgaagtggtagaaagtattgcttggaatgtattagttcttttcgagctgttctctacaagtcacttttgaatctagtctatttcttgccaaaaatattggaaccttttgctagtctaagataattactcataaaaaggtctggggtttttttgttcactgcctgtcctcttgttttatatccctttcaggcagaaaataaagtggaaaatgaaacggatgaaggtgataaagcacaagatggagaaaatgaaaaaaatagtgaaaaggaacaggatagtgaagtgagtgaggataccaaatcaggtaatttgaggaaactccttagatattattatgtaaaactgtaaaaggcactggagaaatgaaggtggtttatatagaaatatttcctcatttattttgggtttgtttcttaatgtaacaataagtatgtaattgagtttcattcagataggtgctaatactaatgctggtggctacacttttttctgtgcttttaatatgtagaagaaaaagttattcaacagtattgaagtcacctcacagacttcccatttcattttctgtgtcagttgctgatacaccccatcatgcctgtcaggcttagagaagtagtctgttctcagcttctgatttcctacagacactagagttcctagagcatttcattgattgatgagcaagtacgttggccttagacttagttcccctgtatgttcctttaaatatatatatccaagggacctccacatagaacttagcaaaatgataggaaaacaagtgtgctgtttagaaaatatgtccccaatagaggcaaacctaaatgcatggaatggctcaacagaactcttaaaaagaagaaaaaggcattgacatctctttgtcatatcagtcctagtttgttatagtggtggaggtaaggagaaagatgggttttcgagagtgggcacgctagtaacaaagctttctgatattttcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaaggtttgcccctgacagcccttttccagtgctctcttaaggcatgaatggtcgtattgtttttagttaattgggaacatttagtataaagagctttgctcccaataggagatgactgcttgaatggcatttctaggttaagaaatccacaggcaggaggagggttatagaaatagtagatccagtctaaagggtgacttttttcattccattcattataccatttagccttgtaaagactgcagagattgaaggcaaattttaaagtctctttaaggaactgattatcattttgtttttaatttgcctgcagaacttatcttggactattgttccaataatttctaccagattgaaatatttatgatttttaagacaaaaacctgtttccttgcctaaatacttcaccctgatcttacagactgaaaggagagagagaccctaaaatagctctttttcttcttgaatttgccagcttttctgggggtggttttttctatttatagtattagctgcagagcatatttaagaagacatgagaatgttactttcctctctgtgttaatttagcattttaagtaattctaaacatgaatatgtaagtttttaaaaatcttttcccctgttcttcattctacttcagaagtagtttccttccattataggataccacatttcaagaaacagtgattactagaacattgctaatcattttattttgaactgtttttgatcttttaataaagatgctttttcatgatctttaattccccagatcattcagctactgtgaactacttctctaagtgtttaatctgatatgatgaaccaattcaaactacaagattactgttttgaatgcccacccatctgacatagatagagacaatggaggttagggaggtgtttacaggccgcagcaaatgctcagtcaacccagagagttactccggctgatcattgttattatactaactcgaaatcctacaaatttatactacctgcccttttcctaataactaaaactaggtaatacttcctaataactaaaattagctaaagaatcagaaagatatctcctgtctgattctttagctaattttagttattctatctcccctacatccccctctgggaagttttgaggtacatgcttgcttaagtgacggctaatataacttgactctttttcaccatttgtccggttttgctctttcattgcaaacatcttttttagtctgtcttctgctaccctggagtgtttgtgcatctctttgtctctgagctgctcaagttcttactgtaatactgtcattaggtgttttagagatctgaaggattatcgtggtcatagtctctcacattttatatatatgtgtgtgtgtgtgtgtgtgtgtgtgtgtgtgtgtgtgtatatatatatatatatttttttttttttttttttttttgagacagtctcactctgtcccccaggctgtagtgcagtggtgtgatcttggctcactgcaacctccgcctcctgggttccagcgattctcctgtctcagcctcccaagtagctgggattagaggcgtccatcactatacccggctaacttttgtatttttagtagagacagggttttgccatattgatcaggctggtcttgaactcctgacctcaggtgattcacctgcctcagcctcccaaagtgctgatattacaggcatgagacaccatgcccggcctctcgcattataaatgaggagctagaggtggagagggctttctcctttgtgcccttcctcagtcttcaaacctgcaacctcggctcatttttgactcctggttccatcattttccatagctattcagccaggaaattcttcatggtgctttagatcacctgctaatgttcaactgctcactcaggtcagcatcccttaatcttttgcctgtctcctcagtcccattctctaacccgcagccaatgtaatcttcttgctttttaacttgttcttaagtataactcacattcaaataaatggacatactgaagcctacacctttgtgaatttttgacaaactgggcccacctatgtcacaagcatccgtttcaataaacaacattaccagcccctccagaagcttcctcttattccagttactttgccttccctggagagtaatcactagtctgtctcattacaccgtagattagtttctccttttttttttttttaacttcatataaatggaatcctacattatgtgcagaaatctttaaaaatgcaaataggaacatgttactttcttcagtaacctccctatctctctctggctgcaatttcaaactctttagtagagaatttaggatttttctataatcaggaccctacttagttctcaacccttatttcttacctgtccttcctgaactgtttcttgtagttctgccaaacagaattgattcttttatctctatctaagctttttcggacattcttttcttacagagcatggttttttcttcctattatttctcctctttaaatttttttgtagagactgggttttgccatgttacccaggctggtctggagctcttgggctcaagagatttgcccaccttgacctctcaatgtgtcaggattacaggtgtgagccacctcacctggccagtttctcctcttgataccactgtgctatgcttcagtgtatattgccataggaagaactaaaatggtagattaccttttaaaagtttcatgaggctgggtgcagtggctcacacctgtaattgcagcactttaggaggccaaggcaggaggatcacatttgctcaggagttcaggaccagcctgggcagcatagtgagactctgtctctacaaaaaaaaaattttttttttaagtttcacaaatccttcatgatgttttcctctggcctcatagctgttactgtgtgcaactttgggcacaaagatttgcctggtatacactactgattatcttaaaatagcttgactccttcactgcagagaaactacttttatggatcatttggcctgccccttcactattccatacaaaatttaaaaggtgtccaaagaagaatttctctccaggtcattgaactttcactccctcgtcatcagtcactcttccttctatttactaggagctcgtatcttcattctcaaaacacctaggtttccctctgagttatgaaagtgtacaaatgctcatgctgcacgacttggcacatgtgaacccttcagtgccacttacagctgggatctgataaatttgatagcacacatgatcattttcatactacatggtaattaggggggtaaggaattcacttaaattactataattaatatataacttatgtagccagtccaagtttctcttattctcattttcttctgtgtctataaacagctttgttattaaaagttttccttaagaatcttttgtcatactgacgtggagtgataattagaggttctaggtctatctcctaaacagatgaggtggcatgctttatggcttctgttattgtcccctgaaaggtttttcaagagcatgtccattttttcattgcacctgctgacaagctgtgaattgtctcaactaaaggagtggtgtgtgggtgtaagcagaagtaccattgtttgggtgctctggatcctttctatctgggtctttaggcttagaggagaaggaaggcccagaactattgccaggataaactataaatcccccatattagagcatgttctctttttgtcagcagtagtaggttcagttcttccaagaaagcagagatcacattttcttaaaaccacagatatttcctttgaatttattctacaaaccacctcatatatacgttttccaaaatggcaaaagtaggtttgtattcgtggcaacatggtaattgggtattagctctgggacaacgggaagactcttaccccctagaaatgtctcataacttgatgcattgtttctgcaatttctcattcttttccttctctctctccttctctctttctctttcattcattcttgcttttttctctttctctctccttctctctctttttctttctctcactctcttgcttgcttgctttgtcagggtcttgctctgttgcccaggctagaatgcagtgatgtgatcacagctcactgtagcctccatgtcctgggctcaaatgagatcctttcacctcagcctctcaagtagctggttccacagacatgtgtcaccacactcagctaattttaaaattttttgtagagacggggtctccctatattgcccaggctggtctcaaactcctggtgccaaggaatctgcccacctcagtctcccaatgtcctgggattaccggtgtcagccactgcttccagcatgaaactctttctggaggtgtgaaaaatgtcattgtatactttagtcacaaggtattaacggacaggggttgattgaaattgatttacactaagcaagttgatcgttgttaccataccttaataatcctctcaatgtgtcaggaaaaaatagcccatttgattattttgcctacagttagtcctgttcagtttcatttttgtatgactacatagaaactacttctgttctactcgttggaattcatgctttgtaatgcaaaattggcctcaaccctatgccagctggattattgcttcttgttaatcatttatctccagttgtttctcctatgttccatatatcaggggtccccaaccccactggcctgttaggagctaggccacacaacagtaggtgagtgacagggcaagtgatagcaagcattactgcctgagttttgcctcctttcagatcagtggtggaattagattctcataggagtgcaaacccttttgtgaactgtgcatgcgagggatctaggttgtgtgcttcatttgagaatctaatgtctgatgatctgaagtgtaacagtttcatcctgaaaccaccccccaccccccacccccaccctgccccaggccccgtggaaaaaattgtctttcatcctcttccgtgaaactggtgcctgctgccaaaaaggctggggactgctgccgtatatcttctgtggcaccatcccagacctcatcattcttctcaggctctataaagccaatatgtgaaaggttgggcctctccctgtagcttctgcttggaacaccctggtcaccactgttgccagacctttcaagaatctgtaatctgagcatcagcaatattcctgttacagttatttattgctatgtaacgatgtaactacccttgaagttagtcgtttaaaacctcagtcattttattatctgtcatgatattgcagtgaggaacttgggcaggtttagctggtaaaatgtgctccatgtcgcattgactagagtcactcagtactacctcatcgctgggctattatagagggccagagacaacttcatttatatgcctatgcctcggctgagatggctaccatcattctctatacatcctttctaagaagctggtataaggtagtctcaggagtagttggactttttacaaagcttagaactttgagagaagaatgtcacaagtagcaaggaggaggatctgccagtgtcttatgacttggaaccccaaactgacacagcataatttctgccctactctactggtcaaatgttctgtccaaattcaaggtaaggggacacagagcacagctcaaggtagaagatgtgccaccttaaccctccacagtctactctcttgtcataaattgtatacctttcccccactgaaaaatagatctctcatggctttatctcattatgatatcaagctgaggttggaggtctcggatcttatgtaaatcaggtccacatacagatgaggctctttaggagtggttcctatttacaacttcttgaatgctgatactataatttgaagattttctggactagtatagtaggggtgagacacatcaaggttaactgcactctgttcaaggagggtttgaattggagacacagagcagtcatcgttgatggcaaatttgaaatctagccaggcacacatttccagttccttcatcagggcccagtcctactcgcagaattgttctccacagtttgacttggccctctgggctttcagttttttcttctgagtctttttccttttccattaaaaaattagcagagttttgcagtgattggctgtcttggcctgcattctacttgttgtaggcccagtttatgttctttctacttcagttcaaggtgttgtaattttttgagaactttgtgggatttctgtgtttaaaatgtaatccccactttgggaggccgaggtgggcggatcatttgagggaggtcaggagttcaagaccagcctggccaacacggtgaaaccccatgtctactaaaaatacaaaaattaagccagtcatagtggcacgtgcctgtaggcccagttacttgggaggctgaggtacgagaatcacttgaacctgggatttcagtgagctgagatcatgccactgcattccagcctggggacagagtgaaactctgtctcaagaaaaaaagtaattcccgttagacaaaagccacacctatgttttcttgcctacatagttccctttttgccctagtcttagttaagatgttatgagaacaaagcccccaatttttgcctagtcttagttaagatgttatgagaacaaagcccttaatttttggatccctttttgtctagttggaaggatcttagatttgtagcttcagtaatgatgatgcaaagaagctgagaggtgaacttgtagaggtgacacagaaaactagtttaaaactagggacagtggttagaaacaaatctttcagcacagtgatatgaactaagcagaaaacaaaagcaaaggcagttattcctgaaaggtcataaagagcttggttaggaaattgtgggacaagtaagtgtccaaacatggggcttcagaaaggaaagagtgttgtaggcagaataaaaataaatattggctgtgtggaaactttccgaatttgatgaaaactttaacttacagacctaagaagctcaatgaaagaaaaaatatatatatatataggagacatgctataaagatgtttagacccagcacagtggctcacaccgtaatcccagcactttgggaagctgaggcaggaggattgcttgaggccaggagttagagaccaacctgggcaacagagagagatcatgtctctacaaaaagtttttaaagttggccaggcgtggtggtgtaatgcctataatcctatctactcgggaggctgaggcaggaggatctcttgagctgaggagtttgaggttaccgtgagctgtgatctcactggtgcacttcatcctgaatgacagtgagatcctgtctcaaaaaaacatctaaaagatgcttagaggccctcatgtctagtagaaagctctaaggcatatactcaagactcttagaagtcctactataaataccattcaaaaagctttatagccgcacctcgagctctttaccctgaggtcatcctttgctggtagtgctctggattggatctttctcccaaagccatttcttagcttcagactcttgctggaaggaaccagagatgagaaataatgttttattcaaatcccactttttcatatttcctctaaattctgcctgaaaacctaatagttgcttctttacttcaatgctcttctagctgctcacaataaaatagaaaaagaatttttccatggcctggaaatgccccagccatatccacaagtttattaattaccctttctatttcctcatgactagagatgatggtgtttccaaaagttgtgctactagataataaagatctatttcttcaaccttcagtactattttcctccctgtactttattacctaatgatggttttcttaaagccctttcagcttgcacccactatgtggtcccaaagccaaagagaaacattttaggtttctgttacaaaagctccccatttccagataccaaattattttacaatagcaaaattgagtagtttaaaacataacaattttattaaatctcataattttgttaaattttaacaccaaacagctgggcaattctgctacatgtatcaattgagtcatttagtagtattaacttcataggtaggtttatgtagaaggtctgagacggcttcattagaatcctagtccttgacaggggtaactgaggtttttttccactccatgtagtctcagaatttccccttgtggtctttccagcagggtgatcatactttgtacatggcaacttgagactcccagagagaacattccaagaaacaggacatgaaagtttgcaggattgtaaggcctgggcttagaaaaggctaccactaatttttattgggcaaggcagagagcctgtcttgatctgcctcttaatgaaataaaggccagtgaacttgtggctatctttaatctaccacaagtcccttctaagaattacccaggaaagtatccactcaagtatcaattattccaaagatgcattggaaaataactaatgggcctttgggtttggaattttaatttttagttccagctctgccatttactcgtctcttttttctttttcctttttttttctttctttctttcttttttttttttttttaaagacagggtctcaccaggcacggtggctcacacctgtaatcccatcactttgggaggctgagtcagacagatcacatgagatcaggatttaagaccagcctgatcaacatggtgaaaccccgtctctactaaaaatacaaaaattagccgggcttggtggcgggcgcctgtaatcccagctgttcaggagactgcagcaggagtgtcacttgaacctagaaggcggaggttacagtgagccgagatcatgctactgtactccagcctgggcgacaaagctagactctgtctcaaaaaaaaaaaggacggggcctcgctctgtcacccaggctggaaatgctgtggcaagatcacagctcactgcagcctcaaactcccagactcacgtgatccttcctcctcagcctcctgagtagctgggactataggaatgtgctaccatgcctggctaatttttaaatttttttgtagaacggggtctcattatgttgccctggtctcaaactcctggcctcaggcgattcttctgcctcagccttccaaaacactgggattacagatggtaggcaactgcgcctggcctcttttcagtggacttcttggtggtacaaatgtttttaatttgatgaggtccaacctaattttctcttttatcatttgtgctttttacatgtcttgaaatctttggcttaagctaagatcatttagatatactttgttttttcttctaagaattttttagtgtatacttttatatttagatctatgatccactaagttaatttttctgggtggtatgagataggagtccaaattcattcttttgtatttggatattcagttttcccagctccatttgttgacctaccccaacccacctttaaacttttattatggaagtattagaatatatatagaagtaggctgggcacggtggctcatgccggtaatcccagcacttggggaggccaagacaggcagatcatttgagctcaggagtttgagactagactgggcaacctggcaaaaccctgtttctaccaaaaatacaaaagttaactgggtgtggtggtgtgtgcctgtagtcccagctacttgggaggctggtctttctttttttcctttctttttttaaaattgtaaaaataaaataaagaaaaataaagaagggattttgccatgttggccaagctggtatcaaactcctggcctcaagtgatccacccacctcggcttcctgaagtgctgggattacaggcatgagccacagcgccggcccagactctgtctttaaaaaaaaaaaaaaaaattccaacatatacagaagtagacaaagtagtaaaatagtctctgcatgcacattatctagctttggttatcaatttttaccagtcttgtttcatttgtctcaatttattttattttttgagaaagcatcttgctctgtcgcctaggctggagtgctgtggcgcaatcttggctcaccacagcctctgcctcctgagtagctgggatcacaggcatgtgccaccacatccagctttttttttttttttttttttaatttttagtacagacagggttttactatgttggccaggctggttttgaactcctggccttctgtaatccactcgccttcccaaagtgctgggattataggcgtaggcatgagcttctgtgcccagcctcaatttatttttgaatcatcgcttgccctataaactcagagtttctttcttaggtttggtctgtgacttttgaatctaaggtctttatctttttctggtattacattacttgagctagaacacatacctcagtagcacatgtaggaagtgagctttttagtccttgatttcaggaatgtctgttctctattcacactgttacagattgctatataggaaattctagtttgaaattcattagccctcagagttgaaaggcattttgccattgttttcaaacatctcattttacttttaagaagtctgatgcagtccaattttttgggtaacctgtttttttgggagggtgcctttctgaaagcttgtaggattttctatgtcttgtgttcttaaaatttcagtaatgtttcttgctgtggatctttttaatttttttgatacctgctgcctcttttattttattttttattttttttgagatggattcttgttctgtcactaggctggagtacagtggagggatctcggctcactgcaacctctgcctcctggctttaagcgattcttatgcctcagcctcccgagtagctgggattacagacatgcaccaccacacccagctaattttttaatttttagtagagacagggtttttgctgtgttggccgggctggtctcgaactcctgatctcatgtgatctgcccacctaggcctcccaaaagtgctgagattacaggcgtgagccaccacggctgaccaatgacctgcagttttaaaaggaaatattttggtattattttattgaataacacttaaggaccccctttccacctaccgctccccccaccaagttcctgcataaatctcaaaaaaaaaaaaataccagaaacattttctttcaaaccagctgagttctaggagtcatattctcataaaaatagaccagaaattgataacattattatcttcaaaggaagagttactgatgtatagctgacagaagtgagggggagacttactttttattttatacctctttgtaacttttcagtttatatcgtgcgcataaatttttttgttcaaaaatataaattgtataacattgtacaatgataatgccttaaattacataatatttatttaaagttttggtgtcattgatgtagctcattgtagtttagggtggcagacatgatcattaatagctataaaacctcattgtcacctcttgtctacatttctgaatctttttgcaaatgggtctccatatttgtaaaactacagtttttgttttcaactgtaaatgaatgaaaaattaggctttcgtctaagtgttaggtctcagcatagttcccaaaagcctgtattaagttgcatggttgctcctaggttctctgggaaacctaagatcattaagagatcagtaaaatagccactccatgctatttcttaagaccttggtaagatgcgtgctgtgacacacacagctgtggcttgtcacagctactcagttggcttaggcagaaggatcacttgagcccaggagttggaggccagcctgggcaacataggttttttttttttttttatgaagaaccctgcttctttaaaaaaaaaaaaaaaaaaaaaagccttgtgtagaagcaagataaacacataaattcagcagacataataaaagtgaatgaaaaatggtgctgggagtttgctgggaaagttcttggatgacgtctatagagggtgggattgattactagctagtagttagggtcttaagcagatataagtaatgtggcatcttcctgtttgtgctgttgagttggcaggaagcattcaccatcagtcttgtggcaaaggagtgagtcttccagagtacctttctgtttagtactgtatttatttttccagctatggacttggacctggaattacagatcaaatattgttttcccctttgtttccacacatgaggtctgctcaccaaagagaagggagaggctttgtataagagtgtcaggtgctgtcctcagcagcctgcctgcctgcccacccctagaaaagttttagggaggaaaggatagtgaggggacagaccgagtgccaggatggggtggtaggtggcaaagtacctcctgtcctcatctttggcccatcagggtcctggtttgccctctccttcttgatagcccttttgaaggtagtagtttaccacatgaggcatttcctttaatcttttaagggttgatttatctctataaggaccagaaattcagagacagttattttagattgtacgttacaaaggagacatatagggtaccattgtaaattatataatctctactttgaatattgtcagcattttcttaatgttctttaagcaaatgtttacctaaatagcttgaatgatcttgtacccttagcacctggctgcagtggaagaaagaaagatcaagtccctggtagctctcttggttgagacacaaatgaagaaactagagatcaaacttcgacattttgaagagctggaaactatcatggacagagagaaagaagctgtaagtatttggaattttttagtggctttttcacaattaaaccttggtcacttttcacaaaacaagttagataaaataaatggtagcctgttctcttggtctccatggctaacttctgtccttttttctgtgtttgatttgccctttcaaaaggattgttagccagtgatgttaaataaaaggcactctgttaactctctaaagtgaattatctaaatctcagcttcttgtgcgtgttggctgtgaagatacatgatgatattaaattcttcactctacaaaacttagatcttagagttatttcattacctacttgttaccaataaagtagaaactgtataactctattatctgagtcagggattttctttcttttttttttttttttaaagttttaatttttattttagattcagaggtacttgtgcaggtttgttacatggatatattgtatgatgcttaggtttaagcttctattgaagctgtcacccaaatagttaacatagtaccaatatgtagcttttcagtctttcacccttttctcctcttccccttttggagtcaccagtgtctattgtttccatgtttatgtctgtgtatacacagtgtttagctcccacttaaaactgagaacatgtggcattttttgcttccgggttaattcacttagaataatggcctccagctgcatctatggtggtgcaagggacataatttcattcttttttttattgctgtgtagtatttcatagtatatatgtaccacattttctttatccagtccactattgatgggcacctagtttgatttcatgtcttcgctattgcgaatggagctgcaataaacatgcatgtgcaggtgcatttttggtagaacgatttcttttcttttttttttttttttttttgagacggagtctcgccctgttgccaggctggagtgcagtggcacagtctcagctcactgcaacctctgcctcctaggttcaagcgatgcccctgcctcagcctcccaagtagctgggactacaggcgcacgccaccacgcccagctaatttttgtgtttttagtagagacggggtttcaccatgttggccaggatggtccctatctcttgacctcatgatctgcccacctcagcctcctgaagggctgggattacaggcgtgagccaccatgcccggccgaacaatttattttcttttgggtatatacccagtaatgggattactgggttgaatattagttatatttttgtttctttgagaaacctccaaactgcttttcacaggggctgaactaatgtacagtcttatcagcagttatataagtgttcagagattttcttgattccctgacttcttcaaaataaatactagaaaggagaacttaatctcatcttgagttaggaacctagttttctgttatcctccctcagatccatccttgggctttctcacacttctcttccctctcctatactgaatggtagctggaagtaggcccatcctgagtcttgtacgtagcattccctggagcagaaacttttgacataaggtcatgggccaaacgggaccaagagaattatgaaaagggccaaaagtgagagtggaagtcataaaaagtaagaaatttagaagcagagaaacatttggttatcttgggagaagttctggagaaaaagagattaagtaagctcttagtggaaaaaaaacaaaaacaaatttttttttttttttcctgaaaacggagtcttactctgtcacccaggctggagtgcagtggcatgatctcggctcaccacaacctccacctcccaggttcaagccattctcctgcctcagtctcccgagtagctgggattacaggcgtgcgccaccacgcccagctaattttttgtttttttgtagagacagggtttcactgtgttgcctgggctggtctcgaactcctgagttcaggcagtctgcctgcctcagcctcccaaagtggtaggattacaggcgtgagccaccgcacctggccaaaaataaatttttgtaatgagttgactagataaagaattagtgactccctaagcatgggctaaatttgagcatttagttaggactttttacctctgacgattttgacttttttatctacatgagagattctgactccaaatggtagaactttaaaaagaaattattccagaatactgatcattttaggatttacatttgcctaagtatcttcttgcattatttaaagtgtttcttagtggccagtccaagcaagtcctctgttgaactcctcatgatgagtagcccagtacctgtcaccatagcccatatccattttgtcctaagaccagctggccccaaaagtaggaagaggctgcttcagtagctctcctaccccaactctataccaccccaccctcagttccctgattaggaagcagcctagtcagggacttactgtgcttctcactccatgctgtacatctgtcattgagcttatgtctctgtaagcatctctcacaccattgattgtctcctgccccgggagctcatgagacctgggtttcatctctgtcaccctctgtgtatgctggaccaaatgcaggcttcttcacagccttactctctttgccacctgtttgcatcctgcttctctggccaagaaggccctttgccccactttttgcctacctcctgcagtcctcagctgtgggtggcatggccttcacatttactgcagtggcagcctcacagagcgcttaattgcactgtaatcaccagttcatgggttcgcatttctgtaccagagtatatactttttgagggcagggacttaatcagatgtctttgttaacacagaagtagcacatcacaggcccttacttaaatgagtgcgtgccagcattgttgccgtagttgggaaagtggaaaggataatccaccctttgagacttagtttaatgggggaaacagtcaacaaataacgacaatacagtatgtttgtatagtacagcagttgtacagatgctgctatgggaacagaaaggaggagttcccaggagatggggagagggagaagttatcagagaaaacgtcctacaggcggagctttaggggatgagtctttgtgtttatttttccctaataagcttcccttttgacattttacagattttcttagagggcctggagtaatagggggctataatatagtggagtggattgttggcatatgcgggattcaaatgatggttgggtagatcccactggcagtaagacatcttgctgtcatttgcaaagcataactgatccattagccttgaatattgagtcaaccctgagcgcttacagaatatatctagtttggcaaggagctctttcctcagcactaaattgctttctcttcaaagaatgaacctgcaggtcccccggttttttaaaccttctgatggatctgttgtctgtcccctaagaatagcagagttcgcatcccctttccacttctgtctactggcccccagacaccaaggggcagtgtataaccgctcctcttctctcagccctgcagaagtttccttgtgtgatgtctattttttaaataactacttaaattatataacttcactattttttctcttttgacttttttctgggaggacagggctcactctgttgcccaggctggagtgcagtggtgcagtcatagctcactgcagccacaaactcctggggctcaagtgatcctccctcctcagcctccccaagcagctgagactacaggcatgaggcactgtgcccagctaattttttttttttttttaaatattgacaagatcttgccatgttgcccaggctggtctcaaactccttgcctcaagcagtcctcctaccttctcctcccaaggggtttggattacaggcatgagctgctgtgtccagctttttgacttttaaaaaatgttactttctaatcagatcacacacaatatttcataaatattttctgaataaaacaacacagctgaaaatgttgggaaaatactctccggactccatcccaatacacaacgctgctctgcttgaattcttccatggtggactgttattttcttaatcagcatttggtgtcagctgtttgtggcaggaaaattctttgtatgagacagtccctacccctactgaatgaatgtcaataatccaattgtattagttataaattgccatggtttctgagtaagtgatttaaaaaagtaagagtatgaaaaagcacacaaaatgggagctataatgttctttataatgtaaacatacgagtcacatcccttctgccacatcctgttggtcacagaccaactttggatctgggttaggtgaatagttttcagtgggaatgtataaatattagaaagcaggatcgttggcaaccagcttggagacctgttctcttaccaaccaaaatgtgtcatttgaacttcaaaatgccacccgctcattttgtgtataattaagacataacctctttctcactctagcactagcatcctatccttccctgtgggaagcaaagctatgaatgtttttctactgatgatttccacacagaattcttgtgaaaattgagagaagtatggcatatgcctggcacagtgtctagcacatacatagtaagtgtttggtaaatatatgcctcccgttatgcaaaccagtaatcaacaaatatgtacaaaattcttaagattcataagccattgttggctttgtgagcatttattgggtcagttactatgccaaagcactttaaatggatttactcactttatttcctggcaaactatgtgaggaagccataagcaagaaagtaatgtttgctttgaatccccttattcaagaatccagcagtgatgttggatgacagcataagccacttctttgttagcccttcttacattccagactggagcttgaacctggtaggttgtgtacctcagatcacatgggtcagaaatgacagagccagatctcaaacctgtttgttcagctctttgtatttatctagtacttcgtaatttataaagaaatgagcttttgctatttcattttaacctagggactcagatatatatgcagcttctgtcatcctattatgaatcaataaagttgatactccagatagtgaatagatcagctaggagtagaggcacccaactctccacctcccccactgcctcagttcattttagattgcactcttgctcatcttaacctagtaagcagtagctttaggataacatttttttaaatagaacgtttggtttggtttaaatagcaataggtttcagaaattaagactcaaaatcaaatataaagctttttttttccctctaatgacttaaagccagatgttctttttagtcttaagtaattgtaattaaatgtaatcatataaaaatttcagggccaggcatggtggctcatacctgtaatcccagcactttgggaggccaaggcgggaggatcacctgaagtcaggggtttgagaccagcctggccaacatggtgaaaccccgtctctactaaaaatacaaaaattagctgggcgtgatggtgggcgcctgtaatcccagctacttgggaggctgaggcaggagaaccacttgaacccggtaggcagaggttgcagcgtgcagagatcatgccattgtactccagcctgggtgacaatagcgaaactctgtctcaaaaaaaaaaaatcgaatttgttatgggtatcatgaactcagctataattagtagctattccagctccctcatattttaaagcattaatattaaaggaaaggcagttatggaagttacagagtatatcagggaattgacatgagaaaagcattccagttcaggggagggtgttgagctgccagtgggtctaccactcattgtgtctgtagactgagtagcttttgatgctaggcagaagcacacagccgtcaacagagcaggtttcagacatgggttgtgttgtagactaaattacctggagagaattgaagggcctgggccccacataagccgtttacatttgaatgtttttttaaaagacactttgaggccattgagaatggatctatgagctgattccatttatagcttttggactaaatgttgtctgtctctctgaagttcatttggctaggtatagaaattttataccttcagaggctgggtgctgtggctcacgcctgtaatcccagcactttgggaggatgaggcaggtggatcacctgatgtcaggagttcgagaccagcctggccaacattgtgaaaccccgtctctactaaaaatacaaaaattaggcgggcgtggtggtgggcacctgtaattccagctattcaggaggctgaagcaggagaatcacttgaacccaggaggcagaggttgcagtgagccgtgatggcgccattgcactctaggctgggcaataagagcaaaactctgtcttaaaaaaagaaaagaaaagaaaagaaagaaattgtgtaccttcagaaaagagggactattagggaactcggaactgtgagaaacccagaccctgtacttaaggaagttaaaggatggatgagacattgactcaaagaaaccaaatactatgagatgatggggctatgaaaattcagagaaaggggaggtcatggtcagctcagattatcaaggtaagattcctggaggaggaggattgataatgatttgtaagaaaggcccagctcttgaaatatgaaaagaatgattgcttaggagactggagggtcagcctgccttgatagtttttgtggtagataaaatgatttatttgttcatttgccaaatactcactgagcatctgctgtcctccaggcatacagctactgaggatacagtggtagataaaacccaacaaagatctctgccttggtggatttcaaataattagaaaccatgagtgaattaaggaagttttataagtaataaggtattatatgctgcatatatataggtatacatacaagctttgtgtgtatgttatgggctgagtcggggggattaggagtggcagggaagggatttctgttttgagtggtgtcatcagattaggccttattgagaaacttgacagttgatgggcaagcacttctaggtgctggaaacagccagtgcagaggccctgaggcaggagtatgactgacatgttcagagacaagggagtaggtgggtgggctggagcataaatgagtcaagggagttaggagcataaagtcaaagagatcatggtgaccaaatcacagaaattcttgaaagcagtccagaggcctttttgctttactctgaaatgtgaaataattgcgggaccttgagttgaggactgaagtgatcttccttacagtttatcagggatcactctgtctactgtgttagagagagtaaattataaggcagcaaggtcagaatcagggagacttggtgtggaggctgttaggttaatgcacgtgagatatggtggcttggaccagggtgtcagccgtggaagtgaagagaaatggtgaagttctgggtggaatttcaagatagagataatgggctatcctcacaaatagtaagtttagaaaaatttgttatattttatgacaaactgaggaagaaagaacagcaaaaaagaatttcatagtgtcccagagtaattatatttaactttgttttctgtgtagttgtagtaattcatcttctgtgctgcctgtcatacaattgaatctattgttcaacatttgctattacattaaaggtagttttatttgagattagaaagccatacccagtagcaggttcagttctgaagcagaaagacttgtggcctcaagaagcaagcacactgcaacaaagataaaatgacaagtcacaataatgatgcaggctccctttttggatttctgctaccagaagtacacatggaagtagcaaaatgcaattatattgttttcttttacctcaggtataaaaagggatggatatgtctgttttggatttggggttttttcagtgaatttctcatcactgatacaaagcattgaaaaggaaggtgtgattatttactttagctctgaggcttcaagtctcagctgatatttcagtccttggcattgcagatagatttttgtggccctcactgtcttttactctttcccacccccctccctgctttatgcaaatagaagggagaagagctttgtgtgaacttcagctgcacttgcagctgtgtctgcgtttggtgtcttggtgttgaaaagtgctctgttgtgttagatttcgcttggatacggctgctttatacatacacagtgaagagggagaggaaggcagggtttttgaaagcaggggaagtgggggctcaggatgtgtcttcagagcagggccataggcagccttgtatgaaaaactgggttcgctggagcctatttttttgttattaaacatatgtgtgtgatattttaaattttcaaatcataaataaaaagttctggccaggagcagtggctcatgcctgtgcactttaggaggctgaggcgggcggatcacctgaggtcaggagttcaagaccagtctggccaacatggtgaaaccccatctctactaaaaatacaaaaattagctgggcgtggtagtgggcacctgtaatcccagctacttgggaggctgagggaggagaattgcttgaacccggaaggcgaccactgcactctagcctgggcgacagagcaagactccgtctcaaaaaaaaaaaaaaaagagaaaagttctcctacttccagtttcatttctatggatgatcactgttaatagtttgtatctttcagaacattttaaatgtgtttatacatgatcacaaagtcatttttatatacttggattatcttataaatatttttattgcaacttgttttttcccccattcaggttatcttatgtaactgaacatcaaaaagaatgccttgatgaccatccttacacatgcatacatacagtattctaggacagatttccagatgcctaatcactgggtcattggttaagtgcatttaaaatatgaccagtactggcaattttctctcagaaattcctagttaacattctttctgattgccacaaaagtgaatgcagtcttcaacttgatttaataaaaataaggtatctagaacaagaaaagttattttatttgcatgacgaggccagtacatggtggcaagctctgctgcatctgccgcagaacagagatggcccttatggagccaactggtagcctgttatttgggcattgctctcaactcataggacatgtttggccccacattggaacttttggtttaaactgggttctctttcaggtttatgtatgtgtttaatcacttatcctttctaattcttctaattactttttttaaattaccttctaagttttaaaatgacagatgaaactcagaaaataaagaggataatacaggctagctcatgttgtaggcaaggaaaattgggcaaatttttcttcccagcttggccctctcatcctcttattagtagattctttttttctttccaaggttaataccttgatactaaggtaagccctcaaagaaaggctagtttggttaaaagcagaacccaaaattcagctaggtaatgcagagaccagaatttccttttagagtcactgctccctccagtagcagttcagcttccttataaagcatatcttgacctaaattccatagttcttacataacagtaggactacagccaagctgttcagaccagtagtcactcaacaaaaacagataagaggatgttttctggccacctcttaagcaaattcagagtcctaaattcctagaaagaatgattagaagaaagcaaaaccaaggatctgtagccagaatatttagatttcccaccccaccttttacagtcattttgcctcttacttactaatctgattagtcttcctgcagaactggacttccagaagattctcttgctgtttacatattacatctcccttctcatcatgcacacaggaaactgaaccaggctaggctttaccctcttcagattacctttcccagaaaatgaagagcccacactagactattaggaccatggtagaaccctgtcttgcttgttcctggtaaccctcaacctctctcaaaatgttttgtttcagaaaatctccctctccctaaggaaagtctacaagccagttaccaaaatccaggacataagctataccgtttactctctttatttgttctcctcttagcctgctcatgcatcttttcttcatactgtgttcatggcctgtcttcccacaccccatctgtccatggaaataccccagttgctactcctataaccagtgatgcttctcactcaatttcacagggattttccccagtcggccctctgccaaaggcccagatttttaggctaattctcatgcttattccatctagtttttgcaaataatagtgtgtagtgtttatccacagaacttgctgcccccaaaagcaaaaatgttatacttccctaacctattaaatgcctcagaatagtgctattggacagaaatatgtgagccatatatataactaaaattttctagtagccaaattaaaaacaggtgaaatgatgttttacataatccagtatatgtaaaacctacatatatacattgtttctatatgtaatttatatgaacaatttttcatattaagtcttcaaattttactgtgcatcaccaacagcacatctcatttcatgttagccacacttcaagtgctcagtagctgtgtgtggcttctaactgctgtattggacaacacagcactagaaaatgattcccagtgacttagatttttctatcaaaatgatgggatggagatgttattgaaaagaagtgggtttattaaccctccttatgcttatgatttttatactactttcagagatctggattttcattttcctgcatgttcaggttgattttctttatcatccctgaattaaattaatttaggataggcttcattctctgaactaaacatataatactgtatttctctttattctcatttgggtgccagaaagattatcttgaatattgaaatgcttgtagtcgttaaactaagattcatgcaaatttttttataggcaactaaaatattccgtgaatgtgtcaccaagtataattttgggtacttgaaagctaagatttgcagtggcactgccaaagttccacatagagaaatgcatatctttgcagctaaggccacgtcaactcatgcagagtaatttaactctggtgttatgttctaaaatagacagtaaccatgagagtatcacatccaaaagagagcacataggaaggttgggtgaacttgaaatgttaacatctgaggaactattacaaggacaagagaggctcgttttacctggggaagactcagacagccatagaaagtatttttagatatctaaaggcctgccaaacatagaggggattacatgtgtccaagtgagcccaaagagcagtagccctactgcgggaagattgcaaggaaagacttagactcaacatggagaagactttgaccatggtaacagatgtccaaatggaaatatgctactcaagaaataatgcctttgttctcactgtagaaggtgcaggaagtgaggtggtgatgtcagtgtgatgggatagaggtaattcaggcattatgtagttgtcctttgtgttatccaatcctgaaagcctcttctggtgtcatttctcttccacttcctttgcttacagctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtaagaggaaggccctgctcttggaaaaagcttatggtcactacagaggcacagagcatcattggggccaaccacacagttggtgttttctgatgaagactgctcaaaattttcattgtcatctagaaaattgtaggcatgtgagatttagggttatcgccacatgaagccttccatgttctttttctcttggtatgatgcctttttgttgagtaggtcagcctctgattggacagtaatatctcagagttcattcagaatttatcttggattattgataccgtaaaaaaaattatagacattttcaaagataaatacacacaacacagcaaactcccatgacctggtttcaacaaccatcatctttctgccacttttactttttgttacggaaatcttcaaacacagataaagtagagagaatagtatgataatcccccatgtacctattggacagcttcaaaattatcaacattttagagtctgtttttatcttttcctcctcactttgggaaatgagatagacttcaaatgtatctctaaccagtgggagtcttttttttttttttgagacggagtctcgctctgtcgcccaggctggagtgcagtggcgcgatcttggctcactgcaagctccgcctcctgggttcatgccattctcctgcctcagcctcccgagtagctgggactacaggcgcccaccaccatgcctggctaatttttttgtatttttagtagagacggggtttcaccgtgttcgccaggatggtctcgatctcctgacctcgtgatccgcccacctcagcctcccaaagtgctgggattataggcgtgagccactgcgcctggccgggagtcttattctttacataactatcatcaccatcaaacaaaagtaatcataattcctaatatcatttgttaaatatcttttgagtgcttagtttgtttgaatcagtattcagttaagattcacacatttgttgacatgtctcttaaaaatctatgtaataattcaccttcccttttttgtgccatttatgtgttgaagaaaccagggtttttccacaatgtggctgtgcctgattgtacaccagaggtgcatagtgtcatgtcatatgtccttctaacccccccacacaaacacacatttcctataaaccagaggattgctcaggttcaaattcacactttttttttttttttttttttttttaaagacactgtctcgctctgttgtctaggctggagtgcagtgacatgatcatggctcactgcagcctcaacctcccaggctcaatcaatcctcccatctcagcctcctgtgtagctgtgactacaggtgcatgccaccacacctggctaatttttggttttgtttttataaagatagggtttcgccttgtagcccaggctgatcttgaacttctgggctcaagcaatccttccgcctcgaccttccaaagtgctgggattacaggcatgagctctaccacacccagacaagattcacttatgaggtcaggcattcttgtagtgtcagtttttctttttgtggtaattaagattgatcagtagttctggtgttgtcagtcggatcatccattataaaaatccccattcgactaaattgttttagaattgagcgttcagaattgcttcttaaattagctattttaggccgggcgcaatggttcatgcctgtaattccagcactttgggaggccgaggcgggcggatcacctgagtcaggagttcgagaccagcttggccaaaatggcaaaaccctgtgtctactgaaaatacaaaaattagccaggtgtaatggtgcacatctgcagtcccatctactcaggaggctgaggcatgggtattgcttgaacctaggaggcggaggttgcagtgagccaagattgtgccattgcactccagcctgggtgacagagcgagactgtgtctcagttagttaccctgaaaatcagttcttataggaaagcctggataaatgcttcatattttccctctattggttatctgtataatgagttgctgcccctcagtaaccaaaggtgaccagcaaagggtttttttgtgtatatttttaatattgtaaaattataaattttttaatattttgtgtgtttcagtctatcatagatactatttgtgtttcttgttgcttcttaaaagaggttgggtctcactgagttgcccagactggacccaaattcctgggctcaagcaatccccctgcctcagcttctgaagtagctggattataggcacgttccactgtgcctggctttttttgatgctaaaattgtcccatttgtagcttgtgagaactgtttcgagttggctattgtttactaaattttaactactttggaagttgaactcatagttccttcaagcttaactgccagcatcattaaaacctaagatgtacttttaattccagttcaccccccaaaccccacattccttctcttcttagagggcaatatatatgggtgtgtgctgtgttttatgttagtctagtgaaagtcatcttgtaagatttttatagtttgcttatccacagtaatataccaagtgcttagagccaaagtttgtgcttttggggatgggatgcaaattctctgtccaagtcacggtattatcaacacacttattcacaacccaaaatatattttaggctgtagttttagtagtttttattgactttaccgaaaaacagggctaagtttactttgggaagctttcgtttacacacactcacaggattaatttgcaatcataagaattactaccatcgtcagacttgccactctaaatgacatttgtggagatagccttagaagtttaccctgctcacaacaaggtgcattctttctcagtcttatttctgtctacttgagtggatcttaaattctttgtatggaatcagattttctccagagttaagctttcaaaagatacaaatgcttaagagttcacatctcaaagtaatttttcaagaacaatagttatttaaaaattaaattcctaggccaggcttggtggctcacaccattaatcccagcactttgcgaggccaagacttgaggatcgcttgaacccaggagtttgagaccagcctgggcaatatagagagaagctgtctctaccaaaaaaaaaaaaaaaaagtagccaggtgtggtggtactgcatacctgtagtcctagctactcaggaggctgaggctggaggatcacttgagcccaggagtttgagattgcaagtgagctgtgattgtgacactgcaccgttacactccagcctgggcaacagagtgagaccctgtctctgaaaaataaataaataaataaaaattcagtttctgaaatactgggataaacttttaagaggaagtttactgtagctacttggtatttggctcttgatggtgctaaagcatcatattcacattaactgctcacagaacatctaaggagtgctagcatctgcatttactttgtaaaagatgggcagagaggtgcgtctactttcttccctaaatgagattttgatgataatgggtgtttgtatgccatgcccctcacccacattgtttcacttatttctcattctcaccttacagttgaagaactgatgcatggcaaggccgcatagctttgctgcatggtagagccaggattcacactgagctccatctgattccaaagtgaggccagtgccacagtgctgcctcccgtgacggaagactaaggggatttatagcagattcagatacagctattctagtgaagcagttccgcaaactagagttcataaaaatagtctttggaagagaaataggtcattttaatctttttactttctcacaaaaataggcttttctaaagtgaatttgtaaaggaaagaattattgagtgcagtgcatgatgagaggttttttttttatttttagtctatgacaagatagtctcatgattttttattgaaataaaatgtacattttggataatgcacaatcataaatattcagctgagttttttttttttttacttcctttatacttgcagaattgatgagttttaacagagaatattcatgtgtaaccaacacacagaggccctcatcatactgagtcaccttcccttccaaggataacaactgtcctgacttctagcgccgtagactagttgggctggttgaatgttatctaaatgtaaccacaattacatttattatgtctggctgctttccttgttttgttttgtttgagacagacagggccttactctgtcacccaggctagagtgcagtgacattatcagggctcactgcagcctcaacctgccaggctcaagccatcctcccacctcagcctcttgagtagctgggaccacaagtgcacaccacgacaccccactgccttttaaatttttttgtagagacatgggctcactatattgcccaggctggtcttgaactcctgggcttaagtagtcctcccgcctccgcctcccaaagtgttaggattacaagcatgagccaccatgcccggccacatctggcttcttccactcaacactgtatatctgagatgtgtccacattattgtttgtggttgtacatttgttccttctgtttgctatacagtgttctgtggctgtactatttattagtctgttctgttggacatttgactgatttctggattttagttattatgaatagtttgtgctgttgtgaaatacatgagcacgtcttttgataagacatatatgtacatttctgttgtatatatccctaaggtgtagaattgagtatttatgaacctaagagtggatcataggatatgcatatgttcagattaatagatgctgccaaactttttgcaaagtggtggtgcctgtttacactctagcagtatgtgagagttccagcaattcaagataataatttttccaaattaccccttttgttgggttgctttggagtttgaatataaaatcaagtctgttaaagagtaaaattaaaagcaacagcacattaggctgggcgcggtggcttacgcctgtaatcccaacactttgggaagccaaggcaggtggaccacttgaggccaggaattcaagaccagtgcctggccaacatggcaaaagcccatctctactaaaaataggaaaattagccgggtatggtggcacacacctgtaattccagctactcaggaggccgaggcacgggaatcgcttgaacccaggaggcagaagttgcagtgagccgaggtcatgccactgcactccagcctgggcaacagagtgagagaccctatctcaaaaaaaaaaaaaaagaacaacagtaaattaaacccactattttaaagttaccagttcagaaaaagctggttctagcacgtaggtctgatagaccatattctaaaggtcagctaaaaaggactttcaaaccagggcaagtaagattgtccgtagcattttggggccagaatggctttagtctctgagttgccacagggtaaggtaagaactatgagcaggtccttccaactcatgattcctaagttccagaaaagttaacaggccacagcttacattgggagctgaagattatctgggtcagttggctgtctttggtatttggctcgactttatgatatatgatgggaataatcagcttctgaatgccagtaaggttggggaagtgctgagaggagggactaggcagatttattaccaagtggttaatttttcatctctctggcctctgtataagtatgcagataagttacatgtaattcttctctacaaaactctccatcagttagtggtagagcctgttaaagtagcagcttggtattatgaatctgctaggctcttaaacacttacggacttctaggtatgaatgtagctggtataagctggcacctgtacatattccatttagtttgtaccgatacctctgtaagttcttcagcccctctgccctgtcccctacctttgattcatcaaatgcttataatttttgtttggagactactgcgtgcatgcctctattgctcttccttggctcttattatttggtcctactcctaactcacctgataactccaacttttggtagattttgttcctgtctcttatagtgtcccaacttggtttcttcctaccaaacaaaaagacacgggaagtatctgtagtagaatgtttctggtatccagttggcaaatggaaactgaggttggccccaactgttcttagaccacctttaggttttgttgatcttaatgaaatacacagcattgcatttcattccttttcatttaaactataaaattatatcaaatgatgcctacattaagattctccctataagactgccattccagatggcaaaaggtgaatagtcataatagaaaccaattcttaagcacatgtgtggtattcccttgaccacaccctgggccatggtatctgttaatatgaaagcacatggggaaccacagaggagaatggcctaggtggtggctgctgtttgctgaggtgtgctgcttactcaagcaggagggcacctctgactgcttgggatctccttttttttttttctttttttagacagagttttgctcttgtcactcaggctggagtgcaattttgtagtcttggctcacctcaacctctacctcccaggttaaagcaattctcctgcctcagtctcccgagtagctgggattacaggcacctgccaccatgcctagctaatttttttatttttggtagagacagggtttcaccatgttggccaggctggtcttgagctcctgacctcaggtgatccacccgcctcagcctcccaaagtgctgggattacaggtgtgagccactgcacccggcgggatctcctttaagttgagatggtcaggactgtaggaacttcagcacatgtttaaaggaagattacctatcattaagttagaaggaaatgacagaaatctagtgtataattacagtggtaagctctgctctccataggcatggatgtattttagtagagacaaggtctcactatgttgcccaggttggtctcaaactcttgagctcacgcgatcctctcgccttggcctcccaaagtgctgggactataggattgagccactaggcccagcccgtcctaggcatttgtaataaatgaggcactcttgaacattcctgcctcatggatcttaagtcagctgcctgcactggggaagccttcgtgtgtactctatgtgtgaaagcagaaggaaagaacatgtttgatttaaatattttcattgtttcctcattattaatagtggaagaatttttggaagtgccttgaaaatcagaatagaattggtctgatttgatgagaactcagacataatacaatggtattctaatgttaaaactagaatgggctggaaatgatggcttacgcctgtaatcccagcactttgggaggccaaggcaggcagattgcttgagctcaggagttcgagaccaacctgggcaacatggtgaaaccctctctctacaaaaataaaaaaaatttgcttggtgtggtggcgtgtgcctgtggtcccaactacttgggaggctgaggcagaaggatcacttgatcccaggaggtcaaggctgcatttagccaagattgtgccaccgcactccagcctgggcgatagagcaagaccctgtcttttaaaaaaactggaacttttttttgagacagggttttgctgtgtcgcccagcctggagtacagtggtgcagtcatggcccactgcagcctcgaattcctgggctcaagcaatcctctcacctcagccacctgagtagctgggacttacaggcatgtgctaccacacccagctacagttggctttttaagcccctcacacctacttacacaaccctacctcatgagaaataaagctcaggaaaggattacaaccaatcaccactttctaacccacccctggactcaaccccacaccgaaaaagaaaagcaatagcctggccgggcatggtggctcatgcctgtaatcctagcactttgggaagccgaggtgggtggatcacctgaggtcaggaattcaagaccagcctgggcaacatggcaaaaccccacctctactaaaagtacaaaaattagccgggtgtggtggcaggcaactgtaatcctagctactcaggaggctgaggcaggagaatcgcttgaacccaggaggcagaggttgcagtgagccgagttcacaccactgcaccactccagcctgggcgacaagagtgagactccatctcaaaaaaaaaaaaaaagaaaaaaaaagccgtagcccatcacatcagccaagattttattatctgcggtgcctttggtcctacttacatgctactttccggagtagccatgctactttccggagtagcaggttaccctcacaaagagaacagtgagggcccagtcttcaacaaagagagtctgtcacaggcatccccaggaagctgctgtggggaaggcacagtctctgaggagcctgggcttcccctcacttggccctgattttgttatttccattctccaggagactcagccagaggatgtgctatagacagttagaaatggattgatgaaatgtgctcaagactggaaattcacaggttccctttcctagattcactttcttttcctaccctcctttcccaacccaaagtataaaattaaggtcctttactaatattccattaagtgtcatgagtgtaatgctttagtaaaagatacaataaacctgagagagaatgagggatttttctactagttaaacctaattttagcaaagcttttaatttttcaggcttcagatgcctgctgtttaaaaaaaaaaaagaaaaaagaaaagaaaaaaagcttgtatgtaggtcagactcccaccattctaagcttttgatactgctgttttgatgccatgtctctctctctctctctctctctctctctctctctctctctctctctctcattttcttcctctccctgtctgctgggaaaaaatacctgattttttttttttaatggaaaagacatacatcctttactttgtttgctaaggcctgttcctatgcatttcagatttgtgtgggccagatctcttaatgttagtaagaattaatggaaatgcagacactgttgttcatttaaaagtggtgagacctatatcagacaccacaaaaacccataaagatgtttagacttcttaaggacaagggttgctttgtgcgaaattgattttgtcttctcctgagtcttcttaaattctaccccatttcagatttcatccttggaagttaccttttctaaggggaaagttactccttagaaaggaaggtggggtaaaggaaaagagaatggacctcagggtcagagagacctggatttgaatctcagctcagtctcttgttcattgtgactttgcgccaaattacatagcttctctgaggcttagtttccttatctcaaaactaggcccttaccatcatcttactaacaacctggagacttcagagagataactgtcaaatcacctggcacggtcaacccttactcaaccttattcttacctcctttcctgtcttttctctaaacccactgccccaggtacaccagtgctgagttgcttagcatctgacagaaggaacctctgaatggcaaagggacatcattcactcttaggtacctcttgctttcctgagagatgtttgtttttgcagggtgccataagcagaagtaaattgcttttcctctagaccttcatttttgctgccaaggagccgttgtcctctcatactcagaacacctgtatcccagtggctttatgaccttgtttgtgacaataggataaagaatctttttcacaaggctttagaatttataataaatgaaaagaaaggtttttttagctgttgggctaacagccttggaaaaccctaaagctgccctattccagcttgtattcataaagatgtagggtaataggtaaatgggccactgccactgagcagatagctttggaaatagtactactgggcctaagagcaagagcctgcaggcatttcccagtgcatgataggtagacatcactttgtgggtgtttgtcaatcagccagtgatgctcctctttgccagattatttcttgaatagttgatttctctgctggaacatatattctgaattgcgggttcagaaagtaatttctgtctggagctgagcatggggcaaataatggatcaatcagtttggtgacaccagggtttgcatcacgtcgtctctgagcacctgttggacccctctcccccagaccttgattgtcaggggtgcacactggctgcaagcaccatctctagaatcagagtacctgtatcagatctgagctccctcatttacatgctttatgacattgggcaagctacttaatctttgtgtccttccctttcttccacagggataatagtgcctggtttatagtgttgttatggggattgaatgagttaacatttataaaactcttaaatatagtgcctaaggcatagcacatgtttcctacgtagtttcctgaggctgctataataacttttttgaggcagagtttgcttttgtcgctcaggctggagtgcagtggtgtgatctctgctcactctaacctctacctcccgggttcaagtgattctcttgcctcagcttcccaagtagctggtattacaggcatgtgcactcctggctaattgttgtattattagtagagacagggtttcaccatgttggctaggctggtctcaaactcctgacctcaggtgatccgccctcctcagccccccaaagtgctgggattataggtgtgagccactgcgcacagcctgtcagaataacttaaaacaagagaaatgtattcttactctctgggaaatcaggtccaatatccagcaaagccatgctccttccaaggtatatagggaagaatcctgttccttgtctcttccaacttccggtggcttgcagcattccttgtcttacggccacgtctctctttgctccatctttacatcaccttcttctctctctgtctttgtctctgtgtgtgtgtgtgtgtgtgtgtgtgtctctctctctcttttttttttttttttttttttttttgagacagagtccctctgtagcccaggctggagtgcagtggcgtgatctcagctcactgcatcctccaccttccaggttcaaactatcttctcctcagcctcccaagtagctgtgaccacaggcatataccaccacacacagctgatttttatatttttagtagagacgaggtttcactatgttggccaggctggtcttgatctgctgacctcaagtaatccacccacctcagcctcccaaagtactgggattacaggcatgagccactgcactgggccacatacatagctttaatcaataaaatctcaggaaaccaaagctcagggattgagagagagaggaggagacctgtgaagggcggcaatatgttcttcctaacttgtttaaggcctctgtccaggtcggacttggtggaagcgagcaacctgtacctgttgataaacatgggcagcattatttctcctagtatatggcttccctttgtcacaacaagtccattaggagtgttctttcgtctgcaggctagaatattgtactttttagttttaaaagtaggcctcctgtttccagcagcaacaaaatcatctcctgttgtccttcacgccacctagaataccattagagaatcattagtagtgatttagagtgtggaaaacaaagcattgcttttattaatggcctagcaggtgatgtggggtaggaagagaacaaaaaaagggcttccaaaagggagctgggacagtaccaccttaaaaacaaaggtgcctctttggcagtttgtggagaatcttagaatagtaagtctctgtttgccactgctctatttgaaactctgggagttctataccttcccttcaccgatacctctgtatttcactatatggctgcccagcctacatctgttcccaaagcaaaaagttctgtgtcctcttcacgtcatcccatcttcacactcccagcagtcagataccaaacccaaattcattttccatctcagctccatgctcgcccttccttcttgctctgtctccaatcccgaggatgcctctttttacagaacctgtggctgggcacaatagctcacacccatagtcccagcaactcaggagactgagttaggaggatcattgagcctaggagtttgaaaccagcctgggcaacatagcaaggccccatctctataaaaaattagctggcgtgggccgggcatggtggctcacgcctgtaatcccagcactttgggaggccgaggcaggcggatcatgaggtcaggaaatcgagaccatcctggctaacatggtgaaaccccatctctactaaaaatacaaaaaattagccgggcgtggtggcgggtgcctgtagtcctagctactcgggaggctgcggcaggagaatggcatgaacccgggaggcggagattgcaccactgcactccagcctgggcaacagagtgagactccgtctcaaaaaattaaaaaataaaaaataaaataaataaataaattagctgacgtggtggtgcacacctgtaatcctagctactcaggaagttgaggcgggggcatcacttcaacccaggagttcactgctttagtgagctatgaccataccactgtactccagcctgggtgacagagcaagacctcatctctctctcttttttttttttttttttgagactgagtctcgccctgtcgcccaggctagagtgcagtgacgcagtctcagctcactgcaactcctgcctcagcctccttagtagctgggattacaggtgcgtgccaccacgcctggctaatttttttattttcatcatgttggtcaggctggtctcaaatgcctgacctcgtcatctgcctgcctcggcctcccaaagtgccgggattacaggcaggagccaccgcccctagccaagacctcatctcttttaaaaaaataaaataaaaaaaaaaagaaggaacttgcagagtgccatctccatctcctattcctttctgtctcatcagcctgacattcagcccatacttctctgcaaaggcactttttctctgctctaggcactaactcctctgcatcccttcttaaagctttctatcctagctgggcatggtggcatgcacctgtaaccccagctacacaggaggctgaggcaggagaatcacgtgagcccaggaggtctagtccagcctgggcaacgtagcaagaccccatcttttttcttcttcttcttcttatttatttatttatttttttttttttgagacggagtctgactctgtcacccaggctggagtgcagtggcatgatctcggctcactgcaacctccgcctcccacgttcaagcaattccctgcctcagcctcccgagtagctaggattacaggtgcccaccatcacacccagctgatttttgtatttttagtagagatggggtttcaccatcttggccgggctggtcttgaactcctgacctcttgatccacctgccttgccctcccaaagtgctgggattataggcgtgagccaccacgcccagccaagactccatctcttaaacattttctaaaaaattgctttccatcccacagaaaattaggttcaagcttctcttcttttcagaacctttcactaagtcctctgtagccttacttttgaagtcctcaccccttgttctacatgcatgactcctttttgaattaatatagccctttttcctttgaatcatgacagacccagcagttttgttttgttttgtttttgtttttgtttttgggaaagaaaaaaaaaaaacctggccgggtttggtagctcacacctgtaatcccagcactttgggaggccaaagcaggcagatcacgaggtcaagagattgagaccttcctagccaacattgtgaaactcggtctctactaaaaataaaaaaattagctgggcgtggtggcacgtgcctgtagtttcagctattcgggaggctgaggcaggagactcacctgaaccagggaggcagaggttgcagtgagtcgagatcgccccactgcactccagcctgggcaacagagtgagactcccgtctcaaaaaaaaagaaaaagaaaaagaaacctttataagcctcggtgtaatacagatgaaagatagtaaggtaccacaaaagggtatggtatttatatagatgctgcatataaatggtacctctcagtaataatgggagtgacattaacattattttctgattgttttaacttaggcttggctgtgtgtttattttattttattttattttatttatttatttattttgagacggaatttcactcttgttgcccaggctggagtgcaatggctcattctcggctcactgcaacctccacctctccggttcaagcgattctcctgcctcagcctcccgagtagctgggattacaggtgcccaccaccgcatctcgctaatttttttgtatttttagtagagatggggtttcaacatgttagccaggctggtctcgaactcctgacctcaggtgatctcgcctcggcctcccaaagtactgggattacaggcgtgagccatcgcgcccgcttggccatgtgtttaaaaaaaattttttttaacccgtacacaaactttcctagcagattattcatagtagccaaaaagtgagaaccgccagatgtcctcttcaggctgtgtggtccatccacagcagggagcaccacccagcactgagaggaacagcctgtggctgcatacagaaccggtgactctccaggaaattacctggagtgaaaaaaaaccaatcccaaaatgttgcaaacggtgcttccacttatgtaacattcctgcaacaacaggtcagagatggagaatagaggagtggcagcaggagtcaggatgggttgtagggatgtaggtatgcagatcttatcaaggtctacctgctgtgctgcagcatatcccctgggggtgggccaaggcacccaggatttctattatttcttactggtttgtggatctacaagcatgtggcctcacagtcccgccacaaggatgcctgagtccttgggtccctgctgtcccaggtgtttttaggattagtcctatccctaatccctttccttcactttacttacatctcatccacaattccaagttactcacaaatttttattgatcagctggaaagtcttcattttttttggcttgctccttccatagtttttccttggtttgcctttcactcctttatgtgcactcatccctcgtatgcctttagtgttcttgccatttgtcccttttatcctgaatcagtccctagattggcagactcttcaacactgcctatttctgtcctagatacacggcacaagcacaaaaagacaaaaattaatgatggtcagttggtcctagtcgcagtgttcacataggagtagatccagcagctgctcttgattttgccaaagtgatttgaccaagttattttccagcaagcggatctctgagactcctctgctaggctttgcgttacattatagagtgcagaaagatgggccacagggcccaaaattctctattatgtacattctgggtcataatgttgatgtactttgctttaaaaagtagtccctagaagactggactaccctaattcctatttttttttttttttggagtttcattcttgttgcccaggctagggtgtaatggtgcaatcttggctcactgcaacctccacctcccgggttcaagcagttctcctgcctcagcctctcaagtagctgagattacaggtgcatgccactaagcccagctaatttttgtatttttagtagaaatggggtttcaccatgttggtcaggctggtcacgaactcctgacctcaggtgatccacccaccttggcctcgcaaagtgctgggaatacaggtgtgagccactgtgcccagccccttattcctaattctcatacctcattgtagttctcttcattgacacccctgaagtaaggggctcctctctcaggttcttagatcaaggaacagccactggagataggcagggtgtggtttgaagctttgtatgtctttgtttagatagacctctttctatagtgacagagagtctgtatttgaattatcttcagtactgctttgtgtattgtaatttggtccaatctccaaatttttcaagattaagcattcttatttctagctgtctcagtactgtcttctaacctatattcagtttcatagttgtccttacatagatagtaaagtccctagatttaaagaaaaactacattgattctctttttcttattctgtagagaatataatttgtcctacataaaaaaatttcaggccaggcgcggtggctcacgcctgtaatcccagcactttgggcggccgaggcgggcagatcacttgaggtcaggagttcaataccagcctgggcaacatggtgcaacgctgtctctacagaaaatgcaaaaattatccgggtatggtggcgcacacctgtaatcccgggtactcgggcggctgaggcagaagaattgcttgaacccaggaggcggaggttgcagtgagccaggatcgcgacacagcgagattctgtctcaaaaaagaaaaaaaaaaaattaaagccttgattgtttccattaaactattcttcttaatttattactctttaaaaccaagactacggccaggtgcggtggctcacacctgcaaacccagcactttgggagcctgaggtgggtggatcacttgaggtcaggagttcaagatcagcttggccaacatagtgaaaccccgtctctactaaaaataaaaaataaaaaaaagagccaggcatggtggtgcacacctgtagtcccaactacttaggaggctgagtcaggagaatcctttgaacccaagaagcagaggttccagtgagctgaaatcgtgttactgcactctagcttgggtgacagagctagactctgtctcaaaaaaaaaaaaaaacaagactaccagcctgggaaacgtagtgagaccccatctctacaaaaaatttaaaaattagccaggcatggtggtgctcacctgtagttccagctacttgagaggctgaggcagggggatcgcttgagtttatgtggttgaggttgcagtgaactgagctgtgattgcaccactgcactccaaactgagtagaaaatgagactctgtctcaacaaaacaaaacaagcccagcagccaaatcgcttggtttaagaactagtgaatgtttaccatcatatccaaagcagggatcgcctacagcctaggttgaaatctggctcatcaattgtttttcatacaggttgtaagctaagagtggtttttatagtttaaatggttggaggaggatatcaaaagaagaataatgttttatgtctcatgaaaaatttgtgaaattaaccttttagggttcataaataaagatgtatttattagaacacagccacgtccatttgttgtgtatcatctgtgactgccttcatgcttactttgcagagttgaatagttgtgacacagaccatatggctggcaaagactaaaatatttactatctggctctttatagaaaaagttggctaaacattctaaagggtcagaaggctcattgtgaaactgaatacaggaggtattttagtgttcttcagtgttcaatactgctttctgtattttaattgccagttagctatcaaatggtcccatctccacatttttcaagatcaagctttcttatttctagctgtcttggtactgtgttctaacctatattcagtttcatacagttgtccttacatagatagtaaagcccctggatttaaagaaaaaaactacattgattctcatatgattctcatctctcaaatgattctgttagtgttcatgtccctcagtattgaacaacagtattgaatactgtagggttttctgtcactaattagaaaacaataggaagagtggctcacgcctgtaatcccagcactttgggaggctgaggcagtcttactgcctgagctcaggagttcaagaccagcctgggcaacatggcaaaaccccatctctactaaaaatacaaaaaaaatagctgggcgtggtggtgggcacctgtaatcccagctacttgggaggctgaggcacgaaaattgcttgaacccaggaggcagaggttgcaatgagctaaggtcatgccactgcactccagcctaggcaacacagtgagactgtcaaaaaaaaaagaaagaaacaaacaaaaggaaaggaagggaaaaggaaagggagaaaacagtaggaagagatggagctgtctttgttttcccttatgagtctatcaggccagtgcttcatagtgggctcttaggaatgattttttttttttttttaaatgaaccatacatgaggcttttaatgggagaaatatttgtggacaggaattggggattcaaatcagaatccccttttaatggtgatttcacagtaataataccctttcaggcaaaccttccctgtaagccatggagcacaatctggactgaattgtggtccttttactgacttttacttactgacttccttttaaagtccacttcattccctgtgggctgtgcttggcattgtatatcctcaggaagacatttgacaatctactgctcacccaaactaaccagagtgagtgctttattttaggggacctttgccatttctttttacagccaccttcttgccagtgtttagaataatcagtcattccacagacctacccccattaacacccttcttccaaaaaacccagaatacaaaaagctaaacatagagattattacagattattgctctgttgatatttcagatcctttggaaggttggatatttgtatttaggagttggatttaagttgatccctttcttacacccctttctagtatacttacagtactttaaatctccctccacaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtgtaagtaacatggaggggggatgcattatctcagggtccgttctggagggctgtagataagggaaggaggctttgttctctccccgagatttggcaggtccatggatgatgcagtctgtgacagtggcttctcaaagaccagttttcagtctgtgttcttcagcacccctgatggacaggtgcacaggtgacaaaatgcttctaatcagggttgtgcctttatggcatgcactgtcagcattggggccataaagatattcctctcccacacctgtttaagcctgtcttgttatgactctcaacagacatgtagagctactggtggtggttttccctacagcagccttttgtggatacagggttcaaaagtgatgcgtgtaaagaaaagaatagaagtgagtttagagctggaattacaaatatgtttcttatagccatttttgttatattagtagtggctgtgtaggctaagaaagtagtattcaggggctgtgttgagaggaaatacgaagttccagcaagctcaatgaggacaacactagtgctgctaagtgatacttgtctgaggctgtgtttagagaccaggtcatttctcccataggctcttgctcggcttcagccttggcctgagggttgtttctgagaccctggcctgccttttactccagaaggccttcccagtgaggatgatgctgaaatgcagccagtagtaggtcaggtaccccagccacatctgtaatcttaggttcatgtagaagttcacgtgtggccaaaagtttagctactatttatagttcagagagataggaagcataagaattcttgctctgtaggagctttagttgagaaaacaagaaatgaaaacttggatagaacttagcaaatgaaggcatatagaacttaccaaaggttacatgagactgtgatgtgccttaagtacactctaatactctgggaggcttcatggacagagacatgtctgactcttctctggcccccagagtctgggacaaagtaggtgcacagaagaaagacactaatttatctaggtatataagatcacaacaactttttaaaattatctcccttaagctagtggtcagtggttgtgtagtacagtaggtacctctttttcttggcaagaaaatgtttgccaagccaccctgtggaccatacataaatgagctcgcctatcaagagagttgaccagttttccatccctattgcagaggtagtatcactggtctttaccaatttaccactgtcatgtcctgctggtcacccatgttttgtacttcaggattccttcccaaagggacctcagtagagctccttgagaatgtggagggtttcaggtggaaccttcccacctgctgcctggttcctgccataagtcagtgctctggaattctgaaccatgtgaattggttctaggatactaggtaggccacactggatgagttgcttctccacttcagcccttcatttcctccactgaaagatgacacaagggattagatcagtgagcttcagaatgctttcaagagtcttaagggtttggtagaaacctcttgggcatagagttgggtgaattgattggtgagcaatgctgcactttatttcatatgttttcaattctgacaagatctaggggtttttaaaacccggattaaatgatctctcgggttcttttgtacactaaagcaggtaaagttgaaataggaaagagtcccagacactcatactaattgttcccttcaggacatgacctagtttgggccaaaaatcgaaggactgcagttcaggagctgtggaggcctccctggactatccagtttgtcagcaactgcctcaagtgaagctctctggccctggtggagacatttatatagcaagaatttattgataatctattttgtgcccagctaggctagggactgtgggggcggggggggggcgggaagaaaaacaagacatagaactgtcccaggaaggagcttattttttaactgaagaaataaaattagaacccttgaaatacaatgcaatcaaaattaacttctgaaagggcctggagcgattcttggaaggagttggcctggaaggagggtgggggaaattcagacacctcccactccccagccactagggttaggctaagcaacttgagcagtgccctagaggttcagaaggaattgacttgcatagaccacagtggaatcaatgcctcacagggtgcattggttgcctgccactaaggaaaggacttctgtgtctttttttcactgaataggctctttcctgagtctcttgtatttccagcaataacgagttactcttggatatgtttgcagatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattacccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgtttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttc

SEQ ID NO: 35764 - DNA, 196020 bp, Homo sapiens; identical to SEQ ID NO: 35763

SEQ ID NO: 35765 - DNA, 14976 bp, Homo sapiens
gccgcgcggggccatttccgctgctgcttctgtgagtttttccggtgcacgcgagtgcttctgaaacgtcagctgcgctcccctaggagtgctgagcccgcggaaccgcagccatggtgagtgcgtgcgccggccgagggaccgggaagcgggagactcagggttgcgttcactccctagcctgttagatggaggcttagagcctgcgccgtctcatccgccggcgttgggtcttaaccgccgggcccttagttagaaccccagcagcggcggggtcccagcagcctggcccgaggttagaactcaggaaaccttaggatccccgcagctgtgttgctttgccgcacggtctgtttgcttggcaaaaggcctgcagcgagcggagggggcatggcccagcctgggagaaagagaccaacccacgtgggagagggcaaaaagttgggtgaagaaaacttggctccaacttttttttttccttgtttcttttcatacgaaatctacgatggcgtgggaccctgggattcggatcaacctctcctacccaccctacctcaccccacccccgttgctggggttcaggaggagatctcccatgggtctgcgcttagtgcccgccgcgagtcacacgcgccagggacctagaggagcctttggcatttgggggctgtggggaacatgaagtgagcgcgactcacggcctggagtgcaggaaaggcttctcctgcaaggcggtggcttcaaaaaccagaagtctggtagcaccacgtgcggcgtctctaaactcttggtcgtctctgacttttaaacatctagggaaagttctaaaacgtgtgtcctggcgtagtagttttggttggcacttggtgaggagggaagaatttgtaaagcactgtaacttctatagttaatccttccagtggagcttggatcccggcggtagcactccccacaaacctcctcccatgcattttgaagcttagtacgtggctgagcctagaacttgaagcttccaaactcagtgctcgctttaacgcagctccctgaaacgttttggaatcggatggtctcaggttgaactttgcagttttcctcaactgtaaaatggggatgacagtgcatgagggtgttgtgaggatcaaatgaaataaagcatggtaaacatctagtcctgatgcttggtacagagtaagcacgcagtatttgttgttcaatcaaaaccttgcaagttttggctgtctggtgtacagcgaaaccaaactgatcatgctaggtagggatttaggttggctggtggtatgatatcattcgttaatttatttaacccctgaagaaattgaaaggcaaataaatacaccctaagcaagtttcaattagtgtttataagctagtttggttttaaaattgagtttaacttttttgttgactaatagtgaaacatttaggtatttaatgattgttcagattcctgaagtcttcctcttttatgaatttgatgtttattgagatttgagaatcctgatttccagagaatgggttgttggaaacaatggcaatttttaaagtttttttaaattgacatatcatagttgtacatactttgggggttccatgtaatatttctaagtatatctattttaaaacatgcaacagggccaggcgcggtggctcatgcttgtaatcccagcactttgggaggctgaggcgggtggatcatggggtccggagtttgagaccagcctggccaacatagtgaaaccctgtttctactaaaaattcaaaaaaattagccaggcgtggtggtgggcacctgtaatcccagctacttgggaggctgaggcaaggagaatcgcttgaacctgggaggcgggggttgcagtgagccaagatcacaccactgcactccagcccgtgtgacagtttgagactccgtctcaaaaaaataaataaataaaacttgtgataaattattaaccaaaatttccagctgggcacggtggctcacgcctgtaatcccagcactttgggaggctgaggcgggtggatcatgaggtcaggagttcaagaccagcctgaccaacatggtgaaaccccatctctactaaaaatacaaaaattagccaggcgtggtggtgcgtgcctgtaatcccagctacttaggaggctgaggcaggagaatcactataaccggggaggcggtgtttgcagtgagccgagatcatgccactgcactacagcctgggtgacaaagcaagactgtgtcaaagaaaaaaaaaatccctactgtagtatcaaataaaacatttgtatggccggacgtggtagctcacacctgtaatcccagcactttgggaggccgaggcgggtggatcaccttaggtcaggagttcaacctggccaacatggtgaaacccccatctctactaaaaatacaaaaattagctgggcgtggtggtgcatgcctgtagtcccagttactcgggaggctgaggcaggagaattccttgaatatggaaggcagaggtttcggtgagccgagattgcgccactgcactccagcctgggcgacagagggagatgccgtctcttaaaaaaaaaaaaaaaagataaaagaataaactccaaatcagtagaggggaaaatagtgcaaatgcaatgataaatccagagaaaggaaagaaagaaaaagaaacagaacaagtggaacaaatagaaggcacaaaagaaggaaaatttgaaaccattataccaatacttaaatatgtaaagggactgagtgctccagttaaaagacgggatgtggccaagcactgtggctcaagcctgcaatcccagaaattgggaggctgaggcgagagaatctctttagcccaggaattggagaccacccagggcaaaatagtgagatcctgtctctacaaatttttttttttttttttttgagacagagtctcgctctgtcacccaggctgggtgtgcagtggcacgatcttgactcactgaaacctctgtctccttggttcaagcgattctcctgtttcagcctcccgagtagctgggattacaagcatgtgccaccatgcccggctattttttgtatttttttagtagagacggggttttgccgtgttggtcaggctggtctccaactcctgacctcaagtgatctgcctgcctcagcctcccaaagaggtgggattacaggcgtgagccaccacacccagcctaaacaattttttttttaattagccaggagttggccgggtgcagtggctcatgcctgtaaacccagcgctttgggaggctgaggtgggcggatcacaaggtcaggagttcaagaccagcctggccaacatggtgaaaccccgtctttactaataatacaaaaattagccgggcatggtggcgcatgcctgtaatcccagctactcaggacgctgaggcaggagaattgcttgaacctcggaggcagaagttgcggtgagccgagattgtgccactgcactccagcctgggcaacaagagcaaaactccgtctcaaaaaataaaaaataaaataaaataaaattagccaggagtggtggcccacacttgtagttccagttactgaggaggctgaggcaggaggatcgcttgagccctggaggtcgaggctgcagtgagctattgtcatgccactgcactctggtctcagtgatagagtgagaccctgtctcaacaacaaaaagggtgtaattctttttttttttttttttgagatggagtttcactctttcgcccaggctggagtgaagtggcatcatctcaacctactgcaatctccgcttcccgggttcaagccattctcctgcctcaacctccaagtagctgggattacaggtgcctgccaccacacccagataatttttgtattcttagtagagacgggggtttcaccatgtcatccaggctggtcttgaactcctgacctcaagagagccacccaccttggcctcccaaagtgctgggattataggtgtgagccactgtgcctggactgccccagctaagtttttaaatatttttagagatgggggtctcactgtgtggcccaggctggtctcaaacttcaggcctcaatcagtccccagcctcagtttcccaagttggtgggattataggcctgagccactgcagccagttcagaatacactcttcaaacatggaacgtttttgaaaattggccataaagcaagccctgcaaattttaacattggtaatattacataccatttttgcctaacccaaaaggaaataagttaaaaattagtaacaaagtagtttgaaatgaaaaatataaactatcagagagatttaaaaattgtagtaggaattcaaaaatagaacagaacaataatgaaaataccacataccagagcataagtgacaagggcagaggggggaagaaacaaatgaaaggatataatgaaagtattacttggagcctaagatgctaatgctagggagaaacgggataaaaaggtagaaaaaaacactagcacaaaataaccccaaagaaagtagaaggaaagaaaaaaaacaaaaggagaaattgctgaaatagaaagtagagcatactgctgggtcttttcctttccgaagcccctctttctcaccagagagagctgttctttctctttcttttgcctattaaacctctgctcccggccaggcgcagtggctcacacctgtaatcccagcactttgggaggtcgaggcaggtagatcacctgaggtcaggagttcgagaccagcctggccaacatggcaaaacccagtctctactaaaaaatacaaaaattagcccggtgtggtgacgcgcacctgtaatcccagctactggtgggggctgaggtaggagaattgcttgaacccaggaggcagaggttgcagtaagccaagatcgcactactacactccagcctgggcaacagagcaaaactccatctcaaaaaaaacaacaaaaaaaaaccctgctcctaaactcctgtgtgtccatgtcctaaattttcttggcatgagacaacaaaccctggatatttaccccaggcaacgaagctagttcagtttgacactgttgtcaaagttttggggaattagtcactgtcatgcattgctggtgggtgtgcaagttgttaaaccctatatagggtcaatttagaatagatataaaagttacaaatgcatattatatcttttgactcgttaatcccacttctaggagtttatcttacagatatactgaatgaaacataatatagattaggtatagatgagattagacattatagcatttacataatagtgaaagattaaaaaatatataaatgggctgggcacagtggctcacacctgtaatcccagtactttgggatgcccaggcaggaagattgcttgaggccaggagttcacgaccagcctggacaacataataagacagtgcctctaaaattaaaaaattagccagacgtggtggtgcatgcatgtagtcccagctacttgggagtctgaggcaggaggaccacttgagcccaggaaagtccccctcagaaagattaatcgaaaaaataaggccaggcacggtggctcacgcctgtaatcccaacactttgggaggctaaggcaagcggatcacttgaggtcagcaattgggagaccagactggccaacatggtgaaagaccttctctactaaaaatacagaaaaattagccgggcgtggttgtgcatgcctgtagtaccagctgctctggaggctgaggctggagaatcgcttgaaccccggaggaggttgcagtgagccaagatgccaccactacactccagcctgggtgacagagcgagaccctgtctcaaaaaagaaaatgtttaagtaggtaacatgtgaaggagacatactctatagacattaaaaagaaaggatggccaggtgcggtggctcatgcctgtaatcccagcactttgggaggctgaggcaggcagatgacctgagatcaggagttcgagaccagcctggccaaagtggtgaaaccccgtctctactaaaaatacaaaaatcagccggccgtgatggcggtcacctgtaatcctaggtactcaggaggctgaggctgcagtgagccgagatcgcgccactgcactccaacctaggcgacagagggagactccgtctctaaataaataaatgtatgaggaagagaaaaataatatggaggtcttcccttgacctcccccaacccccttcctttagagaactcctccatccttcacctaattcttcctagttgtcctgggaccaagacaaattcgcctaagataaggagttacgtagaagacagggcgtcctggtgtacgggctggccctggacgtcacttccgctggcggcagtggcgtcacttcctgctcttgggggcggggcatccgtgtccttgcggtgctgggcagcagaccgtccaaaccgacacgcgtggtatcctcgcggtgtccggcaagagactaccaagacagacgctatggtgagtgttcctactgggccattatctccgggtcacctcccgagagctgtggtgccgcgagcgtggtcccgctgtgtcagaaaagctgtaaaaaaacggaaggaggaaaaggcaggtgcgcggtgtcgggcaggagaccaccgaggcaggcgctatagatgagtggtcccaccaggccatctccgtctccagcgactgccgtccaccctatgtccagcctccaaggccgaggttaggtggtagccgcagtgaatcactcgcgattcgcacgttacacacgatggcgacatgtggggccgcacctgggttataatatgaatatatccttgtatataaatatgtgtttgtaaaaacaaaaaaaaaaagagaaaaattaatgaaaatgatttactggagcagtgggaatgagatggaaggagcggaataggcaggccactcacccaatatgctccctacatgggtgtgtatttatttatttattgagacggagtctcgctctgtcgcccacgctggagtgcagtggcgccatctccgctcattgcatcctccgcctcctgggttcaagctattctgcgtcagcctctcgagtagctaggactacaggcgtgagacaccgcgctcgtcccctacatgggttattttgacacagatctgaatgacatcattttatccataagtattacagtatatatctataaagtaagaatttttaacataactgcaaatgccattaattagttaataagggttgcaagttggtgatatttaactgtaccattccctctttatttattaggcggaagagtgatacaagaggtacttctcatcttctacctggttaccgcctaatacagcatttaggaaaggcacagaagatgattgtttccctttcccagttttcaaaatattgagttgctatcacttgcatagttttgacttttaaaccatgaagatattttacatatttgaaaaataaaatttaaagcaagctgactacaaaataaatctacttgtataccaaattgctaaccacaaggaaaattttaatttgaataacttttgaacaaagtcctgccactggatggctttgataggatatatcctaagaacaaaaataaattttgactttggtgagtttgttggtagaggtggtatattggtgtagcaattttggaaccattttgtgtgtattgtagaggaggtgaggaaatactttaatgtgttggaaaccatgggtttgaacagaagatacgcatatggagtggggaatggaaagaaaactttgtgctacatttactgtaaattatatcttattgattcagtaaattcaggtggaatacggaagttcaaatttaaagattacccatggactcctgacctcaggtgatccacccgcctcggccgcccaaagtgctgtgattacaggcgtgagccaggagtttgagaccagcctggccaacacggtgaaaccctgtctccacaaaaaatacaaaattagcctggcatggtggtgcacgcttatagtcccagctacttgggaggctgaggcacaagaatcatttgaactcgggaggcagagattgcagtaagctgaaatcgcaccactgcactccagcgtgggcaacagagcaagactccatctaaaaaataaaaacagaaatggattagccatggactcaaatggatgcggagccatgggaacccgtttgtaatccatttgctgtaatattatcaaacattcggctgaagaaagacaaaagtacatgagctttagtatactttactgaactgtgtaattcctaatagtgtatttcctttttttcgaaggtaggagtggaaagtccattgttaactacctggtgttttgtgtgtttgagggttagggagcagggcagctgccccctgtgtctcaattgttgattagtattttgtgactcaggtaggaaaacttctggctcaatttgtctgatatttttatgtcccccccatagactgaggctgatgtgaatccaaaggcctatccccttgccgatgcccacctcaccaagaagctactggacctcgttcagcagtcatgtaactataagcagcttcggaaaggagccaatgagggtaaggcagccacaggatgctctgggggaatgttaaaggcacctgtttccatctggggcctctgatctgatttccagtttgggaggagggctagctgctctcgactacaaccagtgggaggactttggcattagatgctaaagctgatgggctaagaattttttttagacccaccaattgttaacattttgccacatttaccttctttttcactctataagtgaattttatttttgctgagccatttgaaagcagttgtggagactgtatagtggctgtatgacctcaccagagccatcagaaggaaagggatattaatgctttttagcatcccttatacggtggatacttaacattcatgaatttcatttggttcccagaaacattccctacccctctcccttttttttttggatgcaattattcaaaaacatggaacgtttcacgaatttgcatgtcatccttgtgcaggggtcatgctaatcttctctgtattgttccaattttagtatatgtactgctgaagcgagcactacctccctttgtaaaaaaggaaaaaaaaaaagctgtttttcagtagaataattatgtatgcatgatgcttctgcccagaggtgatataggatactctcactttattcattattatttttttaattttattttatttatttatttatttttttatttggagagttttgctcttgttgcccaagctggagtgccatggcaggatctcagcttactgcaacctccgcttcccgggttcaaatgattctcctgcctcaacctcccaagtagctgggattacaggcatgcaccaccacgtccagctaattttgtatttttagtaaagatggggtttcactatgttggtcagtctggtctcgaactcctgatctcaggtgatctacctgccttggcctcccaaagtgctgctgggattacaggcgtgagacactgtgcccagccttatttttatttttattttttttcaagtagagacgaggtttcaccatgttggccaggctggtctcgaactcctgacctgaagtgatccgcctgccttggcctcccaaaattctgggattacaggcgtgagccactgtgcccggctgcccagccttatttttattttattttatttttttggagacagaatctcgctctgtcgcccaggctggtcttaaactcctgagctcaggcaatctgcctgccttggcctcccaaagtgttaggataacagcaggcgtgagctaccatgcccagccagaatactctcattttaatagatgctgggtagtttgatgtggtagagctcttttgtcgttgaagatttttaatggaaacatcagagattttgtcaactgtgtttgagatttaggagaactattacaatcgcttttacctgtgttgctgaaggaagataaagtagactctgtgggtctcgtcgtagtgctctttcctccctgctcgtcacactgcagtaactgcagtgcctggtatagcagtggccagtggggcattgtagggtgacccaccagctctcctgggaggtctctcttctcacttgatgcactcaggtcagcttggctgggcagggatgtgacttcttacacttcaggtagatgaggactcatggacacagagcaaccttatttcctcttgccatactttgcacggtgataagcacacaggtccttgaatggagatgctcagtctcagcgacttaattcagaatatgcttactgggagttcagggagggagatgcaacaattttccgtacttctgcctcagtgtcaggtattctttcttgccatatttattgattgcctgctatgtgccaggcgcatgtatatatgctgatgatgcactggtgaacaaaatgaagtctctgccttcttggagtatacattccagtggagaaagacataggttttatgcctggtggtaaagaatgctgtaagaggccgggcgcggtggctcacacctgtaatcccagcactttgggaggccgaggtgggcagatcatgaggtcaggagatcgagaccatcctggctaacacggtgaaacctcatctctaccaaaaatacaaaaaattagccgggcgtggtggcgggcgcctatagtcccagctgctcaggaggctgaggcaggaaaatggtgtgaacccgggaggcggagcttgcagtgagccgagatctcaccactgcactctagcctgggcgacagagtgagactccgtctcaaaaaaaaaaaaaagaatgctgtaaaacagaataaagtagagaagggggataggaatggcagtggtgggtctttttagatggagtattcagagaaggtctgtctgaggagtttgagcagagaactgaatagatgagggtgttggaaagaaacgtttttgggcatggtgtaaaggcatgcttgagggattctaaggaggctggtgtgtggctggaactaagtgtggggatgagaggtactaggagatcacatgagaccatgtaggccactgttagcagtgagtacaatggtaaatgagtagaaggattttgaacagcaagattgctatgatcttacttaacacttataaaagagtcactcctatgacttttgtagggtgagtaagctatagtaatatcaatagaaatgaacatgctttgcatttgccatgtgtcaggtattattattattatttattttacttttttttgagatagggtcttactctgcagcccaggctggagtgcattggcattgatcatggctcactgcagccacgacctcctgggcttaggtgatcctcccacctcagcgtcccaggtagctggaactacaggtgtacgccaccacacctggctaattttttatatttttagtagagatggggttttgccatgttgcccaggctggtctcaaactctgagttcaaacaatctacctgcctcagcctcccagtgggctgggattacaggtgtgagccaccatgcccagcctcatcattcttattaactggtttaatcctttcaataatcctattaagtagaattattaggtaattagaattaggttaaaaagagctgaggtgtgggtgttcgtttctcaggtgaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacattgccaagagaaaatgcaatgtgaggtaaaagatgaaaaagatgacatgaaaagggagactgatactaagagaaacaaaaagactcttctagaccagcatggacagtacccaatatggatgaaccaaaggcaaagaaaaaggctgacggcaaagcgagagaaaagaaaggggaaaagcaaagcaaaagcagtgaaagtggcaaagggtttggcgtggtagactcttaaaaccttggaaaatgccacatgggatagatgatggattagaatgtatatacatgtatactttgatttcagctgccaccaaatgaaaaccatttgttttcctattttaacttggccttttttcttcaattcaaacccagcataactcctgaagtttgttttgggaacttgaataaaatattttctttgatacaaaaaaaaaaaagaattaggttaaaaagaattaggtaattctttttttattaggtagaatcctgttaggtagaattattttatagatgataaaagtaagggaagttaaacaccttgctcaaggtcatttgtgtaacaagaatgagtgccagcatttgcactcagacagtgtagctctagagtgtgtgcccttctcaagtactccagcatgaatgcagagtattcgcactgagccacagaggcaagcagtcaggagagtacgcatctgaaacggtgctgtggggtgttgaacttgcatggtgagtcgcatgtgggatcagctttctagaagtattgattatggcagattgagatggtaaaactctgactctcagtcacagataccttgagaaatactatattattaatatactactacttgctggtgggggtttgtggaagctgttgcagttgacaaggtaagagatgatggtgacttggacgagtatagcagaggagtagaaagaagtggtcagggccaggcgtggtggctcatgcctgtaatcacagcactttgggaggccaaggtgggtggatcacaaggttaggagtttgagaccagcctggccaacatagtgaaacaaaaaattagctgggcatggtggcaggcacctgtaatcccagctacttgggaggctgaggcaggagaatcacttgaacctgggaggcagaggttgcaatgagccaagattgcgccattgcactccagcccgggcgacagtgtgagactccatctcaaaaaaagaaaaaaaaaaaaaaaagaaagaaaaaagttgtcagattaggacaggcacagtggctcatacctgtaatttcagcactttgggaggccgaggtgggtggatcacttgaggtcaggagtttgagaccagcctggacaacatggtgaagccctctctctactaaaaatacaaaaattagctaaacacagtggcacgtgcctgtaatcccagctgcttgggagactgaggcaggagaatcacttaaacccgggaagcggaggttgaagtgagccaagatcgcaccactgcactccagctgtgtgacagagcaagactccatctcaaaaaaaaaaaagaagaagaagaagtggtcagattcaggacgtgttttgaggataagtggtggatttaatgtagggcttgagaaaatgccattgtgtatgactgactggtgtttgaatcctttatcatatcccagggccggtctaggacacataattgtgtgtgcctaggcattcttcccagtttgttgtggctgccctgcccaagcccacatcacctattagcttcacgtccttctctccgcagccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctggtttctggatttttgtgttgtttttgttctgttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcagcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataaatctgttccattttgatgac

SEQ ID NO: 35766 - DNA, 4339 bp, Homo sapiens
ggcggcggcagcggcggcgacggcgacatggagagcggggcctacggcgcggccaaggcgggcggctccttcgacctgcggcgcttcctgacgcagccgcaggtggtggcgcgcgccgtgtgcttggtgagcccggggagggcgggccgagggcaccctggggaccccctctccgtcgccaggcccggcggggcccctagcccacgagcgcgacaggtggcggcggccgcgtccggggcctggcggcgagcggggccggcgtccagcgtcccgggccccgccttcccgccctccacagtctgtcccgctgtcccctcccggtcccgggtcccgccacccaccccacccccagcctcgcgccccgacgcggggtgtccggatctccgcagggagcgggcccctgcctcgctggcagtgggaggagtttgggggcggctcccggacaggtggcccgcacgccgcgactcccagattggggagttcaccgggacggggttttccgaagccacgtggggtaagggagggggcggggggcgacccaacgcccggaaacagggtgtccttcccactcggggcaggccacgggtccgccttcccacccgaagttgagggaccccaagatgtaccccctccctgtaaggtgggcaatacctccaaaaccaggttttgtgtgtgtgtgtgtgtggcggggagggggcctgttcttggacagccagccctgaaagctggagggggtggcatgagggggcaggcagaggtgggcctgctgtgcccagaccatgcctgggcctggagcttctgaggtcctccagggcgcccacaccagctcccagccaggctgtgggatctgatcgcctctgtcctgggctgtgtccaagaatcaggtgcccagtgggtcgggatggcagtgccaggagtcctggatgggcaccctgctcccatcatcccggagatccggcttcatctccatctgggggcggggcctgtgactgccagctccagagccctatggagagctccctgggacaacagggcaggactggcaggggagagtcctggggccatcccagagggatcctgatgctcacagacctgtcccacacctgctgaggtggagcaggcgtgggtggtggccttcaagtttagggaggtggtatggggctcttcccaaggggctggagctcccctacatccaccctgggtcctccaggtgtctgagttcagagctgtatccacaggcctgagttagtccccttgtagtgccctgtgcatgcagggccctctgtggggtgggagacagactgggagggaccaggatgccacagaggctgcaagtccttgtgtggagacagctggccaggctgaaccagggagggttccaggggttccaggaggtgaagacacaggggcgccagcatggccttcccaagagggcctgtccaccttcaccaaggtgttcaggcagaggctgggtgctgtagaagtgacttgggctgaaggtgacgggggatgggtagtctttgtgacttggcctgtcttggttaaacctctttcaaggtgaggttgggctggggatggaaggactgcccttcatccatcaggtacctaagcagaatgattcctgcagcaggccgatggggcaggagcagcccctgcctaggaggtccctgcccattccccacccctccccggtccaggattcccaggggcaggccccctggtgcctgcagattctcatcctggggtgcatcaggaagcactttgctcatcagctcacctccacaagtttggaggggctaagatgtcagcctccaaaaggggacagcaggctgggcgaggtggctcatgcctgtaatcccagcactttgggaggccgaggagggtggatcacctgaggtcaggagttccagaccagcctggccaacatggtgaaaccctatctctactaaaaatacgggtgtggtggagggcacctgtaatcccagctactagggaggctgaggcagaattgcttgaacccaggaggcagaggatgcagtgagccgagatcgcactattgcactccagcctgggcaacaagagcaagactccatctcaaacaacaacaaaaacccaaaaggggacagcagtagtgggagaggccagcatctgtacaccccatcagggtccccgctgtgtgtgcccctcaggcggccaccagccctaccaggtcctcccctcccggcaggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcaggtatctgcctgtggcacctccatttgatcttgggggaggcattaactctagggttccgcagctgggagggtctcggcctctctgggaggggcagggagcagctcactcctccagggcatttttaggaaagggttttcagctagtgtttttccgtgcttgaatggcaccagccctgcctggggtagctagaagctgagtggacctgcagcacacccgagcagatgggctttgcctctgccccttttgtcccctaggctgtctgctgtggcccaccctgccaaggcccgagtgtgggggactttggaggtggctcccggcccggcttccaagtcctcccctccatagtgtggaggctcccccgggaggtccctgccctacctgcccgcgtcccctcccagagtcctggaaagcccctccctttccatggaactgacgcttcacccgtcctcccccagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctgggtaggatggccaggggccggttcttgggtcaagggtggtggagggtggggtcccccacccacctgtaccctgctgtgctccccctgcagggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccgcacaagcctttcatcaacatcttaaaatagtaactgtg

SEQ ID NO: 35767 - DNA, 32361 bp, Homo sapiens
ttgcgggaaagagccaaaccctggcgttggggggcccgggcggggagcccctcccgcggtccacagcgacgcctgcccagccctcctccccttccggctccggcacggggccccgaggcgttcggaggccaggcgggtttctgtcaggcccggggaggaggggcgggcggggcggccgctgcctccccgggacgggccgtaccacgcggacggggaggacggggccaggggactgcagggcggctgcaccgcccgggggcggggtgcggagcgggccggcgggctccccggggcggggcgggagggcggggcgtggggcggacggaaccaccggggcggggtgggaggtaacgggacgggcgcgaccatggcgcggtgagggagcgggggtggggatcggtccgggggaggcctgaggccgctggcttgtgcgctgtctccgccgcccccctctttcgccgccgccgccgccgccccgggcatgtcgtccaactgcaccagcaccacggcggtggcggtggcgccgctcagcgccagcaagaccaagaccaagaagaagcatttcgtgtgccagaaagtgaagctattccgggccagcgagccgatcctcagcgtcctgatgtggggggtgaaccacacggtaaccagctcctgcgcgcccctctgagcgcggccccgcgcgctcccacgccccctgcagccctgggcccttgccccgcaggccctgccggtgacgcctgccacccctcgccaagccacttgcacgcccaccccacccttgcacgcctttcggccccgtgtgcactccccgcacgccacgcgaggcctggtgtctctgtggtctgccgtcgccacctccccttccctccagcccttctggcttcctgcgtgtggcgtgctcgcttggggcagcccatggagcgcaaaggcaaggcctcagtgcagtggagtcgctttcatccctgcttctcctcctcccccctcatcctgtttgtgagggtgtatattcccccttgttccttacagccggctgccagctctgtcaagtagcagtggtctgcccaaatagtcctctctttctgatcgtttggttgttgtggctgctcaaattcttccatcctccaggcctccttacctttgaatgtagaactccaccctgggtttccttttttttccctcttgaacaagatgtatcaactggagaagcacaggcttccttgaaccagacacttcacctgggtctctctgggttagggagaagaaagaatggctattaaccatttgagagaagaggatgcctggttataaggagggactattcatagtagaaataatatgtcttcccatagtttttgaaggtgatcattttaaagatgttgacttatctgttgtgtggctgcaatgttgtgatgatgcatagtgattatggtcctagataggagagataggtcccctgggtccttagggtgctttgagattgttcaacagcccctgccaggaagttggatcctgacagtttaagctggaagactgtttatgtggtgtttgttcagggtctttattctccctcttccaaccacttgctctttgccttctgaccatttctttatgaatccccacactaggaatgagcagaggaagtaaaaggacccgaaacaccaacttcactaactagaattttggaataaggaggatcaagcttgggtttcctgtggatttcagttctttaggttcacttgtgagtgcttgaaattgctcacaagaccaagcgatgacaaagagggccagcaagactttgcattgctttggcagaggagctgaaggtgcctttgggtggagatcgatgaaccgtaatctgagctagggttttagatcttgacctgtcatttaggaaagtgcatgtgtaaattgaggtctctgtggtttcttggtcttgggcaggttactgttttcactgtcatcactggtgttagtgagggtcctgccaggatagcgagtaccagtggtataatgcccagacctctaggagctgcttcgggccaacaatccagcccagtttgttactcggtcttcctgctgtcccaggggtcatctgacaacatttctagggaaactgggtgatcagaatatgaaccccatgtccctttctggaagtcaatccttgattttgttctgcatcctgcttctcactctaccaggcctctctctgctggttctgtttctcacagaaagcaacctgtctgtagagaactggtagaggcctgagagtcaggagtattacagctagctgcaatgaaccttgggtcccttattttacacatgaagaaaaggaggcctcaggtggaggattagcttgcctgtggttacagcaagagatgtcgcttattgtctagcaccatgggactgtatcggccaagggtggtgcctgagtggctggtcttgttttctttgcctcctgtttcttttcctctccctcagccaagtctcaggatagatgcgaagtatagtccggttagagaaggtgaatatatgctctgggttatacgcctatgcatgtcaggtcctgggagtgtgtgtgatgcatggtgttccgataggcaggcatgagtctgtccatatgtggttatgaagtttctcaatagctgatggttaggtatcacgagtcaggagtcctgtgagtcctactctgttggacaaagtggtcatcttttttctttgctaactttaagttgaaagtttgtttgaggggctagttggaaaggcattgactttaagcaagatccgtgcctctggacataatgaacaggcatctcatgggaacttcccaccactgccctggacaggctaagcttcagaggccagttagtcgtaagttttattgcttcatcctggtctgcagtaaggtctgatacttcagtgtccccatttgggaactgagacatctgcctagaagaagagtgtaatcttgcactcgtctaagggatcaggaccacattgccctcggtggactgctgcacttttttggagatttcctcccttcaaaaaaagcctactttgtaacattttgtcatctgagatttcagataccaccttttctttagtttctcacctgtttaggcatttaggcatgctggtctgtggctaatggtgtttcagataggaaggatggatatgtctttatctacagcagaagttagttaccctttcatgaggtgattagtttacttctaggtggaaaaagagaggactttgaacttggtgttgtcacaggagctgctctcatggacaagagcccatggattttgtggaggaagaatgtgtaggaaacaaggagaaaaatcagaagactttgcacctgtcagggaagaactagtgaagagcaaaaaccagtgttttagtggatgaaatacagttccgagggtttggaattagggaagagatggcctcagagaggagcatggagaccatgggaggtagacctgacttgatacttgttggccattttaagaaccaggtatgtgtgaagccttaccacagggatcagaggagcaggagcagttgatggtgactctgtatttaaccatttgagaaactgccaaactgttctctaaagtggctgtaccattttacatgtctaccagcagtgtataagagttccagtatctgcatccttgtcaacacttgttattgtctttttaaagttattaaagccattctgttgggtgtgaattcgtatctcattgtgattttgtttgtttgtttgtttttgtgatggagtctcactccgtcacccaggctggagtgcagtggtgcaatctcggctcaccgcaacctccacctcccgggttcaagcaattctcctgcttcagcctcctcagtagctgggattacagatgcctgccaccacacgtggctaatttttttattttagtagagacaaggtttcaccatgtcggccaggcttgtctcaaactcctgacctcaggtgatccacctgcctcggcctcccaaagtgctgggattacaggcatgagccatcgcacccggcctcattgtgactttgattggcatttctgtgataactaatgatgttgagcattttttcatgtacttactggccatttgtacatattcttttctttttttttttttcttgagacagagtcttgctctgtcgcccaggctggagtttagtgccacaatctcagttcactgtaacctccgcctccttggttcaagcgattctcctgcctcagcctcccaagtacctcggattacaggtgcctgccaccacacccagctaacttttgtattcttagtagatatggagttttaccatgttgtccaggctgatctcaaactcctaacctcaggtgatccacctgccttggcttcccagagtgctgggattacaggtgtgagccactgtgcctggcctgtacattttctttttgttgttgttgtagagacagggtctcgctttgttgccgaggctggtcctgaactcctggcctcaagtggtcctcccgccttggcctcccaaaggactgggattgcaggcatgagccacatccccagccttcattggtatcttttctttggagaatgtctattaaattttttgcccatttacaaagatctttttgcccattattaaattgggttatcttcttattattgagttacaagaattctttttatattctagatacaggtcccttatcagatatatgatttgcaaatattttatcctattcattgagttgtctttttcatttttctttttttttttttttttttttttttgagatggagttttgctctgtcgccctggctggagtgcaacggtgtgatcttggctcactgcaacctctgcctcccgggttcaagcgattctcctgcctcagcctcctgagtaactgggattacaggtgcccgccaccacaccaggctaatttttgtatttttagtagagacagggttttgccatgttggccagactggtctcgaactcctggcctcaagcaatccccccgcctcggcctcccaaagtggtgggattacaggcgtgagccactgcacctggcctgcctttttcatttttcttatggtatcttttgaagttcaagtttttaactttaataaagtccagtttatcttttttgttgttgttgtgtgtgcttttggtgttatatctaagaagacattgcctaacccaaggtcatgaagatttactcctttgttttcttctaaaagttttatagttctagctctttttttttttttttttttttttaatgaattggggtttctctgtattgcccaggatgttctcaaacttctggcctgaagcaatcctcccaactagagttttagctctttctttcttcttcttctttttttttttttaattgtattgtggtcagaacatttaacataagatgtactctcatgacaaaattttaagtgtacgattatgttattgatgaccatgggaacagtgtcatagtgcagctctgtagagcgtattcatctcgcttgaatgaaactttatgcctaccaattaactccccatttcccccgcccccagcccctggcaaccaccattctactctttgtttctatgaattggactgttttgaaaccttatataaggagaatcatgcaatatatgtttttctgcgactagctgatctcagcgtaaggtgctcaaggttcatccatgttgcacatagcagaatttccttcttttattaaggctgaatagtattctgttgtatatgtataccacattttctttatcatctgttgatggatttgttttcacaccttagctcttgtgaatagtgctggagtatgtatagttttagttcttacatttaagtctgtaatccattttgaattcacttttgggtatggtgtgagggacagatttattctttagtctgctcaatttctctcctacattccaccccagttctgttctgtccatacattttctttctttcttgtttttttttttgtttgtttttttgaggcagggtctcgcgctcttgcacaggctgaagtgcagtggcacaatcacggctcaatgaagcccctacctccccatgctcaggtgattctcctgccttagccacccgagtagctgggactacaggcacatgccaccacacccgactaacacttgtattttttgaagagtcggggttttgccatgttgcccaggctggtctcgaaatcctgggctcaagcgatttgcccacctcggtcttccaaagtgctaggattacaggcgtgagccactgacctcctttacctgtctttttatcttgccctactgctttaaaaatcttcagaggggcctggcatggtggctcacgcctgtaatcccagcagttagggaggccaaggtgggcggatcacctgaggtcaggagttcaagaccagcctggccaacatggtgaaaccccgtctctactaaaaatacaaaaattagtcgggcatggtggcgcatgcctgtaatcccagctactcgggaggctgaggcaggagaatcacttgaacctgggagacggcggttgcattgagccaagatggcggcattgcactccagcctgggtgacgagcaaaactccgtctcaaaaaaaaaaaaaaaagaaaaaatcttcagagatggctgggagcagtggcttacgcctgtgatcccagcactttgggaggccgaggcaggcggatcacttgaggtcaggagtttgacaccagcctggccaacatggcgaaaccctgtctctactaaaaatacaaaaatttgccgggtgtggtggcatgcgcctgtaatcccatctacccaagaggctgaggcaggagaatggcttgaatccgggaggcggaggttgcagtgagcagagatcgcgccattgcactccagcctgggcgacagagtgagactccgtttcaaaaaaaaaaaaatctttagagaacattcctactcaggcctttgaatgaagtttcttttagcaggccttcccacctcacagggagcagtgggactcaaacagcaggagaaggagaaagcaagatatggaaaggaggagtaaacaccggtagatttattggctcctgtggccctctcttcctctctggagttgcagttcttgctttggacctcctcggtcctgtgagtgtatttctagcatgtcatgttttctgatggtggcaggtaacaagtgattgctggtggtggccagcccactgctgaaccgacagcagaggactggaacatgtcaggaaacctgcatgcctagtccaggcatcctaggtaacaattcctatgaaggtcgcacagggaagtggaggcttctggacacacaagttcaccagactagaactagctgctgaattttcatctccatgttgcatattgcagaattttcttcttttttttaaaggctgaatagtattctgttgtatatgtacaacagaatcatacctctcactttgagagactgaggtggatggattgcttgagcccagggctttgaaaccagcctgggcaacatggcgaaaacttgtctctactagaaataaaattagctgggcatgatggcacacctgtagtcccatctactagggaggctgagatgggagaatcacctgagctcaggaagttgaggctgcagtgagctgagatcataccactgcactctagcctggcctatggaagtgagaccctgtctcaatcaatcaatcaaggaattttcatctccagtagatcagcatagagtgaactcattgcttttttttttttgagacggagtctggttctgtcacccaggctggagcacagtggcatgaactcggctcactgcaagctccgccttgtgggttcacgccattctcctgcctcagcctcccgagtagctgggactacaggtgcccgccatcatgctccgttaatttttttttgtatttttttttagtagagacggggtttcactgtgttagccaggatggtcttgatctcctgacctcatgatccgcccgcctcggcctcccaaagtgctggaattacaggcgtgagccactacgcccagctctgcagatgtctttttggttttgtatccccagctcctagcatatagtaaggcccttaatacactgagtagaagtaaattgaatagaaatttggcagtctggctgggcgcggtggctcacgcctgtaatcctagcactttgggaggccgaggcaggtggatctcctaaggtcgggagttcgagaccagcctggccaacatggagaaaccccatctctactaaaaatacaaaattagccgggcatggtggtgcatgcctataatccgagctactcaggaggctgaggcaggagaattgcttgaacccgggaggcggaagttgcggtgagcacgccattgcactccagcctgggaaaccagagcaaagctctatctcaaaaaaaaaaaaaaaaaaaaaaaaaaattggcagtctgagccagattaggaaaggccttgaatgccaggctaagcagttaaaactttaccctgaggttgagaggagcagccatggaagatttctaagcaggagtgtagcatgatcttgtagattctcctaatgtcaagtgctcttggtgcaataccaggagaggcattaggtgccttgtttctggcctgatgtatgaggactgggagcctgaccctctggccatgctagcctcatccttctctgagcctctgctgttcttgatgtctgtatccctggattctcacttaattgcatactgctttgactttgagggtgtcagggttttttttcatctccctgatgagattataagcctcctgtttcttttgcatgtacaacactttctccccttgtgttctcctcctcccacacacctacctaacagaatgaagcacgtagcagatatttcaataggaacagttcaattgaaatggaatagaactctctgggatataaaatttcacacaactaaaaaaataataataatagggctaatccctacagtgaatcatctacatgtggcctagtagaaatgaggggtaagtctcccctagttgagatatggattgttcaccaatgttagctgagttaaaaatttcctaggctgggccaggtgcagtagctcacatctgtaatcccagcattttgggaggctgaggcaggcagatcacgaggtcaggaattcgagaccagcctgaccaacatggtgaaaccccatctttactaaaaatacaaaaattagcagggcatggtgacatgcgcctgtaatcccagctactcaggagactgaggcaggagaatcgcttgaacccaggaggcagaggttgcagtgagcggagattctgccactgcactccagcctgggcaacagagcaagactcgatcttctgacctcgtgatccgtccccttaggcctcccaaagtgttgggattataggcgtgagccactgcgcccagccgagccctgaactctttgtctctgttttccctttaagtctcggagccaggcttgatatgccaggaaaaaggaaatgggacagccaccacgaattgtttctgttggcagaaaaacaaagaagtggaatggtttcctctgtaggcacagatttgacagtcacattctcttgtgagcaccccctggaataggaactggcatgactcttctggggttttttttggctattgggagggtttagccaatgaagggtatcacagagcttgatgctgggaatttaaaaatcaactttattgaggaataatttatgtatattaagtgtgcgtattttaagtatacaatttgatgaatttcagcaaatgtatttgctcatgtaaccatcaccccaagcaacatataaaacatttctgtcaccgtagaatcacacttctcatgtccctttacactcagcaccccccgccccctggccaggcaactcatctcatttctctcattatagatgcctgctgtagaatttcatataaatggaattatacaggatacactcttgtgtctatgccagtttttgccagcagtttacctagtgtctgctccactgccaacttataaactaccctgcccccagcatccctctcaaagcacgtgcattcctatggcttccttcatttctccatgagtaaattgggttttttcccaactctaggaagatatggttccccagcccagttactgcattaacttgaacttcctccattctctgacatttctaaataaaaaaggtttgtaacataaaaggagcagcaaattaaatgccatttcccccatttatgctcctggaggagttctaatgactctaggttatcccctcactgccacctggggcctcattgagataacaggatttgcaaggaaagtgggagacacaaggctgtgccccctccccccagtccattaagtcaggactaaggtttcctctgtaaatcctgaatgcattagtggcaactgggttgagggtcaaatgtcaaatactctgctgtgatgggagaggacatctgtggttaattagaccactaactggctaaactcgaggtggggaagggcaggatctgccctcatctctgcaccaatggaaagctagctctctgtctaggatccagctccctgaagggatgaaagtcagaaggtttgtttgcagtagaggcaaggcatcctgccccatctcccttagtttagtgtatggcaggacttgacatcaggaactggccctgctttattttattttcttttttgagacaagatctcactcttgcccaggctagagtgcagtgcagtggtgcagtcagctcactgtaacctcaaactcctggcctcaagcaatcctcccacctcagcctcctgagtagctaggatgataggtgtacacgactatgcctggctaatgtgtttaatttttttttttttttgagacagagtctcactcttgttgcccaggcagtggcgcgatctcggcccactataccttatgcctcctgggttcaaacgattctcctgcctcagcctcccgagtagctggaattacaggtggcttccaccacacccagctaatttttttgtatttttagtagagatagggtttcaccatattggccaggctggtcttgaactccttacctcaggtgatctgcctgcctcagcttcacatttaattattttttttagagatagggtcttgctgtgttgcccagggtggtatagaactcctggcctcaagtgatcctcctgccttggccttccaaagtactgggattacaggcatgagccactgtgccaggcctggccctgcttttatcaggagggtccaagtggggcagtggccagacatttactactgctcactttaatctattacagccgggcgcagtggctcatgcctgtaatcccagcactttgggaggccgaggtgggtggatcacgagctcaggagatcgagactatccaggctaacatggtgaaaccctgtctctactaaaaatacaaaaaattagccaggtgtggtgtcgggcacctgtagtcccagctactctggaggctgaggcaggagaatggtgtgaacccaggaggcggagcttgcagtgagctgagatcgcaccactgtactccagtctgggcgacacagtgagactctgtctataaataaataaataaataaataaataaataaataaataaatttaatctattaccttggggatatgagttacaagtccacacaaacccatccagctttttttcttccttgagctaatttcttgagtgacccacaatttgtatgaagatattcaaaggccttaattaatacccacttaggttgggagacatttatctattgatcatttattattgcatatgacaaatatttattgagtatctgccatatatgctagtaatggtgccaagcactgtggtgccccaaagattagtaggatgctctttgcttagaaatataattaaagccgagcgtggtggctcacgcctgtaatcccaacactttgggaggccagggcaggtggatcacctgaggtcaagagttcaagaccagcctgaccaacatgatgaaaccctgtctctactaaaaatacaaaaaaaaattagctggacatggtggtgcatgcctgtaatcccagctacttgggaggctgaggcaggagaatcacttgaggccaggaggtggagattgcagtgagctgagatcgtgccattgcactccagcctgggcaacaacagcaaaactccgtctcaaagaaaaagaaaaagaaagataaataatatagtattgcctagcttaactctagcaggtgaggtttataggcattaactacaatatgagagactgtgagatggccagaagacagatacaaagaaaacttcaggaattccaagatgggaaagggtattgatggtctagagaatcttggaaaacttcatggaggaggtgccttttgagctggcccttatcaggtggagagtttcaataggtaaaataggacaaggttgggaacttacttgaagagaagaacagaaataaaggcagggaggggccaggtgtggtggctgacacctgtaatcccaataatttgggaggccaagtctggaggattgcttgagctcaggacagtgagaacttgtctctacacaatacaaaaaaattagctgggcgtggtgatgtgcacctgtagtcccagctacttggggggctggtgtgggcagattgcttgagtccaggaggtgaaggctgcaatgagccattgtcatgccactgcacttcagcctgggtgacagaatgagaccctgtctcaaaaaaacaaaaaaagacagagagggaaacttggacatgcttttagcaagattgtggcatccacattgtagcttagtgtctctgaggcaggtggcctcctggctgagagccttacgttctccttgcttttcagatcaatgagctgagcaatgttcctgttcctgtcatgctaatgccagatgacttcaaagcctacagcaagatcaaggtggacaatcatctcttcaataagtaagttgtctactgagtggactcaggttttgtgggcagtcctttccctcaagtcagaggcttctgaagcctcatgcatggtgggagccaaggcagcacctggcagggtgtgacagcagcacctggatctcagagcggacaaactggctaggaaaatgcattcgttatgtgcctctcatcctagtattgtcgtctcactctattatcagcctacctccggtggcccttggggcatgtggctgggcccagggtgattcatctagagccagctcaggtggcagtgagctgctctggagctgaggtattcagtgtgaggctgtagcagtggccccatcttggtcttagtctgaggcaggaggttgccaggcatgttcttggtctgggatgccgccaggctcttttctgtctggctggtgtatgagcaacaggcagagcatggggctcgagggcactatccagagtagcacttcccatttttgtctgctgtcgcttcttggattagcaccagtgtctgaaggttgtctcagatattgttggaaacactagcggccgccacacctggcacaattttgggcctgctttaagccctttggggcctggattttccatccctctgtggaccaccccaggactatttgctgcttacactttctcctttctgcatgtgaatcctggttctattcttcattgtctcacagtccccaccacctcactagctgggttctgtcaccccaccattcccagactgttagtccagaggagaagattgacttgagaacatcccttagtgacctccctctgccatagtaagtaataccatcttgttctagaagccgtctgtctccatagctgccacctgttaagtggccacctaaggagggagaggcagccctcaactcagagaccagaaagaaggttgttctgacccagaagaaagaaggttgttctgactcagaggtccgggttctcgaagtgggcattgcaccactacccccttcagggtccatggcctctggtgaggtgctacctccttgatatcttggcctaaagcagagaacccaatctcttattttcttctatctttattccttttgtccttccaacaactgtgtatgtgtttttgttgttgttattggtgttgttttgagacagtttcactcttgttgcccaggctgtagtgcagtggcacgatcttggctcactgcaacctctgcctcccgggttcaagtgattctgctgcctcaggctcctgagtagctgggattacaggcacccaccaccacgcccggctaatttttttgtatttttagtagagatggggtttcaccatgttggccaggctggtctcgaactcctgacctcagtcagggtgatccacctgcctcggcctcccaaagtactgggattacaggcaggagccaccttgcccagccctgtatgtgctatttattagattctagcactgtttactagaagacggggtagataaggcagataggccacttcctttccaagaagacattccttttgatttccttaaagcctgtcatcctggagtagtcactgggacatatttctgaaagggggtccctaaacaggatagctgttgtaaagatggaggattggtaagagtcatcatttcaaggtgattctctttcctcctgggagtctgtattgatgagggagtgggagggtggagattggtgccagcagccagcagacagggctctgtggtcccactcagttgactgaagacctctttaactcaggcactcttttcctacgtcccagtggaagcccagggcagggcttcctgtaagtgaccatcttcaggatgcttccacaggaatatggccagaggagaggggccctctgatgagagaggtttttccttgtagcattcaggctgatttcacctcacagcagatgttcacatgcaggttcccactgtagtaagcacagtgcttgtgaggtggagcctgcactcaggcttatggcccagcgggtgagagtttttttctttaatgtatgttttattgaagggcagcacacacatagaaaatcgcacaaataccagttatactgctggattacttttacaaagtgaatacaagatgtaaagtttttaaacttttacatgctcagaatcacctggagtgtttgtttttcgactcaactccagaattcctaagagcctagaaacctacatgttaagtatggcagatgttcagatccaggcaatctgtggaccacactttgaagagttctgaagtcagaatatagatgaggctgggtgtggtggctcatgcccgtaatcccagcactttgggaggctgaggtgggaggatcgcttgaagccaggagttcaagaccagtctgggcaacatagcaagactctgtctctattacaaaaaataataataataatagaattaagatgagcaaggggcagttcacaaagacatatctctgcttttccctagggagaacctgcccagccgctttaagtttaaggagtattgccccatggtgttccgaaaccttcgggagaggtttggaattgatgatcaggattaccaggtatggaggctcctggcaacatcagtggattagggaatggaatggggtcaggaagccacaggacaggtagagaatcaaaacgtgttggctgtttttgtgctgtgtctccctgtcatgccttgctccagcccaggcggtctctcccccagcactgggggccccttgcagggcgagggccttagaaatgcttctgaggatgctgcacacactcaggttcctctccctcagagggagggcagcaggagggagaggggtctgcggaagcacctttattttagtctgacattcccagtctaggctgaagaacccttctcattcgtagtttgacttcaaagagaactgggtggggcatggtggcttatgcctgtaatcccagcactttgggaggccaaggcaggtaggtcacctgaggtcaggagtttgagaccagcctggccaacatggtgaaaccctgtctctactaaaaaatacaaaattagatgggcatggtgatgtgcgcctatagtcccacctactctggaggctgaggcaggagaatcgcttgaacctgggaggcggaggttgcagcgagctgagatcacgccattgcactccagcctgggcgacaagagtgaaactcagtctcaaaaaaaaaaaagagagagagaattgttgttagcgagagatgaggcctcttaaagcagatgaaatagattagaaaaggaagacttcaagggtagtgtaacctcttgccaggtatgagtgtcacctcctaaacttgtgccctatcctggtggtgggagtggggagttggtctgccagggcaactgcccccttcagggcgtgacagtgttgtagaggccattggcctgttgggaggaatcaatcccagtgtcagggacattagaatctgactcagtccatggtttctgtcacttctcctcttagcacatctccttggatcttcttccttggcagacagccttgtggtgaaggtgggcgaattttccacttcacctttacagctgtaagaaatatagctgactttttttttttttttttttttttgagatggagtttcactcctgtcatccaggctggagtgcaatggcgcgatctcggctcactgcaacctctgcctcccaggttcaagtgattctcctgcctcagcctcccgagtagctgggattacaggcgcccaccaccacacccggctaattttttgcatttctttttttttagtagagacggggtttcaccatgttgaccaggatggtttcgatctcctgaccttgtgatctgcctgcctcggcctcccaaagtgctgggattacaggcgtgagccaccgcacctggcctgaaatatagctgactttcattcatctgtggagaaaacttttccccatagcacagtgaaacctagtgtatagcacagtgaaacctagaatggatgcccaaatcttttctaacactgtagttcctcccaccccacccctttgatagagtagttcacagcagcagaaggggccttgggttagagtctcctcccctctctcctcctctctggagggcttgcatgcaaagaaaagtatctcgaagaagagggtgagggtttgtgagaggaggaggagatgccttgggcttgaatgcccaggagtgcctacacctaagaggtactgggaggttcctccagcctgctgttaggattgaaccctgaactcaatcatgacttgactggggctggaggttttctggaaacttcttgccactattgcaaccccaagttgctcagacagattccctccattgttccttggtgaggggttgcaagtgaggggttcctttccctcccctgggctgtctaaccacatcctctcagtgtctgcattttgcccctagtagccttgtgggcgcatgcccgtgctcaagactgaaatgagggcagggaggatggtgctcagggaggggaccctatattcttggactaccagccacttagagagtcaggggatgctgcctctacctcccaactaggcttgcagcctgtaagtcttatggtagagaggccaggctgggaggaagaggcgctcagtcacagagtctactcaacctttctgtaacgggaacagcctgttttttggggtgctactttagcacctttgctgaggaactcccagagctgcttaccacctctgactttagttttccccatgaaggtggtcctcacttctccaccagggttttctgaggaggtattaggggaaagtaaagagtaggatcctgatcagccgggcatggtggtgcatgcctatagtcccagctgctcaggaggccgaggcgagaggatcccttgagcccaggagttcaaggctgcagtgagctatgatcgcaccactatactccagtttgggtgacagcaaaacaccatctttaaaaaaaaaaaaaaaggctgggcacagtagctcacacctgtaatcctagcactttgggaggctgaggcaggaggattgcttgatctcaggagttctagaccagcctgggaaacatggcgaaactacatctctacaaaagctacaaaaataagccgggcatgttggtgcacacctgtagtcccagctacttggtaggctgaggcgggaggatcacttgagcccaggaggtagaggctgcagtgagctgagatctcaccactgtactccagcttgggtgacagagtgagaccctgtctctacaaaaataataacaggatcctcattaagagatggggaaacatcttggagaggagacatttctgtgacatgatccccatgtatgttttcttgggaacagggacacttgggatctcccctcaccgttgcttcccagaggtcccttggcatctgcttggtgaacatatccctttggttgactcacgccttcccacaccctccctcttaaggcttctactgctctctgatcctaatgggagtaggaccttgaggaggagcagggatacagccaggaaagctccccaaaactgcctcccagccttgcatagacaagcaggaggttgaggcaaggggaaaggtgtcaggctcagagatgaggatcagcttcctgctttggggaaggtttttcagcattagggtagatccagggacaagagacgaatgggcattgcttctttgtgctagaccccttgaagacagtattttctaagcttcatctttgctacccccaagagactgggagaatcagctcagtctgcatctttgtgttcctgatgaggaaatgcaggggtagagaagttaaatggctcacccaaggtcatagtgcgtgtgagagtccagattagactcagccccctccatcagaggcagaattttagttggtaggatagctatctgggatcaggatggaaactttcacagtcagtcctcttcccatcctagactgggatgaagagcaggtggtaaggaacaattcttgtcactttggaggaagacttagggagggatgtgaacaccctgtgagaaaaggggagggtaaactcccatctgggagtccctctatctcagtgttgttggctttcaagcagtccagcccctgagggaagactcagcgaaagtcagaattctgttcccctgccaagcccagccttcttttgtctcgattatcagaattcagtgacgcgcagcgcccccatcaacagtgacagccagggtcggtgtggcacgcgtttcctcaccacctacgaccggcgctttgtcatcaagactgtgtccagcgaggacgtggcggagatgcacaacatcttaaagaaataccaccaggtatggtgagtcccaagcctgggctgcagaggatgggttggaagagggagaagagagccctgggggagcttcttagggaggggttggtcctctctggtaatggcagctgcttctgatcaccaagcagtgggactctcctgcaaccgtatttctgtgagctgaaatgcctactttaaaaaagaaaaaaggagccatgaaggctcatcgctgactgactcccagttggaaagtgttcacgcactggcatccgccccgtttcttctgaaagaggccccctcagctcggcaggcttgtttcttttcccgtcccatctctccactcatctggaacctgtccatgaggaaggcagggagccccgtggcaccatctgtgtgtctgtcctcagcctacttgggtcttcatttctggggcacctgagaagggccgaagggagcttctggtctttcaggagttatggcagaaaccctggggcatggcatggataagagctttggatatggagctgttctcttctcccagatggctggatccctggcctgcctctgcatcctgtctcttccctgcggcattcccatatcaggctggcagaagagatgcaaggtgtggatcagggattttcctgtggtagaatcctactttaaacaaaatcttaggtgagatactaataatatgaacccacaggggctctgagccacctgctcagcttgcctctccctctgccatgccaacaggaggctggaggtggctgttgcccattttaagcctgagaaacccctattacttcatagaacccagctggagaactactggtctagaggttagaatcccagggagccagggagcattttagtctggggtgagccccatccatccctggcactgcctgttccttagtcctctctcttcttcctttccattctagtttatagtggagtgtcatggcaacacgcttttgccacagttcctgggcatgtaccgcctgaccgtggatggtgtggaaacctacatggtggttaccaggaacgtgttcagccatcggctcactgtgcatcgcaagtatgacctcaaggtaaagggctctgtgtttgccggagctgtgcctcccctctatctgagccccgaaggggccactactccaacttccatgtaattgggaagctggagcctatgtgttggcatggacagggaactctggagtggatatgcctgattcttgtggaccaaaggcagtttgaagtccaggtgacagtaacaggagattatttaagccctaaatgtgccatatttatgcagcagttgatgttcctgtctgtggaatgtgcacagtgagggaggccgtgctgacgcatgcactttagcatccatcaggcccccatggactgccagcacaagtgcatctctagactctgagaaggacacacttgtggctgtgaactagggtgctccgtgttcttgaacctggcttctgacttctgtcaccttatgccgccatcccttccctctgtgctgcaactgggctggtttcctctgtgttcctgcagtgcctgtgctcctcttcccaggatttcacatctgctgtctggaatagtctccttctctctctccacccactccttcccccacctaattgcttcctccttacccttctgagctcagcccaaatactacttccaggaagtaggtaggccctggccactgtccctccccaggccgggcccgtgtggtatgtgctttcagagtgtcctgctcctccctgtaccactgagcaccgtggtagtgaatgaactaatgacttgtggaaccactgctgaatatctgtctcccctgttagaaggaaagtagctcaagggcagggactgagcttctccagtgcagtcctgtttgctgagcacctaaaaagtgtcttgcacatagagctctataagtgggcttgacacagtaaatgaacaaggtgctgcctcctggcccctctaggactctaacaagcctacttgagttcacctgctggctctcccatgtttgctcatgcagtcgactttgcctcagcttgacttcccctgatggctcttatcctttcagggttctacggttgccagagaagcgagcgacaaggagaaggtatgctggtgctgagcaggaatggaagggtcgcttggagtcagaaacaactcctgtcggccatcctgtccctcgcccaccccagcccctagcccagctcccagacatgccgtctgtcaacatgaaatgccgtgtgtcatgaatcacctgtctgtccttgtgctaggcctagaccttggtctctggtcttttacctctgccctcactacgttcttcatagtcctgctgggatggcagacatttctatctcatagtccagcctgagtcagtcagtggctgcctgagccctgagctggtccaggctcaacaggaaagaatcctttagtcattcctcatctttcatgtgtttgccctccctgcccacccaaagcctgggactagaggctcctgcactgctgatttagcaggttgagggtcggtacactgacaacccctccttcccctttctgtatagttgctcccggcagaacagttgggtgtccctggggtgaattaatcaggcttacccagcctaactgctgttgctctcctaggccaaggacttgccaacattcaaagacaatgacttcctcaatgaagggcagaagctgcatgtgggagaggagagtaaaaagaacttcctggagaaactgaagcgggacgttgaggtacttactaaccttcattttcacctgcaaggctccttctgtacctagagtaggcgcctcttaaaccttaagaagaatggaattcagtactttccaggagtatggacaaaagggtggtgatttgagcagcgtgggcacttatgggcacctaaagcaagtgcaaatgatcattccacctgacggagcatagttggcgccagtaggacctttgtaatttagtttagaatgcttttcccttttcactaattcattccaacacctttttcaaactcccttctgctgttgtccctacaatggagagggcatctggccatcagagctgtaggaacccagctattaaggtcctgtaaccccaacattttgggaggctgaggtgggaggatcgcttgagctcagcagttcaataccagcctaggcaacatagcaagacctcatctctactaaaaattaaaaaatttagccaggcgtaggggcacacacctgtagtcccagctacttgggaggctgaggcgaaaggattgtttgagcccgggagatgaggctgcagtgagctgtggtctcaccactacactccagcctgggcaacagagcaagacattgtctcaaaacaaaaaccgaaaaagttggctaagcatggtggcttactcttgtaatcccagcaccttggaagggtgaggcaggaggatcactggagcctggcagatcaaggcaacatgagctgtgatcatgccactgtgctccagcctgggtgacagagcaagaccctgtctcaaaaaacaaaaatccactaatcaggttcttctctggctctggctctgattctccacttacctagcaaacttctgtttgtaatctggggaggacaggtgctaaatagtgaaaatgttatctggaccacttgataactcagcgtctccttctcttttaataaattgagaggctgctcgttaaaaccaaatcctacaaacaaacttgggaaaaaaaattttttttaattgtggtaaaatacatataataataggtgttttttttgtttgtttgtttgttttgtttttttttaggagattctcgttctgtccccaggctggagtgcagtgcagtggcacgatctcggctcactgcaacctccgcctcctgggttcaagtgattctcctacctcagcctcccaagtagctgggactataggcacgcaccttaaccattttgatatatagttgagtggcattaagtatattcacattgttatgcaaccagcactaccattcatctctgaacttttatctttcccagctgaaactctatacccattaaatactaattcccaattccccctccctaacccctggcaatcagtgttcaattttctgcccctatgaagttgactactctaggaacttcacataagaggaagcaaacagccaagcgaggtggctcatgcctgtaatcccagcactttgggaggctgaggtgggcggatcttctgaggtcaggagtttgagaccagcctgaccaacatggagaaacccagtctctactgaaaatacaaaattagccgggcatggtggtgcacgcctgtaatcccagctacttgggaggctgaggcaagagaatcgcttgaacccaggaggcggaggttgcggtgaccctccagcttgggcaacatgttatgaatgaaactccatctcaaaaaataaaaaaaaaaaaaggaagcaaacagcagttgtccttttgtgactctgttattttgcttagcataatgtcttcagggttcatccatactgtatcatgtgtcagaatttttttctttttattatttatttatttgttttgagacagagtctcgctctgttgccaggctggagtgcagtggtgcgatctcggctcactgcaacctccgcctcccgggttcaagcgattctcctgcttcagcctcccaagtagctgggactacaggcgcgtgctgccacgcccagctaatttttgtatttttttagtggagacggggtttcaccatgttgaccaggatggtttcgatctcctgacctcgtgatctgcctgcctcggcctcccagagtgctgggattacaggcgtgagccaccacacctggccagaatttctttctttttaaagctgaataaggctgagcatggtggctaacacctgtaatcccagcagctcaggaggctgaggcagaaggactgcttgaggccagaagttggagacctgggcaatttactgagatcctgtctctacaaaaaattaaaaactagctgggtgtggtgacatgtgcctgtagtcctagctattcaggaggctgggtgggaggatcccttgtgcctaggagttcacggttgtggtgagctatgatcatgccactgtgcatcagcctgaactagagggtaagaccccatctctttaaaaaacaaaacaaaagctaggcgcggtggctcacgcttgtaatcccagcactttgggaggccaaggcaggcggatcacgaggtcaggagatcgagaccatcctggctaacacggtgaaaccccgtctctactaaaaatgcaaaaacaaaattagccaggtgtggtggtgggcgcctgtagtcccagctactcgggaggctgaggcaggagaatggcatgaacccgggagacggagcttgcagggagccgagatcgtgccactgcactccagcctgggcgacagaacgagacctcatctcaaaaacacacacacacacacacacacaaaaactgattaatattccattgtatggatgtattacattttgtttattcatcagttaatggacacttgttatatcagttggggttctccagagaaacaaaacctataggatgttttgtaaatctctttataccaagatatttattttttattttatttatttattttttttgagacagagtcttgctctgtcacccaggctggagtacagtggcgcgatcttggctcactgcaagctccgcctcccgggttcacgccattctcctgcctcagcctcccgagtagctgggactacaggcgcccaccaccatgcccagctagttttttttgtatttttagtagagatggggtttcaccatgttagccaggatggtcttgatctcctgacctcatgatctgcctgcctcggcctcccaaagtgctgggattacaggtgtgagccaccacgcccggccctaagagatttattttaaggaattgtttcatgggattatggataccaacgagatctgcagtcagcaagccggaggcccaggagagctggtggtgtggttttattctacaggccatcaggccaccaggcagaaggagttccctcttcctcaccggagggtcaccctttttcttctcttcaggccttctgctgattggatgatgcccatccacactggggagggccatctgctttactcagtccaccagttcaatgctcatttcacccagaaaccctcacagacacacccagaataatgcttgaccaagtgtctgggcactcaggcccagtccagctggcatatacaattagccatcacacttaggttgcttccaccttgtagctgttgggaataatgctactgtgaacatgggtgtcataaacttcgttttgctaggaagcgtttccttagtcacccccaactatgttctttccttattctgcctttcatcatctgacattatttgtcctgagtctttgtccttctcccttttctaccctctccccctactgtggttctgagaagaatttaatgcagtttactcagtgcatttgttttcaatgcatgttgctttataaatgttctcaggtgggtggagggcatggtgcatggaccttctttttcctgggaccctagccccttctccctgggccttgagaaggctttgtctggaagtgctcagagtggcatccctccctcccttcctcttccaaggagatcctgctgggctcccatctttagggctccttgtccttagttgtgttctgggctcgtgcatagagctgctctgcttccatgatgattctcctcctagttctctgttaggacctaacatggtggtcagtctaacagtctcctagtgaccactgtatgatggtgactgcactcttgcctcattattagctaaactggaatgctagctggccatttccatcctgtatcattccatactttgtcttgaaatcctagataaaagacttgaaccaccaccctgctcacagcacccattatacagatgagaaaactaaggcttggcaaggggagtcacatgatgctaggggaggactttcccccagcaccacacagcctcttttgaccttcagggaatgggttgagaatattggttggttctggctgccattcttgtatggttttgtgttcccttttccttttttttctatttttacctgggctgaaaagtcgatgacatagttttttcagactttgtctctgaggccagttagaagtatattttaccttgcaacccaatggatacacacaactgaaacactgtctacccttattttctgtcatgtattctgatattttctattctattttattatacagtagtccccccttatcagcaggggacatgttccaagatccccagtggacgcctgaagccacagatagtactgaaccctgtatatactatgcgtgaattttttttccttcttcacaatttcacggatagaagatttgttcttacaggagatcttagcaacctcagcatgcaatttattttctttgtaagtcaagagctttcaccttttcacttaaagctggccaggtgcagtggctcacacctgtaatcccagcacttttgggaggctgaggcaggtggatcacttgaggtcaggagctcgagaccagcctggccaacatgatgaaactgtctctactaaaaatacaaaaattagctgagtgtggtggtgcatgcctgaagtcccagctacttgggaggctgagacaggagaatcacttgaacctgggaggtggaggttgcagtgagccgagattgcaccagtgcactctagcctggtgacagagcaagactctgtctcaaaaaaagaaagcactttatggcttctctttggcatatctgaattgccaacatcactactcttgctctgtggagtcataatgaagtcaaatatgggttacttgaatacaagcactgtgatacaactatagtgaactgataaccaagacagctacggacagctactgaaagactaatgggacgttagtgcatacagtgtggatatactgcacaaagggataatctgcatcctgggcagcactgaatgggacatagcaagattttatcatgctactcggaatggtacactatttaaaaacttatgaattatttctggaattttccatttaatatttttggactgtagttgaccacaggtaactgaaaccattgtggataagggtggactactgcatttaatttaaagaaatcctagttccagcccactacattgggtttaggactcataatgggttgaaattttgatctgaaatatattgttgtgtcatatccatcgctccatcctcttccatagtatatcatttcattatttctttcctcaaacttggccatggcctctttttttaaaacaagagacagggtctcactctgttccccaggcttgagtgcaatagtgccgtcatagcttactgcagcctcaaattcctgggctcacgcgatcctcccacttgagcctcccaagtaggtaggactacaggtgtgcactgccacgcccagccaatttttaaatttttttgtagagatggggtctcatcacgttgctgaggctggtctcaaactcctggcctcaagtgatcctccttaattggcctcccaaagttctgggattacaggcatgagccaccgtgcccagccaccatggcctctcttgatcccaaaccgtcatgggctgttccctcttcctgcagtgctcgttctatctttaacctgcagtacttgcctcactgactcctcttcatccttggcctcaactcctttcttcagggagggtcttgctcacccctcactgtaaactcccacagctccttgctttttttttttttttttttttttttgagaccatctccctctgttacccagctagagtgcagtggtgtgatcacagctcactgcagcctcgacctcctgcctttcccctgctgaatgactgtcttccccattagagagagctcgcgagggcgggtgctctgatgccttactctctgttgaatttcaaaactgtttgtagaattgagttgaaaggaatgcctttcccccctttctggatgtcactgggatgtcctgtgtaacctcttcttccttccatctttccatccttgcccttcctagttcttggcacagctgaagatcatggactacagcctgctggtgggcatccacgacgtggaccgggcagagcaggaggagatggaggtggaggagcgggcagaggacgaggagtgtgagaatgatggggtgggtggcaacctactctgctcctatggcacacctccggacagccctggcaacctcctcagctttcctcggttctttggtcctggggaattcgacccctctgttgacgtctatgccatgaaaagccatgaaagtaagtcagagcctgcgcctgctctgcacagccctgccctcatcctaccccctcagctcattgtttagatccttctaggggcatctggacctccacctcattcattgctgcctttgacctctttctgcctccagattcccatccagggtcaccacctgaacctggggctcctcctctgccaggctttcctatacttccctgcttgtcctggctgactgaagagtggttctgctctggttcatgagatgaaccaaactttattcatactgtcctgtcagccccacagagtgactgtgaagatccaataagataagagctatgacagctggaaaggactccactggtccttttctcagccccaacatgataaggatggagctgagccttgtgtctgggggttgtagcagtgcccagctgctgtctgcccttctcctgccccctcttccttcttccctgctctccttgtccctccaggttcccccaagaaggaggtgtatttcatggccatcattgatatcctcacgccatacgatacaaagaagaaagctgcacatgctgccaaaacggtgaaacacggggtgagtcctctccatcttcatccagggcccagctgggtcggtgcatctgtgcttaccctcagaccccagggagggcagtctcaggcctcctgctccaaggaacacactcctgtctccttcttcccaggagagcagactggaagagcagcctgcctgccttgccatgttccctgccttcacccacctgctccctgccaggctgggcccaatttgtttatcccccagttctccagccctcggggccaagcctgccagtgtctttccccagggcctgctgggcctgttgtgcatcttgttgaagggcgagtaatagctttgtttccatgcccatactgctccccacaggcctgtttccctgtgggcctgaagccctgttctccatgtagtggcccccacagagatccagagccgcgttgccacctccccactgcctttcttctacttcggtgcaggcctggggttataaatcacaggagtggggccaggacagttcaggacttgtatgccacttcctgaggtggtctgctcagtcttggtggggttgggggtggtattcagctctgatactgagtaagaggcttctgaataccctggctccccccatgtgcagcctcctgattggggcacaggaactcaacctgaatcagcctcttgtgtattacaggcaggggccgagatctcgactgtgaaccctgagcagtactccaaacgcttcaacgagtttatgtccaacatcctgacgtagttctcttctaccttcagccagagccagagagctggatatggggtcggggatcgggagttagggagaagggtgtatttgggctagatgggagggtgggagcagagtcgggtttgggagggctttagcaatgagactgcagcctgtgacaccgaaagagactttagctgaagaggagggggatgtgctgtgtgtgcacctgctcacaggatgtaaccccaccttctgcttacccttgattttttctccccatttgacacccaggttaaaaaggggttccctttttggtaccttgtaaccttttaagataccttggggctagagatgacttcgtgggtttatttgggttttgtttctgaaatttcattgctccaggtttgctatttataatcatatttcatcagcctacccaccctccccatctttgctgagctctcagttcccttcaattaaagagatacccggtagacccagcacaagggtccttccagaaccaagtgctatggatgccagattggagaggtcagacacctcgccctgctgcatttgctcttgtctggattaactttgtaatttatggagtattgtgcacaacttcctccacctttcccttggattcaagtgaaaactgttgcattattcctccatcctgtctggaatacaccaggtcaacaccagagatctcagatcagaatcagagatctcagaggggaataagttcatcctcatgggatggtgaggggcaggaaagcggctgggctcttggacacctggttctcagagaaccctgtgatgatcacccaagccccaggctgtcttagcccctggagttcagaagtcctctctgtaaagcctgcctcccactaggtcaagaggaactagagtacctttggatttatcaggaccctcatgtttaaatggttatttccctttgggaaaacttcagaaactgatgtatcaaatgaggccctgtgccctcgatctatttccttcttccttctgacctcctcccaggcactcttacttctagccgaactcttagctctgggcagatctccaagcgcctggagtgctttttagcagagacacctcgttaagctccgggatgaccttgtaggagatctgtctccctgtgcctggagagttacagccagcaaggtgcccccatcttagagtgtggtgtccaaacgtgaggtggcttcctagttacatgaggatgtgatccaggaaatccagtttggaggcttgatgtgggttttgacctggcctcagccttggggctgtttttccttgttgccccgctctagacttttagcagatctgcagcccacaggcttttttggaaggagtggcttcctgcaggtgttccacctgccttcggagcctgccacccaggccctcagaactgagccacaggctgctctggccaggagagaaacagctctgttgttctgcattgggggaggtacattcctgcatcttctcaccccctcaaccaggaactggggatttgggatgagatatggtcagacttgtagataaccccaaagatgtgaagatcgcttgtgaaaccattttgaatgaatagattggtttcctgtggctccctccaaacctggccaagcccagcttccgaagcaggaaccagcactgtctctgtgcctgactcacagcatataggtcaggaaagaatggagacggcattcttggacttcactggggctgctggattggatgggaaaccttctggaagaggcagatgggggtcaaaccactgccttggccccaggaaggggccataggtaggtctgaacaactgccgcaagaccactacatgacttagggaacttgaaaccaactggctcatggagaaaacaaatttgacttgggaaagggattatgtaggaataatgtttggacttgatttccccacgtcataatgaagaatggaagtttggatctgctcctcgtcaggcgcagcatctctgaagcttggaaagctgtcttccagcagcctccgtggcctcgggttcctaccggcttctctgcatttggtctgctgatcatgttgccataatgtgtatggaaagtgtaacacattcttactggttaaagacgactaccaggtatctaacttgtttaacattga

SEQ ID NO: 35768 - DNA, 180263 bp, Homo sapiens
ggcggggccggccccgcagggtcttgggcgtcggtcgtcggtggggtcggagctgggcgcggagcccctcacagtgcaggtacggaggcgcgactctgccaaccgtctgctccgccggccccctacgtgttcgtgaggttgccggcggtgggctggggaccgagcccggtgtgcggggcggggactggcaggggtgggcgcttgtcggggtccgggggctccgcctgagcgtttgccccgaggccggtctgacccacctcagctcttcagcctagcattgttctcctgggatcagagtgactgcgccttagagttcctccagaactgcaagggtctcccctccgttcctgcgagcgtctgaggcgcccctgaatccatactgagctacaggtttcctgtgggcacatggttgagaaattcgtctcaaacggggagaaaaatcgtaaaggactcacagcatgggagtctggatatgacttgtgtgtgtgatcctactcctggggtccgccttagctggcaagatgatccttgaggtcatcttgcgcatcccttgtctttagacagaaccacagctaaatcacacagataaggatctctgctgtttcagaggcagggatttgaaaacttaccgtcatttattgcagtgaggagagcagcaaacccatgttgaccactggctactcaggtatacttaaggtaccgagaggcgaagagctaggaggtagagattgacatcctttacttaatgtactgccaaagcctaagctatgagatgttaaaagagataatgataactttatttttaaaaaaggcattttgttttcgaaagctgttggaaaattcgtggttaaactttactacagaatattgcagagcctttaatatgctaataatatttaccatgaatctccaactgggggtatggtatgtagaattttgaaaattttactaggatatactgttattcttgggtgatgcctctggctaacatgtgggaaccgtttgggaattggagttccagaattagaaattcaggatttagaaggggcagtatgggtcagtgcgctttgagttttaatggcgtgcacatgtaatgcgatctcgttacagtacagattctgattggttctgcatttctaacaagttcccaggtgatgctaatgctgctggcccatggaacacaatctgagtagcaaaagtatagatcactggattgaaagttagagaccatgttttccagaacagatgtgctgccttgagagagtcactttatctgtccaggcctataaggtaggagtctggactacaagatctcaaatatttctttcagatttaaaattctgtgagtctagtcgagttatccctgtagtgttgaattctatctgaaatattcttgccaatttggcaaattttgcagcttggcttgaacatttaaaataatgggcaattatctgcatatagggcatcccattttattcttggaatagctcaagaaggaagttcttcatgttgctgaaatacatctctgcaacttccatgctgttggtcctagattatctcttaacaatcaaacaggaaagaagtgttacccgtcttcctaaaatgttgactccaagtattagatgacagctgtgcctactatgatttttctaagcggaattgtatttaattcttccattatgtttaagaaatccctttcttaaatttgtctttgttctctgtggagtgtagtggggctttggctggactttgaaggatgggtgtggcttgcaagactagaaaagtatcttaagcagttgacactggtgcagagatgggactgcatctgttgaatccaggattgtttgattatagtaagaaatgagattatcagtgaaagatgtcgggcagatgggtgtagggacaaagcagtattttagcagatgtatgtgctttactgtgatgtataaggtggttggaactagggaaggagggggagacggagctggataggcttcacatagcaatattagacaatttaggttgataataataatgccttatatttatgtatgacactttacagaacttttcacaggcatgatttcatttgatctaatattcctacgaggtaggcagagcagctgttatgctgttttgtagatgatgcaccaaagagggtaaatgatttgccttaattttcaaagctattacatggcagactgaagtagtgatagtgataatggaggagaaaggaaagatgcaggaggcagtactaaggacgaattgataagtggggcctgactgaccatgagggtacaaaggagaagaagttgttagggaggagtcaaagtagttgggtgaatcataataccattgagaactgccactctaggttttactctgccagctctatcattgctagcagctgcttggagttataggttgaaagggattatagatgattcccaggttgcttggcctgtctacagctactaggtgatactgggggcacttgggctatctgtcccataccaaggaaaataggaactcggtcctcagtgtcccctgaagatgtaagagctggaatattgccagattcatatctatattaaggtccttgccatcctggagactctgactttggctttgtatcattttccttttgagattcaggctgatgttagttgaatgtgatcaagggacaggttagctatttagtctggcctccccaagggcttcactacagcagagcatgggcccttgctgccccaaatccttcctaatgctgtttcccaggagatttgcacctcacctagagctgtctctgtggttcttttaccctgaaagtatacaggattgagatttagtgtcactaccaaattccataggacctagggctgttcctgcacttttagtttcttaggcttctgtctggagtggaaagagccatgtttactgagggttaggggagagatgtgtgtgtgcgtacatatgtgcacataagtggtgatttccccagtggtggtggtcttcaagagtggagctactctcagggaaagctgtcagagccagtttatatcctgagtgtgatgttggtacaggcatctattcaacattgaataccttctctttgcaaagccctacgccgagtgcttagatactgagatggatacaatcctctgtcctggaggaattcatagtagagtaagagatgatattttaaatagaatgtggtattgaaatggagatatgtctcaagtgctctgtgagcacagaggagggaatgattagctccacatggagaagccaggagagtctttaggaaagaggtgagaattgggctgagccttgaaggatgaggaggaagaattgtcctggtgacatttgtaacatttgcagatgcataaagggaaaggcagatagatccaagtggctggaataaaagagaactttggtgattgatgcgaccggattcataatgaagccatgttgttttattttgttttgttgtttagagatggggtatcactatgctgcccaggctggagtgcagtggctattcacagacaagatcatcacgcactacagccttgaactcctggcctcaagtgatccccctcagcctcctgagtataggtgggtctgcaggctgctgtgccagtttgaggccagttttttgttttgttttgtttttgagatacagtcttgctctgtcaaccaggctggagtgtggtggtgagattttggctcactgcaacctcctgagtagttgggactatagctactacaggtgggactacttagcctcctgagtaactggtactataggcatgcaccaccaccacacccagctaatttttgtatttttagtagagacaggctttcaccatgttgtccaggctgatctcaaactcctggcctcaagtgatctgcccgccttgggctctcagagtgctaggattacaggtgtagccactgtgcttggtcaaggccaggttgttaatggcctgtagtgcagtgctaaaaagatttcattttgtgggcagagaagccactggagacttttaggcaggaagatgacatgattgtattttgggaagctaaatgtggaaattgaagggggagaacctggttcagggacatcgggagactcttgtaatatcatagacatggtttagggctgagctaaggattaggtcagtggggatagagaggacaggatgaatctgagagagactggagaaacagaattaaccagacataatgactaaattggttgttgagaacaagagagggagttgttgcggatgactcagttttctattttgagtggatggtggtgccaatagcaaagagagaatatagaagaagaacttttttttgtttgtttgtttttggtgggggagataccaagtgtgttttgggtcatattgaacttgagggctctgtggcagttagcagacagtgagatatgagtctgaagttcagaagagtttctgtctaggggcagtaagtatgagtggtagttgaagttgtgggaatggttgaggtctcccagccacgcttacagaaggctgaaaataatgacagaggagatgagaaggattgacgtgcaagggtaggagagaatgttgcccaggaagctaggaaaggagaaaattccaggaaaaggattgacaatctcagttgctacagggagatcaagttaggatgagcttgggaaatgcaccttgaggttgtgtaggacattggggtcaccagggctcttttaaagtgtgagcagcttcagtggagtggtagggatggagccagatagcaatggatcgagaagtagatgggaagtgaagatagagaatgtgtactcactttgagtagttcagcagagaaaggaagaatacagaatggtggcagcttgtggaagaggtagcagggacttgtttttcctagaatggaagtcttgtttatgggttttctgatgccatgtaagatccagtagacagggtgcaatgaagacacaagagaaaagacgattgctaaatcaagtcctcagaggagaggggaaggggtgggccctgaaaagaaggggataccattttctttaaagaggaatgttggaagaaaggaaggaatttaggaagaaagagataatgacatatgcatgcagatatatctaaattttcaaagaaattcttacctaatagggccagttttctttttcagcaaggttatctgctgagaggtgggaatgctggtgttggcttgggtgggagtaaggacttgaaaatgtaaaggaagcttgaaataactgttaagaggaaagaggaagacagtggaactgaaataagctccaagagtgttgagtaccctctgaactgaaatcctacactataagcctccccttcatctttctcataataataatggctgacatttattgagtgctttatacaaggcactgttctaagtgcttttcaggcattctcatgtgatttttacaacaatcctgttagaaagttattgttattatccctttcttccagaagaggaaattgaggcatagaggattagtagcgcttgtatttgatgaatctcttacgtctgcagaaatggattccttttcctgaggcatcagagaagacagaaatttaatcccaactcccggtttctgaaccttgagagcctagagtctagggttgctaaggagggaatcttaccatgccagtttgtgggcatgatggtggcatggagggggcaggacagtgggatcactgttgctgtcagcttttgacaactacatagggaaactcggatattcttgagtgatttttccagcatcctgactagaaagacaagtgaccgatagtgatttgtcaggtattgtgggctgagattgtgtcatctgagaggtgaataagaagagagaccttgtccctgttcctatcacctagaaaaggagaattttttcttggcagagagacaggcagatctaaaaccttatataataacataatgattattaactcaccttatgtgttttctcagtttgtgtgacagatacaatttgtaggtaagctgtatacctgacttgagtgaaaggagagagtgatgggatggcgtggatggaagagaaacggacttaccttttcctgctgcagccactgaagcatcatctctgtgtccttccttttgaggttgccatggatacgcctttgcatggtggtttgaggagattgatttccattatgatcagatgatgacgtgggtttaaaaagagaaaggatggaatgctctgcttttggggagtggccggcgagctgcccaaaaggcagagcccagtacagccgatagggctgtggctttgttggctgctttggcttttgctgaagttgtgaaatggtgcatctctctctttagagcgcaggctcagggttccctgtctacagggtcctagtgccaggaacttgctggttgattcagggggaggaatcagcaggaacttcgaacagcctaagtaggacttctgataccactgagaggattgaggttcttgagtgcagggctgagtgcctcttgccttcttgcagaagttcctatattgaagataagtgaagcatatagcatagcttttcttcttgacttttagaggtctgggcccttggaggtgggcctggaagtcactggatatttctggggaaaggggacattttgagatggagtagagctgcattcagagtgggagtgggtttgtagacgtttttttagggtaatgaggagctggagaagggaaggaagtccgttgagtgtgtaggccttatctatgaaatccgcaaggcagatactgagtaggacctaggaacaaaaagctctgtgtacgttgtcttctggggtcctgtgaatatctggaatccagctttccaagcttccagtctcccagcctccatttaccactcagtaagcagaccttttcctttctgactcctgaaggacttaggtccacgtttatctcttccttactagtgctttcagagatgtatagttttgccttgctgtcagactgcctgggtttcagacaagctcctctaggagtgggaaagcagggaaagcagacagttgggttagcccaggatcaaggtttgataaggtgagacaagaggagatcaaggtatcaaaggatgctggggtgccagtaaaaacaaggtagaaatggttcagacaggggagaaatggtagaggtggaaaagaggcttttcctcctcactttctcctttttcattctccaaaatcttattttcctataatttcctgaaatttctctaagactattggcagacacagagattattatttatcagacacagagatttttcccctcctctcttctcatttttctagatattttagtggtatttaatatcattggagaggaaaatggattagaaatccaagaggtgtctgtctcctccctggctggggtaacattaacccaggattgtcctatgggatatgggcctgggcccggtaatgctgtggaaggagcacctacctgtagagatattcagatgtgcccctctgccattttttggctatgagacttgggcaagtcatttgacttctgagacatagttctgtcatctgtggaatggagagaatggaatctgttttggctacatcacaggttcatttttgaaggagatagtgaagtacatgtattcgtgtatgcaattaagttttccccagagaaggccctaagaacaggacgcattttctctctcctaacatgttgtttctcctcccatttttttcagttctgttaatgtttcaattattacatttctcatgcttgaaaactcctgagtgtatttattcatttacttattcatgcattcattgacccatctatttatccttgcagcatttgagttcctactgtgcgcaagtcatcgtggatattcccttaaaataatgaatgaagatgatatctaccatttgttgagcacacagacattgtgctaaacgctttacttaaatcttatttaatcttcaaaatgtccctgtgaggtaacattatttcttcctttttgcagttgaggtaaccgggactcaggaagttaaatatcttgctcagaggagaaccaaaggtatattcaggtctgtctccagagcccatgtaggcctgctgcctctttcctcatgtttgatctattacaaggccttctcagggcttttttggtactgtctctgaactggcctctttcttctcctcctgatcctggttcaaaccttccttaccctgtgtcaaatgttgcagcagcctccttgctgttattcctgtctttgccaggttgctcctgcctgcactccatcctgcaggtgtcatcagtttgatcttcctaaaatagttttcactatgcagtctcctgctcaggaacaagactgccttcctgttattattggatcaagtccttctctgtctgcctgatgttaaactccgtgcctacccacagttacctcccagtatgttgcaatgttattcaataaatgtttattcaataaatatttgaccatgagctacttactggctattggatcataaagaggaaaaggtgtgggctatgcttcaaaaggcttatagtttgatagaataaccatctacaattcgttacttcagctaagctagggttctttactattcgctagtcaagcaaagttatttctgcctctgttcatactgtgttcacaagttacagggctttgtaggcctttccacatattttttatttttattttatttatttatttttttttttttgagacggagtctcgctctgtcgcccaggcgggactgcggactgcagtggcgcaatctcggctcactgcaagctccgcttcccgggttcacgccattctcctgcctcagcctcccgagtagctgggactacaggcgcccgccaccgcgcccggctaatttttttttgtatttttagtagagacagggtttcaccttgttagccaggatggtctcgatctcctgacctcatgatccacccgcctcggcctcccaaagtgctgggattacaggcgtgagccaccgcgcccggcctccacatattttttaaaattcccataattcaaggcatgcttaggtactccctttctttctagctcacctctctcctgtctataatttcttatatttattgtgtagatgtatataccatttagtatcatgtcaggtaattctttgcagttctataatttctgtactttttacaaggtgcttttttttttttttttttgagtctcagtctgtcgccctggctggagtgcagtggtgcgaccttggctcactgcaaccttcacctcccggcttcaagcgattctcatgcctatagtctctcaagtagctaggattataggtatgcgccaccacacccagctcatttttgtatttttagtagagatagggtttcaccatgtcagccaggctggtcttgaactcctggtctcaagtgagccaccggcctcagcctctcaaagtgttgggattacaggcatgagccaccacacctggcctacaaggtacctgtatatgctttagcttttttgaacctcatgatactgacgtagatatggcagatattattttcatttcataggaaaataaacagattccaagaaattaggggactattgatacctatgtggttagtgagttgtgaggctatttttagatctgagctcttttgaattttttaaggcagtgtggcctacaggaagagcagggccttggaagcctagatatgtctgtggtaatggtgaggggtagtagaaagcacagagggctctgggtcaggttgtttccagttttggctctactcctcacagtctgtgtgtcttcagggaagttgctcagttctcaaagactcagttgccttgtcagcatcatccctggccaacctctcaatggggttattgtaatgtctatatatgatgacattgttcttagctaacttttatttagcacttattaaataccaggcggtgtcctggatgctttgtttggattatctcagctaatcctcacgatacctctctgagatatgttctttgttacttccctatgacggatgaggaaattgaggcatagagatgttaagtaactagaccaagtttatgtagctaccaagtgataaagccaggaaagtagcctgagtctagaaccagtactcaaccatggttctataaaatgtctttttttaaggtgtcctatagactgtaaagtgctccgaacatgtgaggtccaggctgcaaggatgtgcctggccctgcccacctgtgtaatggcgaatagggaaaggagggggcgacatggagattttgcagggaggagagagattatttcctagggggtctggccaggactgaagatttggaattgtgttttggggccatatttctgaatgttggctgtcattctcctgttgggctacctggcctatcttaagagggtagagcggggtaaagtcactgttctgccagtgaagtaagcccagtgcagaaaagacaggcgtccctaggcccaagggaactagatccataccatactcagtggagccataggtcagaccccaggccaaccttgttggctgtgtaggggcagggaccctggtcttttggtttctagcccatgatagatgggccagtgaatgaaagcagtgtggtaacatagtcccttggagacctctcattagaatgcataatctcattaaattaaacaattctaattataaaagtaatacatggttactgaagaatttttgtgaaatacaaaagcgtagaaaataaaccatttcattgggtctgagatgctaggaggcaaggccaagagtacaaggggcagatgactgaggtggactgggccttgtgctacaagaagaaagaagggctctctgcttttgactactgcctttagtaatccagttgagtctgatactcttgtgttttacaacctggccccttataacaaccataaagggtgaagggtgactatggcaacctttgccagccttgtgggagggggctagggtacttggcttgctttgctatgtgtgtgaagttgccttcattactgcccttctcttgctgcctcctgggcagggcctgcctcctctggctcagtgtgagattgaaatccaggccctactcacatgaatttggaccctgagtccagagtttagagaggggagggagagagaagagcaccagaaaggtagatgagagacccttattttggctgtgtggaggctctaggcagctgatcgctttgaagtgtcacttgatgcttatgggcctgctgaggccttacatcctgggggagaggggaacagtgatggtgagtgggtacagactaggaggacgtgtcaagactgcttccagccctaggacagtgtattcaagagttgagtgctgagggtctgtggcgtatgcccagcccttagtttctggcccacgtgaagcaggggggcactaggacccagaggctagcacggttcctgacaagtctagagcagcactagcgcagagtgagactcatcagctggcaagcaggattctgtgtctctgggttcaggaatcctcaggcagcagaggggacttgctcctcagcccccatcactgcccccacccctacccgtgtaggccaccgagtgaggcccatggactggggagggctgtgcctgacgactcctgtgtccctctatgagggcccagcgccctgaccctcctgcctaggtttctaccttttctctctgtctttggccagctgggggagggggtagaggccgggtgagcaacatggcacagagcaagaggcacgtgtacagccgggtaagtggccctaatctgggatggccctggagggctgctggggaaggcctggctgcctgtggacatcattgctgtgggggctggggagataggctggagctcagctgagggcactcagactgtgttttctaaggagccctcgaagccctggtggtgtaaggctggacaggcttccctttacagagttgatccctaaatggggactagcaaggcctgacctctgactctaattggccctcataccaggggctcctgagggggtccagactatcctggggactcagaatggggatgatggctcagagaggtcttacagtgaagcctttcttaagagctgctttgttatttgttacttgctttctttctcttctgagatagaatctgtagctactgttgtggccccctggttctgagaggcttattggggttggaaagtgggggagtctctgactttgggttcagccttttatatcactggcaattccttttattgtcaggtccatgagagccatcctgctgttccaggtgtgatttggggtcctggagcctctgggaactacatcctcaccttcctggatgagctgtttggggaagggaattaggcagtgataggctgggaggtgtcctggctcttccctggctctgccagggctcccttctgaagctattataaatgagagtatcagaagggtctcccatagagtctttaggatgatggtatcacttcatcatgcctcattcatctgtttgctgcaaggcccctggttcatggagttgctgttgctaaaaatgacctaagtgtgattttcttctaaaccatgggcctatttgggacctaattttctattgtgttcagtcatcatgggtgtgccgaagctaagagctgcccaaggacagtgtcttagtctgttgttttgccttgcccatctgtggagtgataaaccattcatttggaccactgagcagagtcttggggacagagcgaggggtagatccacccaatttacttggcctgtgttttcctttttatagcaacatagcatggagaagaatctccagagcttggggatagagagttgaccaaacaagactcaggccaggtagaaggggagttgaatggttgaatgggctgtggtgaagcatctggggtttcatggtgggtttgtggatgggggtgggaggagtcagatcaggaaggagaggtggtgacttaagggtctggaaggaggcacaattgtgtgcctctgaaagggtgaggcctaagaaaaccatttgaaacacagaggagacaagtgacagtggaaggggaaacaggattctgtaggatcacccactgaattgcctgtcttcccagctcagactcctgagtcagggcattgggttgtggggagcctggtctaaactgagttatttgcttgatcttatttcccctcctgagaagagaattaaggagacagtgctcctgagaaagcagccatgtggtgacattcacagactggtcaatgaattctgatttgttataaaaaatataaacttaaaaattctagcagattccagaggaatttggagaaatcttagaatatcattggcattttttcaaaggggaatttgggggtccacccaattctgtaaatggggtttaagaaaatgactctggttgtttttcagtccagcatcttggctgaggcatttcttatacataagaatgccacctttgatctgaggcctctaactgtctgtgtttacctgtgtctttcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccaggtattcacgcccttcttttgtgtctgtgcatgtgtgcacatgtctgtcgcatgtgcagctgatgtgttggtacttcgttttcctgagcatgggcataagcctctggttgggagagtggaaggtagtgggggagggaagattgaagatgcatccttagggaagctgccctgtactcttggtttgcttggagcctggggaggggcccatattacagccgtccttgatctggctatattgaaactattgatctggctatattgaatctggcctcagatccaggtatttgaagatggagcagatactacttccccagagacacctgattcttctgcttcaaaagtcctcaaaagaggtaacaaccacccacttaaagttgcctccccatagccaggaggagtccccaggacttctcctcataacatggggccacagtagatcctaagatttttttccgtcactaccatattcccttattatatctccccctacctctctatacaagtacacactttgtttctgtttgctttctacagagggaactgatacaactgcaaagactagcaaactggtgagtgatttgggggtgggaatggggaataataaagggaggggaaggagaaagaggagggatacccagtgctaggcaggtagaagtagtaggtgagtctgatttgccttctagtctctccaacttccctaagaaggaggctttctggggattaattgctgtgttagagttacagtaaagatggtagaagggaaaaactcataggctccagaagttcagggtcaaatgagattgagctgagggtgataggaaggacaggtctggccctagtagtgtagccaacttcctaccttttggtacccaaagatgccaacatctaaagggtctgagggtaaggttaaggtagaagatagaggaagaagcaatctcctattcacaagtgaatggcaaggagccgggccctctgcctcctgttttaagctggatgcagagagtgcttcctagttcttctctgctactctgtgcaggatgtgtgtgaggtggggctgcagactctgcagcttctctgggccaaggtgtgaacatcctggaagctgatctttgaggggctactcatctcaccctgactcccccctacccgcgtctaacctgtgtaagcccgagttggtcttaacacctatgcccaggacatctgttctctaactctgccctttcctactcctcatgcagcggggactgaagcctaagaaggtggtgtgtttactatttgtgcctgggtggatgggggccatgagccccttccccagctgtcctgcatgtccctgggctgctgcatgcatgtgtgtgtgaccttgggctgggatggccagaggaaatggtggccttggctttcagagttcctttgaagggtgcaagaacatcaggctcagtgtccatacccaggtagcactcattagggatgattctctctgccccaggactccaagtcaaagattccccaatcaaaaactataagcatttgactgtaaatagcagcagtgtgaaatagatcatttactgggttacagtgtgttctcacttagcccgagcttggacgactgtggaaggatagactgggggaatggggctgaggaaggtaccaagtgagggggttttgcaggaagatgggaggtcagggaacagagcctaggaagaacagtcccaagttggaaaacctaagagccttcatgtgcctgcctgtggatgggcacagccataaatatccccacaccccacaactctgccccatcagtctgtccctgtctccttcctctggtggtgtgcctgaggcctacctcctaccccttgcagcctttcatcaaccatcattggagtggggctcaatcatgtcacgtcccctccccttcccaccatagactctttaaactcttagatcactgccatgaccacttcctcaaaccagcccctgccttgggcctctgcccaagctgtttttgacctgcatgtgcctgtctggcctgtatgtactgtgctgtatgtacaattctgtgatttccttgtcgtcagcctatctcaggccattctgacattgcatggagagctgctggattggggctgtgggagggaagaggaaaacatctccttttccagggggaaaccagctcctggttggtgatgggtcctttggagtcttgccatggtagagaccacatgctggtacttgctttggtagggaatggggatataaggaaaataatgctgtgaaggatcctgggcccatttcagagtcatagaaacttggctttgtcctttgattattgtctcctggttggggcttccatttcacctcaggccttgaatagagaagagcatgaaactatggtctgatatttatggagttctggccccagcctggtctgaccctgggctggggcctgagcaatgcccaaatccaggggctttggcagctgcctggggaaatgtgaaaaagcccagcctaggccacccatgctgcccttctgcactcacgttggaaagtgtcaatcagacagttgagtgcccccaccccggagcaccccagtcttcctctccagtagttatttttcaaagcagagggcccctgctctcacccatgtggatcagggagctggttccagagcaaaagaatatgctttgaaggggaaggcagaagaaaactcagatgtctctgcaaagtgcctagttctttttggaaaccctttagagacaggctttaacctgtctacaaccaggggatggttggagaggagcccaacagtcattagagctgctgctacccagatgcgtgttccgcagggtttcgtagtcactgtgtgtgctcctcagagctgaagcctgttgctggaggggcactctagatgtgtgtgccagatgagagactgtaagggtgttgccaggttgtataagagacagaagtggagttaatggggctgtgggtaggtgggtggcgggggcagaatgtgagtatgatgagagagactgctggagcagagaggccatgtgtccctccccagtgatgccctggccccatagaatgccatttctgggatagcccctggcccagttttttggagcacgctcttgggggtgggcaagggagggaagagaggagccaaaacctgttctttggagaaagaagcaggacaagctctgcgcatgactgtcatgaggaggaggagccagcaaagccctagatggttgctaggtgactgaggagcagtggctccacccccatggagcagaggagggtgggtgcatgacgtcaggtggagctggtgctgcggccactgaggctgccatcagcctaagctggtgaactgggccaggcaccgctccggtgcctgccggagcctggcgatccagctgcacgtctgcgggggcctctgtgtcagagcggcggccgtttgcaggctgggaagctgccgcaccgggaggctgagactgcattgttgggatttgatgcactaatctcctgtctccgccgcctttccctctgttcggtctcttgccctccctcccttcgtctgtccttcctccgtgtgtttgtctatcctcctctgtccctcctctttcctctccttgctttctttggttttctgcaatgatgagacaggcaccgacagcccgaaaggtactcttgcttgctctcgtcctgctgctgggttgccagggcaatggtggcagcaggctgctggggtgggggtgggggctgattgacttcatctgtctacctggtcggggaggcgggtgaggacgaaggtgggttagggagaggtgtgtgtcaccactatgccccacaccctgggcatttgcttactgccttgcctgcttttggctctgcctgtgttccaggccttaacacccagtggcctcacaggcttgggcttcaggcagcctctaccgcataccggatctgggagggtttcctgtggtagaacctagggaagcaggcccaggtatctcagtgcctctagcaggcctgcctgcctcacccaacctttgctagaatacctcttggttgttctcccagtatcccccaatccccaggatttgtatcagggcactttaccagggtgggatggggaacctagaatagtctttgacccacagctgtggaagcttagcccagggtagaagaggtgggaattggcctcagtgtatgctggaaatagggcccaagccaaatcttgtcttggctagagcagtgagatactgggtagcaagaacactatttggaaattggagttaattgtccacttaccattttgcagtaacctgaaggggctgtagtttctctgtgctgctgcccacccccacctcctttcctacagctgggtggggttactttgctgagctctgggcttctgctaatgcaatattcatggtcctgacacctgagccctcttccctagtgatcgggactgctgcaggatctggttctggggaagggggttgggggagggaggacagcagcattgttctaccctagggacctgatctcccatttctgggcttagattacgctcgtcacatggggtttctagggagttctgtgtagagtctagcacttgaaggaagaggctgacctgggaaagtccttgggagtggtggctgggcggggcctctggctctggactggagttggagagatcgttagcaggaggactggtctcatgggaccttctcactagctgcttccttgttctatggctcagcctagagatggacttctgggatttctggggtgtctgaaggggtgaggcctgcaaggattggacaaaagtgggagcaggaaccaaggggaacaggaattctgggttcctgaagtaggaatacagtgattcactgaagggagaaggggatgggatgggggggagggtggctaactgtagccccattcctgttatttcttctgctctcattgctgtcccttttgctctctgtctttctgccattgtcctttctttcctgactacttctcttctggctcctgttgcctgtccagaccacaactcggcgacccaaggtgagaaaacaggcccctgtgtgagccactgctgagtgtacacacacgtttcaggcatgtggatgtatgagggcacgtgtatgagcaagtgaaagttcgtcatagtgtatcctgggttctcttcagaggaaagggtgggggttcgcagtgctggcaggcacctcctggggaaaatggcttttggcttttaggaggttgtctaagccagtagcttgaatgcaaaagagaaatgaatggggttgtggtggttaatcaaagcaggctttcttgaacaagggaattttgaccagttttgatgggagggattggaagaaagatgaacttggccatgtaaaatgtcaggggataaggaggtgagtgtgtctgtgacaggccttgggtggggatgtctgaggattgcacatgatctctgagtgtcagcccactgggagaccttggggctcagcactttgagcacattggcaggcctgtctgctccagggcttgaacttcaggtcagctcctctgcccaccttctcccctgccccacaggggcatggatagtgttgccagatcgggggagatgacgaagagttgtttcaagggggagtctaggggtacaactttcaccttggcccttttacctgcagggtcctctgaaatagactgagagagggagattcagcttgactcccaaagagggcttagcaggggtagagagcctggcacccccacttttggcccaaccttctgtggaaattagattgtactttttccgtctaggggtggagggcatagacctggagcaaggatgggactgagagtataatggagttgctagaatgatcacaagtgggtcatagatgggggttctagggaataacggattctgctcttaagggtagtgccagagctaggaggaatgtggagtcagtgccaagcgaggagccttataatcttatgtctttctcttatcttttcctccctctctcctctgcctccatcctccccctgtcctttgtcactatctctctctgcctctctgtatcattttccttgtccccttcattcttcttttctcactgtgctttgatactctctttctgctttttcccttttctgtctccttcccttgccatattctcatattctgtttctgttcctcttactacccctatcctctgctttctttctggtctgcctctaccctttctgaatagcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggtaaggcctggggtaggggtaaaggagaatcaagacacccagaggcttgtggctacccgctgtgtcttgaaaatttcctggggttggcaaagacctagaacttggatcagaaagggtgaggacatagcctatggatatcttgctactgactgagccatcctttcctttcttgcccttatgccatactttccccatatatactgtgctacggtttcctctcagatgttcttatgccactgactgttggccaccctggggctgggtgatgtttgcacactttcttgtgttctttgcgccagctcagtgttggtggagaggaggagtgggctgtgcacagaccgtgaggcctctcctttgcaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggtttgactctggatgaagggggtggctggggcagcctgagacctaaggaagcatgctggaaactagactggagctggagcctggaacatactgtgagaaaggcctggggcatctctgtgctggtaccccctcccacctccacttcttcctcaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggtaaggggcccacagctgctgggggccaaacggtcaggtgagaaccatgcctgaaagtgttaatgatcttctccaggctcagatggcgctgcatccagttatcagctcaagcagcttgaggagcagaatgcccgcctgaaggatgccctggtgaggtagggtcttcagtgcttgcctctgatgcttactcttgtgtctccaaatgtgttagagcacccatcgccagagactctgacacgtgctttcctccttctgccttcctcacatccctgcaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtctggggagcccagcccctcacccagaatcccccacctgactctcctatcagttgatgcctcctctttctaggtaccttccagcagcccttctccctatcctccccgtaacacaggtggatgctgctctgggtgctgaggagatggtggagatgctgacagatcggaacctgaatctggaagagaaagtgcgcgagttgagggagactgtgggagacttggtaagagaagagcagacccctgacatctgacttggacctgctgagaaaaagattgacatgtgacccttggcctttgagcagggtgtgcggtgagggacccagcctgggcttgctaccctgaccctgccttttttttttttttttttttctgagatggaatctcgctctgttgccaggctggagcgcagtggcgcaataatctcggctcactgcaacctccgcctcccaggttcaagcgattctcctgcctcagcctcccgagtagctggtactacaggcatgcgccaccatacccagctaatttttgtatttttagtagagatggggtttcaccatgttggccagcatgatctcgatctcgacctcatgatccgcctgctttgacctcccaaagtgctgggattacaggtgtgaaccaccgccgctggccgaccctgcctttctttagcccaaactatggtgtggtgtcctaggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggtacatgcccactgtttgctctctgcccaccatcaccccagggcttccttatgacccagctgtgcttcactgtctctcctcctaggatgtgaatcgggaactgacaaaccagcaggaagcatctgtggagaggcaacagcagccacctccagagacctttgacttcaaaatcaagtttgctgagactaaggcccatgccaaggtcaggaaagtgtgtgggtctgagggagccctgcctgggatgaactggtatggggtctgggcttcagattcctgggggaaggggtgctttgtgtggtggtttggaagactctggcctgggcttgccctagaagcaagggatctactggagcaaggcatgggaattttggggctctttcagctctggctaagagtcctcctccctgttcacctcacaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggtatggccaatcaatcacatgttccacagaaatctagtgaacttgccatgaaccaggcattgaagatgctgagtgaagacaacagagtctctgcccacaaagagtttatggtatagtggaggaacacagcaaagtcaccgattaatatatattacaaatggtgtgttttcaaggagagataggttctgtgagagagcacaattagagatttgatttagaggtgagcagggtgtgactgagggaataacattgtctgagggccaggaggtgcctaggggttaaccttggggatgatgggcaggatagcattctaggtggagagatagcaggagtggcagctttaagtcaggaaagaccttgattccaccggtcccactaccctttcattttcacatcctgactcctcacaacctccagtaatcacatcactaccctttccccatgcaagattccccacccaggtaagagctatttctgctttctctcccatgtgtgtccatgctccccacatagttaagctctgagtactatattcctgagtctctgttctccatcctctgctctgaggcccaggttcctggtgctttttcccacaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcagtaagtgactcctgactccctcaccccagggtgggggtccaggattggccagaactgagattgcctggcagactctagcctcacagtgcccttctctggtctctagtgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcaggtgtggggcaagaatttgggcttggggcaggaggcagggaagctttcacttgatgggggctcttactaatatattcaaggttgtatgtcccatgcttgctgcttgaggcctggtttgctcttagatgaactctccatatgatgcagctgcttgagggctttggattctcttgtacctccagagacccatgatgaccagggctcaaactacagtttgggaagaactccccacccgctccagggcctaaaagttgtctgtctgttatctctcctcagcatctgtacagcatccaccttgccgaacagcctgaggactgtactatgcagctggctgaccacattaaggtgaagtatctgggccagtgattgagcccccgtggagatcagaaatggagggcatcaggtcaagagatcaggcacccaagaagtgtcacataagactagggcagagttaccaaagccatatcagggaaactagaggacctacttatgtatgggggtcagcagaggatggggacttcttagagatgttgataaggcagaagggctcctgctgggggctgatgattgcatgcttctatcctcacagttcacgcagagtgctctggactgcatgagtgtggaggtaggacggctgcgtgccttcttgcaggtgagaacacatctagatctgtgtgagctcctcttctttcttagtcctcacttccttactccgagccttaatgctaacttggttctccatccattttctttttcctgagtagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtttaaggctgcaactggggaagggaaggaaactgagtagaaacatgaagggtatagcacttgaagatctggatctggttaggggacaaaaatggttttggggtagctggaaactgtggtgctgaacccagggttgactcctgactctggcctggcacacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcaggtgggcctggatggctgggtagaaggtgtggggagagttagtgaccagtgtggggcttttacttctgcccttggctcctgcagatctatgggaccccctccagcagcccctatgagtgtctgcgccagtcatgcaacatcctcatcagtaccatgaacaagctggccacagccatgcaggagggggagtatgatgcagagcggccccccagcaaggtaggtggagatttccttggagaagttgcagaggcctgtaggagtaagacttgcagagctactgctagttgtgggaggacggggagacaggaggaaggcatctggagagcaccatcctgcctagaaggcagggttttccctgtaactggatctctctgtaaggagcacagtgatgatctcttctctccaccctcactttctcaccccctaccgaccattccttagcctccaccggttgaactgcgggctgctgcccttcgtgcagagatcacagatgctgaaggcctgggtttgaagctcgaagatcgagagacagttattaaggagttgaagaagtcactcaagattaaggtgagggtagtgtaggctcaggatctgggggccaggaaattggtaggactcaggaaagcagtgagtgttggggatcgggaccaagacggcttgggagttaaggggagaagtggggcctgcaatcaatgggagctgtggtgagccctcagggaacctactatctcatggtctagcccccagtttccagggactgtggggaggatgtcagggatctagaagttctgtccttgtccagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaagtcaggcactttccctggggccttgcttcctctaatcctcccactgctggagctctctgcctcctaacccatacccctactcaggttctcttatagtgagactccccattttctttacccactgccaaccccattgcatcaccccagcctaagcctgtgctgctctgccctggcttctcactggcagggctattccaaggacctctcaggactgaatagtcaaggagtgctttagagaagggacactgccaaagcccagattctctttcacagagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggtgagtactgtggaataggcagcactagcacagaggagattgtcttctctcctgtccttggcctcattttgacctctgccccaccccccttacccccgggtattcagccaggaacatgcttacacagtttcactctgtgccagttttcaccaagttttcccttccgctgaagatgtgtgctgagtttctctgggcaaaggagggcattactaaattgttaatgaggctcagaataatgatgacagttggtctctagtagatgtcctttctggctctgtaatctgacctttctgcccagccctatatcccagagggttgtcagccagcagcaggctgggctgactctcctggggcatccagccctgcccgatacctgctcttgattgcttctctgcttggacactgtgttttctcactgagttcatgtggcttcattttatgatgtggtcatatcttccactgctgaattatcccagtttcacttggggcttgtgttttgacctttgtctagtcactcagtatagtcagggctcctcacctagagtttttctggttaccagttctagcctccccagttacctgactcaggaggtggctgctgctgtctttgttctcctctgccctatagtttgttttgtttactctccagtttctcacttaaccttctcacctccagaagacaggctttttgccctggaattaaacccttagggcctccagactttcccagctgctcctgagtcttgtcagctgacctcacctacatagagtctttgacaaagtctctgttactgacaccccttgatcttgggaggtgaccaagtaccttcttgactttaggctcttgtggtacagacagctctgtgttctttggagagagtttccaggattactactttgtgttgtttttagcactcttgaaacaaacattagcactctttaaacaaacatagttctgaatttatgaaacttcccaccaaaaaagaaggtcttttgcctcagagcaatggggaatccttaggagcaagggagtgtgtttgcatccccaacttaagctttgctgctggtgagcactaagggtgcagacatattggggtctctggagcattctccgtgcccttcttggagatggcatctgagacagggaggcaggaacagcctcatgttccaagtactttgtacagtgcacactctctttgccactgttcttcacacattgtaccctgtcttgtggcctcactcctgtttggtgtctttctttaacacttatctgctcgtccccaaagataggtggcagagagtcttgttagagaaagtatgatgattaggaaaagggttttcctgcaggttgtgtccaggattcctctggtgtgtccccgtaacccccaaatcacctaactcctctctcctcttttcctgctcccccatgggctatcccgagcacagaagaacagcagcgaggtagagacccactctggccgggggttaccaggctggtgggagttggagctaagggagcagggtggagggggaagccaggactggagatgggtgatggggggatgaggaaaggggaagagtaggaatggagcccaattttcaaccctttccacttggggctgatgagattttttatggtccccacaggagccatccctgggcaggctccagggtctgtgccaggcccagggctggtgaaggactcaccactgctgcttcagcagatctctgccatgaggctgcacatctcccagctccagcatgagaacagcatcctcaaggtgagggagccacggggaggactgggatgggagatggagcatatttgccccattgatgatagatgacaggggcctcctagcacctcttaccactatccttcttttttcatccacagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctggtatgtacctgccaacccccaagatgaataaaactgccccctccacttggcccagggatttagcccctgctcaggtggttcccccaccacagaagctcttcccagcagtgttctttggcttcactgttcagtttgtttgattcacccactctctctcaagtacttgttctgttagagagtcttatacctgcacccctaacccttaatccagtagaactgcctgcctgcgccttggtgggcctcaccagctttctctccccacagctgccaagagcccgtcggcccaacttatggagcaagtggctcagcttaagtccctgagtgacaccgtcgagaagctcaaggtcagctcagtttgccaggcagagctcacttcacagcataaactggtggagccaggcacttgtggagttcctctgagcccagccctgtgctagacagcaattggggaggagatggaagggaaggcagggttcttgccttggaagctcactgtctcagtgcaaacagaagacagattctcataacaaaatggataagctagggtaatctttagagtgactggttcaggctttagcttccatcagcgctgagatcattgtggggtagaacggttgggcatggcttcccaagagcggtagaatgtgagttgggccttacaggatgaggacttgcaaagtaaggaggagtgctggtgtggggatggggttggagatgagagcaaaagtatgttgatatagaggactaagtccctgcccccctggtattagtgtctctgtgaaaccacgtggtcttgtgctagcctgtgggggtcccataaatgaacccttgtcttcctctccccttccctaggatgaggtcctcaaggagacagtatctcagcgccctggagccacagtacccactgactttgccaccttcccttcatcagccttcctcagggtgagggggagcatggggtggaggatgggacagtgtggagagctcaggcgggcccccctctcctccagaattggaggaggcctttggagtctcaggtctaacaactgcataccttgggttatctggccaaattttacttacaagtaactcagaagtgcttacagtgctttgaaattccaatattttagcacctaaacaccttccgtgacttttgacaccaggagggcctcaaaactcccttgtcagattatgtatccccattcttatttgaaaaatgtggtcacaatagcccaggatctcagaagccctagtcacccaggagctgccttggtctcagtgctcagggaccccttcagtggcccacagctcaagtgagcccctgacctggagtctttttctcctcatcaaccaccaggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgcttcctgtgtggtgttgagagtgggacttgggccattaagctcacagcaggagtggaggagaagcgatgctgaggaagctttggctgtatcaaatttgaggtctcctcttcgtagtgaccagaagaatgctgtttctaaaattcatgtgcagtaagttactctaaccaaggaggaaagggctagacttaggactaggtacctaagttcatttatggagtcaggagggctgggagggtgtagcctctgccaaccctgcctctgcttcctgtagcttccactgctctttagtccaatttttggagctggagtaatgatatgatcaccaccccagccaattttctgatgtactggccagtcttcccataagacctggggtctctcagagggaatatttactaaataagggaaaactaaagtggcatactagtaaaggataggaggtacaaaagctactcccaaaccccaccataaattagtatcacctggggagtttcttttaaaatgtaacagatttctggtcttgacccagacctactgaaaatacttgcagagttgggactcattaggctggtaaacagcaccccagcattgtagatattagccccagtttagattagttggctagctcctttatattctctttttttccctcttggggagagaagtccagttcagactcccaaaaggctctgatctagatgcagaaagagacccttgaccctgcagagtgctaggcctaaactaggccagaccctctgctcttctgctttctgtcttgaggggaagggcagacaggaggaggggtgcttgaagttgggcgtccaggggccatattctcaatgactatactgtctgggaggtcagtgggttatggcgtttgaatgcctgctctgtaccttggctcttctcacctgggattccgagagaaaatgatttgatgacttttcttcaatactctcaatgatggtacacaaccagtgtcattccagatgcataggatgtaatgcattacatatgagggattaattctcacagaactggttgagaagggttattattgtgtcttgaaccagagagtcttcacctcacgtctccaaattgggctctgctagggcaaggaaatcacagaccacactgtcctttccttgggattggattctacccaagctgctgacctgccttctgattggtgtggttaagacaccgaggccaagcaacttctggtggcactttgaaaggagaatggggctttttgttccatccttttcccttggtggcagtttctcactacttaaactgctgctctcttgaatgccgaattcattcacccaattatttgttggctatcaccctgtgagtgccccacaggtatcttaagagtcagcatgtccaaaactgaaatcatctcttctgtgtcctacatgtgacaagccacaaacctggatatccttgactccttctttgatctctttagctaatttagttatccagtcctgttcagtttgtccttcattactgtctctcaaatttttccactttttttacatccacgaactttgtctataaataacttcttgctctgggcacttcagcagtttttaaactggttaccctacctccattgcctttcttcaaccagttctacacatcgatatgagggacctttccaaaatgcatactgggccatgtcactccccagtttaaatcctgaaatgatttcttcaactagatttaaaatttacataagatcctgaaatggttcctctatgtgtctagattttaaaatttaaactcactagaatggcacatgagaccatcaatgatttgggtcctgtccgcctctccagcctctcccgatgtgccaggtggttcagctttagtgaacccctgcagtttgcttgccacccggtgctctcttaggcctcttcccaccacccagaatgccatctacctccttccctccactctacctccctgccctcgccccatccccattcctcagctgacatcctgtccatttattaagatagctctggcaatgccatctcaggaaatttccaatccctatggcctgttaggtgctcctcttcttgaggcagcaaaagataccgaccttttttccaggtgtgcttggatttagttgctttgtgactttggcaaggtttctaatctctgatctgttttcttacctgcagaatggaaaaatgatatcttacagggttgttatgaaggtcaaatgagatagtgcatgcaagcatcaagcactgtgctggcacacagtagccttgcttctcttctccagtatgtgctcctactacgctactttatgccagtaagcatctgtttctattttaagtgttagttaactcctctcccacttcagacaggagttcctttagggtgtcttccatctctgcatcctgccaaatacaagtaaagggcacgtatttgaggaggaggaagatgacttttattttggacatgagtttgaggtgcttgtgagaatgtacaagcagagatgtccctttggcagttggaacctgctgggtctggagctcagcagggatgtccagattgaagataggaaaagtttggggagtgagttgggagtgtatcaatggtggttgaaggcatggtttgggtgaggttactgtctgtattcaagttactaagaaaaccgaatctgaggcaaagctagtgttagcactttattggagggtgaagtctcagagcagcgagagtgagggaaaggaggaaaagaaaatcaaaggttggtgttagtgagttggctcctgcctcacaaagacagctagtcacttgcccatgttggatgtctctggatagactacacagaaacaccatgactggctagaacattgtatttggattgatggaggggaaattcacctgttctgcttcctgcccatgctttactgctcaaagtttgccatggagccagtgttagctccccactttcttgctgggatgatatttcttggccactgcgaaagccagatcccatgccttgcggcatggcatttaatctaagtcctgcaatggcaaggggaacagaatgtggtcaccggcctgtgggagttagtcagcacagagcaagcagctggagacgtgggagtcaggtgaggctgagagaatctgaagcagcaagttacctcaggagagtattcagagggaagggaaggtagagccctgggaagccctgagagttaaagagcctgcagcctgaaggggcatccactgcaagcatagggcccctgtagaaagcattgtcacagagccaagggaggagagagattgagcagctcagagggcaatcaagttctgggaagtggccattgtgattcagagatgcctgatgagctggccagggcagtctccatggaatagaggaaacaaactgggttgtggtggcaagaaaggggagacagcagctcatgctcactgtgtgtcctgggtagcatccattcatggggattgtggagaatggatagccaggcagatgaccaggggaatgatttctggaaactggggatgtgatggtgggggagaggcctggcgaggtgctctgtgtaccaaggatggagtatagcatagtaacagccacctttgattcatccaaagccagaaatgccagtgtgacaaaaccaagcagaccggcagttggcaggggcagggtatgaacattctcaactctgttccctaggagcttctctcttttggtgggttttgggcagtttcctagggttaacgttacctgccccagcatggaggcagctttgtgaaataagaatagggcttatattccatctcttccgctattgagctgtctgaacgtggggaaggtgcttaacctttcagcttcagtttctgtatttgtaataggccaatagcaccttcctcaggtgatattcttaggtaatcttcagggagaaaattaaataacatagcatgcttgatacaggtatttaaaaaaggatacctggaagaggctgatactaaacaaatgaaaaggaaacaaaatagaagcacattcccaagatgtacactgtgacacacataaccatcttttgagccccaaaggattggtagccctggccaggcgcggtggctcacgcctgtaatcccagcattttgggaggctgaggtgggcggatcacgaggtcaagagatcgagaccatcctggccaacatggtgaaaccccatctctactaaaatacaaaaattagctgggtgttgtggcgcgtgcctgtagtcccagctactcgggaggctgaggcaggagaatcacttgaaccccaggaggcggaggttgcagtgagctgagatcacgccactgcactccagcctggcgactgagtgagactccgtctcaaaaaaaaaaaaaaaagaagaagaaggataggtagcccttagtgccccagctttcagcttgtttctgtgggcagctactgtcttattttctaccatccaggcactgttttctcctccttttagcaggccaaggctgagagagagagtctaaatgtggtggcacgtccctcaccccactcccacaatttgcattcacctgtttggttcacattttcagtgctctgcctcagtggggagcaggggtggggcaacacaaagacccaaataggctgctgggtaatcctagggaatgtacaaggatgtacaaggccccagagctgagtctaccctacacagccatgaggcaaaaagtgaattaggaacaagtatgctctatagcccaggtactctggaagttttatagcacaggtgaccttggcccctgtcaagtataggcccagggcacctggagaacacttaagtctgagggtgagtggtccctcctgcttctctgtggttattgtttcatgtagccagcttttctatgtgtatgggtagcatgaccattcatctagcctccctccatctctatcatccgtgccacccgaaacaggtattgctactcccagggacagaggtcctcagaggggcagcctgggacgtttggcctacattccttttccgaaggctggggagtttggatgtgggaattggactcttgctcaaataacgggtaccagtgtaaatagatgtctctcaccctctgttttgttactttttattatggaaaattttaacatacaaatgagaggagagtgtaatgacttacacatacaatatatgttcatttcatggttcatcttgtttcgtctatatcccctttcctcccccttcttctcccagaatgttttgaagcaaatctcagacatcttatcaccttattatttcatccaaaagtattttagtatccctgaaagatacagctcttcaaaaaagaaaactacaataccattatcacacctgaaaagttaattcatcagctatccagcattcaagttaccttggttgtcttataaacattttgttttgttttacagtatgtttatttggatgagatttaagacaaagacaatacactacaaatagatgtcttttgagtctgcttccccctattttctaattattttactaatacagtgtttgctttatatacgttcttcttattcaaatacataacattatcaccttgataatgcaaataacacaatatggaggaagattgagaacataggctcccagtacttagtcactgggattatagagattttccttttagtattttctatcaaaatttaaagatgtcctgccatggctgtgcaagaatagaactgtctggaatgggagtgcaatgaaaaaaaaaatggattcaaagttaggaaaagatgaaaagatgtaagtcaagaagagagaatatattttgaaactaaatagaatttcctggccaggcgtcgtggctcatgcctgtaatcccaaccctttgggaggccgaggtgggtggatcacgaggtcaggagtttgagaccagcccgaccaacatggtgaaaccctgtctctactaaaaatacaaaaattagctgggcgcggtggcgtacgcctgtaatctcagttactcaggaggctgaggcaggagaatcacttgaacccggaaggtggaggttgcagtgagtcgagatcgcaccactgcactccagcctgggtgacaaagcgagactccatctcaaaaaaaaaataaaaataaaaaaaataaaatttcttcattcagagtgtaagcatgcaaacaggtgctaaggagagaagttgtatcatcttatttcttcctcagattgcccttaacaaaccaaataggtaatgcccattgacctagaaaagggagctctcttcaagcaatgtataagaaaaagcagggcagagggaaagtagtgagagggtcacttgctttgaggtactctaggtcaggggtccccagtccctggctatggactagtactgggtgcatggcctgttaggaacttggccgcacagcaggaggtgagcaacgggcaagggagcattaccgcctgagctctgcctcctgtcagatcagcagcagcattagattctcatagaagtgtgaaccctattgtgaactgcaatgcaagggatcttgtgggctccttatgaggatctaactaatacctggtggtctgaggtagaacagtttcgtttcaaaaccatcctccccctcctccccattccatgggaaaattgtcttccatgatcagtccctggtgccaaaaaggttggggaccactgctctaggtgatggatatcaaagccttcactttgggaaacctgtcaaatggctgaagctgtgactctccatcattacaaatgatgaaagatgtagcagatttttactgaggtgctaatggattgaaaaaacgtgtctattaaatgtggccagacagatacccaggcagcaagtcaacatggatactgaatgagagttaagtgcttgcaacctctctgctccacaaatcaggttaaattctaaacttttttattttagatttaataatggggcaaatacaaagcaaagccttccatcagttgcagcagctggatggagaaaaaaaacacttctagaatataacttagaacatccccttgaacttccttcatctaagccatacccactggctgaagatgttgcactttttgacaaacaaaagaatggaggtgctaccaacacctttgtatcataggaagagacatgtaaacacacgagggtagtggagctgcactcagcactggatgtggtgaagaagggtatataagagatatttctccatacccatcaaaattttggatctataaacactgaaggcaagtgtatccattttcagagaattggtttaatggagtaggaagtagcaagggtttttttgttttgttttgtgtttttgtcccctgaaattgctaaataggacttcacaaagggtacatgagagccatgagatgactgaagtaagttatggaatttaaaaggtggagaaaaattttacaatgttaggggtcatttcctcatagccgcaggtatggtaagacccattagttcctggcttgttagtgagcaggagatggcagacactcttggctgcacagcaagtaactgcaaaggggaatgacataaaccagcttgaatataatggggaagctaagaaaaaggttgtttagtaattgtagttctgggaagggaaggagtttctagcctcttaaagattcctgctcccaaggtcattttatttctgtttagtttttcagaaattattcctggtatcaataggttaagaaagtagaattttcccaagtactggccaggcgcggtggctcacgcctgtaatcccagccctttgggagcccgaggcagacagatcacgaggtcaggagattgagaccatcctggctaacgcggtgaaaccttgtctctactaacaatacaaaaaaattagcccgacatggtggcgggtgcctgtcagtcccagctactcgggaggcggaggcaggagaatggcgtgaacctgggaggtagagcttgcagtgagccgagatcgcgccactgcgctccagcctggacgaaagggcgagaccctgtctcaaaaaaaaaaaaaaaaagtagaattttcccaagtactgatttatagataatgtttataagtggcacacaaaactttctgtttcacaaacagtagcattgattgatccctttaaatgcaagttcaatccttataagctaagtgcagtgatgattttatgtaacatagctaaatgcacacaaaatctgtatattctgaactacaaaagtggtttccatagccacatatggttttagataaggattcattttcataatgaatagtactaacaaatacgttaataaaacaatacttgtttgtttaacaccaaatacttgttctgtcaccaacttttaaagcaacaccattccaactactactaaaagcatttttagaagctttgatctgtgaaaacaaattctccaaaaacttgacaaatagtatggataaacctcaaagcttttaaatttaaaaagccttccaaaggctgggcacaatagctcacgcctgtaatcccagcactttgggagaccaaggcaggcagctcacttgagtcaatgagtttgagacaagaccaacctgggcaacatggcgaaaccccatctctacaaaagaatacaaaaagtagttgggtgtggtgggatgttcctgtagtcccagctacttgagaggccgaggctggagaattgcttgagcccaggtggcggaggttgcagtgagctgagatcccaccactgcactccagtctgggtgacagaatgagactctttcaaaaaataaataaaaataaaaagtcttccaggccaggtgtggtggctcacgcctgtaatcccagcactttgggaggctgaggtgggtggatcacaagatcaggagatcgaaaccatcctggctaacacggtgaaaccccatctctactaaaaagacaaaaaataagctgggtgtggtggcgggcgcctgtagtcccagctacttcagaggctgaggcagaagaatggcatgaacctgggaggtggagcttgcagcgagccaagatcgcaccactgcactccagactgggtgacagagcgagactctgtctcagaaaaaaaaaaaaaaaaaaggaaaagccttccaacactgaagccttcacatgaaacttagtttctccaaaaaatcacttgctatctgaaaaaaaggatattaaaacaaattaccttttaatacaaacattcttaaaagagacttttcctatatctacttaagagaaacataaaacagctcactatctttaataatttgtctgatactgtctagaaactaaagaatacatgacagagctgtgtctcagctatggtgagtcaaaggtcctatctggatttcacatattaaacagctgtagtgtagcttacagcggcacaaacactcaacaaaaatattgtgttgtttcatcatttaggtagtaaaaagaaggaactgcacagtttgcaaggtcctttacatgtggtcattaaaactgaataattcaagtatggtaatataaatacaggcgttaaagtctcattctaaaattgaaaatatgaaaactttgtttcttcatctttcatttacatggttagatatcgggaccttactgtagaaatatttagttactatatatggttgtcccagaaaataatggagcttcagaacgtacaaaaggtgtcaaaatcatagttgactctgtcagatgcttttctagctcatttcaattattcattcatagtaaccaagtcttttaactctagcaaactttcttgggtcctttctaattaagaagacagtatcatcaacttgtacttgatctgatcttctaactggcgttggaagttcataatttcattgatgaactctataaaaagatcttcaggaatatccattggctcagtgtaagggttctgataatccccaaacccatatatcagacatcataattctttaggaaacagtctttcttttacaagatctgctctttgctccttcttcattttcttcctcagagacgtgattttctaccccattttctcaaggtcatttttgttgttcaagtctgtccttgatgtcttgccagtactattcagatctggagtcagttggatggctctgatgccaggtttgggacagaatggttataaagtctctccaagtcgttgctcacagagactgcagctggtgctggtgtcatgacaggagcagaagaatcacagcctaaaaggatatctgcatcactccctccatggttagaattggaacagctggtgaggcaacatccttggaggatggaggggaagagtaacttgcttccagatggggttgggagtaaattgaggcctccagtccagtctcttgcagtcctgagcttagaaacatctcctcctcctcctcattatcatcatcatcatcatcatctctttctctcttttagagaagggcctcgctgtgttgccaaggctggagtacagtggccattcacaggcatggttatagcacactacagtccccaacttctgggctcaagtggtcctcctgcctcagccctcagctgggactacaggtgcgtgccactgcacctggctgaagctcatcattccttggttgtaatgttcccattactcaacttgatggtctgtctttccttaaagcccagatccaacctgggatgagtgttcatttcaagagatcctttggccatctcagatacctgttttatccatttaaggtgctttttcagaagttatcaaagtcaaaggcatcaccctcatctgtgaagccaatgccgatgaaagcactatacctgctcagtgtcatcctagaaccacattacaaagtagaagctgtaatctttcactgtctcagcagtgtcagcgtattgttctactggtgcccgagcaaagagctctcctgatattttatacttgagttgacataggcagtcttcccttttgaagactaagcaggctggtccacattccagcctgtagccattgttggaggcctggggcagaatctagtagacattgacaccagctaagataggcttgtaccgtgccttgggctgccatcttggctctctgccctttgtgacctccagatgacgttgggagtaaattgaggcctccagtccagtctcttgcttagaaacatctcctcctccttctcatcatcatctctttctctctttcagagaagggctttgctatgttgccaaggctggaatgcagtggccattcacaggcagtctaggttcgttcttgcttgatttttccttataatttatttgttgaaagaactatttctcagaatctggattttcttaaaatgcatcctcatggtgttaataagttcctctgtcttctccattttctgtaaattattagttgggtttagagcagtgattttctgactaacagcatcagcatcatctgggaattgtaggaaatggtaattcctactcatcccagagaagctggccataaaagtcaccatcttggtgagacctagcatctcaattctgtgaagtcacccattgaaagagatcaaaacaattggagtggagaggggtgaaatattggatgaggtagtggttggtctcttgatggtatggcatgcctgttatttctatgttttcatttcatatcaatcaaaaattggggtttttgcataacagatggaatgcaaaaaagaaaaaaaaaggagtgttgaacttatggttaaacagttaacttagctgatttaatgtactttaaagactacgttattactaatggtttagtgttccctgcccttgacagagacacaaggagaaaagtgttcactctccctgagtgcttagactactatttgaccctttctagaagacaagggaattcagatagggcagactgtcctccctcagagattggagttttagttacctacatatttgacagccaaagacacttgatttggaaagatccttggctgggccctctagctgcagccatggctagttaagtttccacagagagtacaagccaggcttgccttgccagaagagacccttctgatctttgtagaaaagatcagcccaggactggccatctggcaggtaatcaggacctactcaaacaattgagcaaggaacaataggtggaactgaaccctcatgaactcatggagtaaactctaagcctcagtgaacaaaatctgagataaatcacttgtaactcatcttggtattcctttgtaaaaagcaaaaagcaaaggatagactatgcatttgacaacatagaactgaaaacctagatatatatttaaatttaaaaaaatgtaaacacacattttaagaagtgaatttttaaaaacgcaaaaagaaacacttagattaacaaatgataaaacatgaccacaccattttacaaaatttttatacttttttttttttgagacagaatctcgcactgtcgcctaggctggagtgcaatgacgcaatctcggctcactgcaacctccgcctcccaggttcaggtgattctcctgcctcagcctcccaagtagctgggttacaggctcacaaccaccacccccggctaattttttgtatttttagtagagatggggtttcactatgttggccagactgatcttgaactcctgaccttgtgatccacccgccttggcctcccaaagtgctgggattacaggcgtgagccactgcacctgtccagtttttatacatattaacatagtgatattggaaattcatttttcagtggaaaaaaaatgctctctattttggaaagtaggtagttgggctcctgttttaaatgaagacatgttatctgaaaaattaacatgctgtgtaagttcagtgaggaggcaaggggagtgaagaagggtgaagagaccagaacatacccattccactaccagtggacatttgggttgcttccgagttcaggtacctccaaaccatgctatataaatatcctcccttgttcatgtgctttggcacgcatatgcaaaagtttctgtaaggagttaaattgcttcgtcattccttatgagtattttcatctttattaaatattgccacattgtttttgcagagtggctgtactggtttacagcctcatcagcaggataggtccccttggcgggattccagtctgcccctttggggaggagggtgtagcagggagagaaataaggctggcaaggaatgagaaagccaggcaggagaacaccattagtgccaatccaaggagttcagactgtatttgactgcattgggaagctactggcaattctggaacagggaacaaaatgcaaaaacagggttttgggaaggttagtctttaaagctgtctcttggtttgtgttggcagttggtagtgatagtggtggggttgacttaggccagcagcaggactcaagctcacaggagagagatctgtagggtgacagcacaaaggggacagtgagcacatccctgggggcagaaaaccagagcatcccagatctcccaactcttatccttaaataatccagttagacacacacactgctagtaggtgtgtgaagtgctacagccactctggaaaacaatgtggccgtatttaacaaagataaatatgcacatactgaatggcccacaagttgtaaaatataccaagcaaaacaaacaggaaaaaaaaaagaggaaagaattgtcaataacaccagatgtaatagagaggtctatcaagcaaagatctgaaaagtgtccactgtctaattgtccacttggcaattagaagtttgatgatgagctttgccacagaaatgtctgtgaccagtaaggagcagaaatcagaacacagtggtttgagggatgagtgagtggtaagaaagggaaactgggcacggggcctactatcaggttggttggctgagaacagactcaagcacatagaaacatcagtatgtgatcaagcaggatgggtcccctcggctggatttcagtctgcccctttgggaaggagggtgtaggatggtgggtacagggtacataattttacaaatggtgatttaacacttgggaaaaacaagttaaatcctcatattacaccatataccaaagtccagatggattgaatatttaaatatacaaagcaataccggaaaagaactagaagaaaatttagaacatacagattttctatataaagaaaatttattttgtatataaagttggggatggctaaaacttttctaagattgacaacaaaactagaaaccttaaagaataatatggataaatttgactttattaaaatacacacacacacacatcgtattaaaccttcctgtaagaaaaagaaaaagactgcaaacaaaattgaatgacaaatgacaaacagaaaaatatctataattgggaggccgaggcgggaggatttcttgagcctaggagtttgaggttttagtgagctgtgatcgcgccactgcgttccagcctgggtgacagagcaagaccctttctctaaaaacaaagaaaaagaaaaatatttataacataaataagtaacttttacaaataaataggaaaaagaagctgggagtggtggctcatgcctgtaattccagcactttgggaggctgaggcaggtggatcacttgaggccagaagtttgagaccagcctggccaacatggcgaaaccccatctctattaaaaatacaaaaattagcctgacatggtggcgcatgcctgtaatcccagctacctgggaggctgaggcatgagaatcacttgaacctgagaggcagaggttacagtgagctgagatggtggccagtgcactccagcctgggtgatagagtgagactccatctcaaaaataaataaataaataaataaatagaaaaaagaaacacatcaatagaaacatagatatgaataggaaattcacaaaaaatacacttaccaagttaaatcaaccttaagtaaaaaattcgttcaagattgtaaagtgaactgttaacatttacttctctttcctccctaagtccaactggaactacattttttaaatgaaaaaaagtaaagtatgcaacctcatgagagaacttgaaaaaaaaaaagtaaaaaggaaaaatatccaaagcaaaaaaaaaaaaaaaaaaaaagcattccaaagcagtgctggaatacgaggaggggtttacagtatacttctttggacctgacgcctagcacttttcccttctgagagaaaatctgccatccccactttagtcgcctggttcatgtgggaaactgaggcttagagacagcagagctggggagtggcagcaggatattgtggcaggtggtggcagtcggggacttcaggctgtggtctcacaccgccacactgcctttcccttttctcacagagaacattcaaatggctgtctttctctggcaaggtagaaagcctctcaaataagtaaggaacatgctttggttaacagctaacgaggcattaggtctggacagggagacaagcagtgcagcagccaaatcccagtggacactagacacgaggaagaaagcacggtgctgccagggcaggtcctcctccctccttcctccttcctccattaggaggattcctgagcctgcaaacctgttccctttgtgcatcctggagggacagcccctgccccataccttccaataccctcaccaaaccagatgaagctcaccctcaaattcctgtgtgaagtgagagacaaaaaaaccccaaacctgaagtgtctgaaataaatgtccaaattatttgaacaaaacctgggtaggtagaaaccaaagggtttcacttgaatgcttggcagtaacgtctcaactggtctttccacctgtgctacaatccactgtgaagtccattattccattcttgtaccaagtccccttccacattcctttcacttcagacatgtttgctgatgtttacacctctccatagactacccagcctatcgtcgcatgcccaaagctttatttccccaaacctgccctgtgccagggaaactgctctccagttctcaggatatttatgctatgttctcccacctcttatgtctatattttttgtggcttcttccctctgcctcagataccccttggtagttctactgttctaaatcctacccctatcctatcccttcactgcatctccaaggccattttctccacaaagcttttctttaacacatggggctggtaggtaagccatgaacatttgtggaacaaggtaatcctccaaacaagggtgatttttctttcactgaacccttccctccctttgtgcttctttttggagcctcacactcttctgaatttgttgaatccccaaccagctggaaattccctaaggcccgaaactgtttctggcctaggctgtgctgatcttcctgggactaaggggtttcctgggtcacagatcttctgtgctaaaaccaggaaagcctctggtgacccagcatgtgttgatctccctagtcttgcctgtctttgattccatggattattaacagaaactataatgttgggttaatgtgttggcttgggcatggcctccgaaacatgttttttacatgtctgccaccagcaggctctagatccaggaatgaggcttttccactaagggaaaactccacgtgatctaggaagaaagtgaggatatccaaccagatgataaatttcctatctgaaagagaaggtcaaccctgaaataaggaggctgaagacccttagagaagccacagaagagactggaagaagaggggtagagttgcttttttaatggggcttccagctcctacttttcttcctgtctgtaagtctctgagcttctgttccagctctgtaaggttggggacgagaatgctctccccactggactgttgagagttcaatgaggggaaatgtgtgcatataccaggccccatgctgggtgcccagagacgctgcgccttcctggcatgcttctcttccccatcgctcagcaccgcgtccctcactccctccactcccgattctcacttcctactcactggcttcttccttcccatcttcctccaaacttcccattttccactatgtctctctcaccgtatctttttcacttaaacaaaaatggaattcataaaaacagaggccaaaagtcaggataaacctggaaaaatcaccaagtacgcaaagtttttcttgcaaggtttggttttttcaaatgccttctttgttttccttgcccatatccttcttcggagagtcaggatttggggtttgcagagctgtgtggcagtggaatgtggaatgttctcctgaatctcagtcccatgaagaaaagaggcaaaagtcctgacatctttcctgaggattgtctgatttaaaagagctgattctccccaggcaaatgacttacctttgttgtgctgggacaagctgaacaggcaaggaataaacctccctagaacacactgattagattagccagtgagaaccactgaagacgcagacattagattaaaaaacagaaaaatgaatgttacttttacagtggctatgaatagacaaagactttttggtttgaaaatagttggtgaggcaatagaggaggggctatgttaatagcagagatagaaaaaacgagaggtggatggttccaactgcaaggtccaccctaaaggaattggagtcagggcccaggagccacaggccactgcactggggtaagtagagtggattttacataaataaagttacagagtggttgtaggttctggtttggagatgtgagtgaaccaactgaatagaataggcagattccccagcccaccaagagtcagatgagaattttattgctttttgctaaaggcctgtacaagacttagagcaaagataaggagtaacctgattgttgaaactaatctataagtattccaacatagcaaaggacaagtaacggaatgacgaggttttcctgtagtagtgttgcgattttgttctgctgtgtccccctactccagtttcctctgtgaggggagcgtgtagtgtgtgcatatctgtggaatgtcagacttctaaagtcaggggctgagacctatatctagttagacctctgtgcatattcttgagccatgggagtctcagtggttgatagtacttcacacttcttccagttcaataagggttacctatggtgtctcctctgagtctcctaggagtccagaaaacatgagacttgtataagaatccacacttcaactaagctttctggcccaaagaaggcattgttaccaaggatctgtttcttgaggtctttagggagtgagagggaaggaacgcatgaggaaccagagctagtccccatctctctccctagaagtgacagactgcatagctcttatgtatcaggagtcctggagatcagctggctttccttaaaaaagggtcatccagccgtgatgaaatcctgacttagaaacccagtgcccttagctttgtgggcttctgtccctgagaaatggtgttttaccctccctccaagcaggcatcccaggatttggaattcagctgtgagctcatgagctgatggatgtttccaggagtaccctgaagaccacccaggtatgctctccccacctcctttattttggatggaccagtctaaggagagtcatcttttcccacaccattggtggcactcagtgagtggcttgttgcttgactgaatgcctgcccacaccctctccagtcaagtttatcttgagtaactaaacacttagcaatggagacactcatacatctccactgcactagaagtagggatggtggccatgccaacaaaggagataactttagcacaaaggatgtcacaagaaacagatagtagagtgtgttctccagtgttatcatttcccaaaccagaatcaactggtcttgggtttccttccctcatccttcatctgtagaaaactttgtttcttgagctacttcagatctacttccctatcttaagaggtgggctatgtgcttcttctgctaatttattatctcagaagtacataatttgagcaattttatatagttttgaggacaggagccctgtaagagtctcttactcagaaatggattcagcttggtttgaggtttaataggtcattgcaatgctcccttctggtatcacaggacataagctgggttgggcggagtcccccttttgtgtcttagccttcctctccttactccagagtaagagcagccctgatggaaaaacaaaattaccatccatgcctacttcatttctgcccctcttactctaagtctgggcaatccgcaacatctttttatattggacttcctagatcacagactctttttttaggaagagtcaattcaagccacccaggacttatgatcccttgctctgtgtcgggcacagtgtgagcacagtaatggcatgggctgcctgatgtggggcagtccctcttggtcagcaattcactcagcagccatctcagtgccccctgtgtaaatttgaggcactttgccaggctgtgggaacagtgtggggttaaacagcacatggtccttgccctcagaaagcttaaaatccaaagtcagatacaaggttatttaacagatgcgtgttaattaacaattaaagctaatgtgcactgttccattgaacaaacatgacttatgtggtaaaatcagaaagcagcttgatttttgtctcttactgctcttttacatttactctttttttttttttttttttgagatggagtctcgctctgtcgctaggctggagtgcagtggcacaataattggctcgctgcaacctccacctcctgagttcaagcgattctcctgcctcagcctcctgagtagctgtggttgtaggcacccaccaccacgcccaactaatttttgtatttttagtagagatggggtttcaccatgttgaccaggctggtctcgaactcctgacctcaggcgatccacccacctcggcctcccaaagtgttgagattacaggcgtgagccactgcacccagcctcttttacatttattcggtgggactagctcttgctttgcccctgaatggaatttaggcaagtcacaaggttgttccagccacccttggtctcagtctcattttaataattataatttccagtcctacctaaagataccacttcaatcttgacttggagtggagcctcttctggtgctgctaaagaacagaggcccgtggtggatggtggtctggatggggagtccctggtttccactcttcctcacttatttagctaaccagggtcctcaaccccgtcagggttgttgcctggaagagaagaggtgagaagaatatgaaaactatacgtttgtgatctccagctcaccagtggaacatggtgattcttttacagattcttgctgtaactcctctgttactcccctcaaaggccagctttttccacccctgtaggaaattcctttcctacacccaccccatttatctcatcctcatggccccatgggaatttctctgcttctgcccccacccatcatctctttcctgcccatttctcctccatcttggatgaagctaccctcttcccctggtcctggttcagcctttcatcgctgctcagtaacatgaacccccaaaaagccagccagcaaagcagagcaggcctgcctagcatagaaaatgccagaatttggagaacaaaagtgcttttttggataggactgttttttgttgttgctcatacaacacagctctttgtgattaatctacatttaacatagctccaatcaaagtgataaagaaatatttttattaaaatgatttccttttatggcaaaataagcataagattgaccattttaactatttttgaatgtacaattcagtggcattaattatattcacattgttctgtaatacaaccatcaccaccatccatttccagaactttttcatcattcccaactgaaactttatacccattaaacactaactccccatttctcactgccccaggccctggtagccattaatctactctctgtatctataaatctgacaattctaggtacctctataagtggactcatacagtatttgtcgttttgtgtctggcttatttcacttagcgtgatgtccttaagttcattcatgttgtagcatgtgtctgaattttattcctttttaaggctgaatcacgattgtatgtatgtaccacattttatttatccatctgttgatgaatatttaggttgtttctaccttttagctattgtgaagaatgctgatatgcacattgggatataactatctgtttgaatcctggttttcagttttcttgggtgtatacccagaagtggaatttacttaattgttcttgaatagggaatacctctgtatggtggacaatataaaaggtacaagaagtcatagagttccctgagccccgacctccaagttcccctcccaggaagcatcactgtaaccagtttctgtgacctcttccctggagagaccatactgtacccataggcaccctctacacaggcatgatgacagccataagcactcttctacactttccctttttcctacttaacaatatttcttttttaaaaatttaaaaatctatttatttttttcttcaacttttattttaagttcaggggtacatatgccagatgtgcaggtttgttacataggtaaatgtatgccatggtggtttgctgcacagatcatcccattacctagatattaagcccagcaaatattagctgttcttcctgatgctctccctcccctaacaatatttctaaaaaaatcattccatagcaccatttaaagaatatcctcattctatttaaaaggttcatcgttttccaaagtagagacaaaacttgtttttctttctttcttttttaaaatcagtcctttattcatggacattcaggttgtttccaatgttttgccactgtgaacaatgctcggatgataacagccagcatttcctgaatgcttaccatgtgccaggcccttgttaaaatccttcccatgtatcatatttaattctcactacaactgtgacataagcacagggaggtgagtaactgtcccaaaccacatctctgtttttgtccacaggtgggagtgtaagataaccttccagataaagagttgctgctaccaaaaggtatgtccattttatttatttatttttatttttatttttttgagatggagtcttgctctgtcacctaggctggagtgcagtggcacgatctgggctcaccacaacctctgcctactgggttcgagcagttctcatggcttagcttcccaagtagctgggactacagccactacacctggctgacttttgtatttttttagtagacatggggtttcaccatgttggccagactggtcttgaactcctggcctcaagtgatccacccacctcagcctcccaaagtgctgggattacaggcgtgagccactgtacctggccaggtatgtccattttaaagttatataaatacagccaaactggctgcatcgaggctgtgcttatctgcatctcactggcaagtagatgtatgagggcccattgccctcctctctcactgttgaaaaatttcttgatatctgccgatctgaaaggtaaaaaatggtatttcattgtggtgctgatttgcattttaattttacttgtagatttttaaaataacacagttacaagattcaaaatttgaagagtacaagagtagagacaaacccccatccatgtgtctccccagtgcccagttcctgtccccaaacaaaatcaggcctccatttgcctccatttctccctcctatgcctatggtcaaaacctgggccacaccattatccttagctgctccatctctgaaatattaaattcaaacattctactctgatctcgccactgtcctattaactaccaagcacctgaccctctcttgatgccccacctgccctttaccttaccttcctttcccatccagctgaggttctctgccctccagaggctccatgtcaggcgccactgggctccagccacacctgcctggaaagccttactttctgtttcacgatacctagttcagagtcagcccacccatgggatcactctcatttaaagatcttaggcagaataaccacataatttactgctcaaaatgggacccttttgagaatgaaaggagcacaactaattatgaagccaagacaacaggggcagatagttactgtccaaggcagatcgggatgcaaattcaagctcaatcttaaggaacaattacatttaatttcggagcagagatcaataatatgtgctgagccctgcgaatgatttaagttgctgcctttgtccgctgcccaagcttctcttctaaatggattttttaaacagtgcatttccctaacactattttcttaaaactttatcctttagaataccagtttcggcccataaactcaagtgtgtaaaaaaattagtttgtttataaaattctccttcatctgtacttgagccccgctctttaaaaaggtgctgacccttaatcccagtcagttctgagtttcctttgcagtttccattttgggtttggggtggggtggagtgcagggttctagactctcagtgacctacaaagggtcctgcccttcatgtcatctatccttgtcccatctggtcctgggtcgttggtgcctgcaggttattgtggaggtcaaagtctctctccacctcttcaagcagcctcactcagggagcttgcctggggtcctcttggcctagatacacccagcagctgttctgttccctgctctcagatccacagattgtgagggatgctgctttctctgtggggctcagtccagggagcggggattgggacctcagcctccaggacctagcaaagtcaatgtttctcaacttccctccagcctttgtccttgccctggggaattattcttggatatgagtgaggggcagggaatgccttgatctttctcatgaccattttctcccacactttggtctaggtctaggccagaagtctcttctattcccctaaggaaagaggctccttacctcttctttctgttttcacacaccttccctgcagcaatgagcatagaatggcctggctatttgaggcagggaagggagagaggtaaggggagtatcaggctggagaaggcattggctaatatttcagaacataatcttgcaaggcatataaaaatatcttatacaagatgtgcttcctgttttaactattatgattttataatttttcagatcttgtaggcaagactccctattcccatcccccaggccagggcagccagttatcagctgtgtgaacttgggcaaattatgttatcctctctaagctttagttttttcgtctgtaaatgaggataatagtagttcatatcagtgcttctacttgccaagcactgctctcaatgtttcatgtatgttacctcatttaatactcatcataaacctatgggatagctgctatcattcccattttacagatgaggaaaccacttctcacagttgtaacttgcccaaagtcatgtgatctcctgctcttaatcacttccccaacctgtctttcataaatattaataatgacctcagccaggcgtggtggcttactcctgtaatcccagcactttgggaggctgaggtgggaggattgcttgagcccaggagttcaagaccagcctgggcaacatattgagacctcatctctacaaaaaattaaaaagtagcctggtatggtgtggcacctgcctatagtcccagatatttgggaggctgaggcaggagaatcgcttgagcctgggaggtcaaggctgtagtgagctgtgatagtgccactgcactctagcctaggtgacagagtgagaatgctgtctccacaataaataaataaataaatgaaatgacctcttgaggttgctgtgaggattaattgaggtaaggtatgtaaagctgtcagccctgagcctagcacatagtaaaaactcagtacattctaagctcatactttagccatgattttttggtcattttcattcaaaatgcccttggaattgtatttaaaatatatataaatgtctgaacttaagcatatttgccctattcagttttcccatccagaaatatgatgtcttattatgtgtttcttagcaaagttttgccacgtgtcctcatataaaacatgcatttctaggcgagtttatttctagatgttttagggtttttgtttttattgaaaatgaaatcttttcctccattgtatcttttgatcagacagtgctggtgtctccaggttcttattagttaatcagctcccagatgtctctagaggctatgtctttccatagccctcttattttaggttgacatgaagatcatttggcccagccagtgacatacgctctgagagagaggcacaggggcacagggtgagaagtagctttccagggtagctcaggttggctgaggtgatcagagaactgtcctttggctaaggaagtacagcctggggagaggggaaggaaggggccagcccttgcttggctgcatgctgtttctgggtccatttggggatctgtctgaagaacgagttcctaggtacccacatttcctctgtggcctcaatgattcccaatagtgtgtgccaaatgatggctccagtggcagctctgccaaggcccaagatgcctccgtgggctctagcttgcttaagtagagagactgtcatccagcaatgtctcattcttcatcatgtgattaagagcaggagatcacatgactttgggcaagttacttacaactgtgagaagtggtttcctcatctgtaaaatgggaatgatagcagctatcccataggaagtggaggatacataatctgtggcgtccctgaatcagctccctgcctgactccactgcagacctccagagggcagcagagagcaggcaagacgggagaacaggacttggttcctggagaagcaaaaaagactctctgctcctgcaagctgctaggaatactgctcatccccctccccgcctcctcaggatacacatgtgagcttcttcctgagggtgtaataattataataatattattagttaatactaactattccctgtgggccagacattgacctaaggtttcacattgattcagataaccattgaggtagatataattattattcgcattttttttcagttgaggaaattgcagtgaaaaaaaaaagaagttgtccaagatgccacagttagttgagtcaggatttggacccaatcatttatgagccaggctctattctaggtatcagagatacatcagtgaataagacaaactttctgccatattggaggaacagacaaaaagtgaacaaatgaataaacacatactgtggttttggatagaaatgccatttagacaaataaagcagagttaatgaccagagaggggcattttagatgggctggtcagggaaggttttcttgggtagatggcatttgaccaaatagttgaatacacgaggtagcaagtcaggctgaagattagggaaacagtaagtgcaaaggtcctgaggtgggaatgagcctggggtgttagaggaacagcaagacttgcgtcgtggctgctgtagagtgagccgagtccataggccacagcagcgattgggaagtagataggggtggtgaagaaagagaactcctccacagcatcacctgggcttggcctcttacaatgtctcagcttctctttaacatatctctcaccttttttcaccttcctgcagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggtgagtactgcccagcctgtggggaacttcttgtgggtaaaggttctagataagcctgccagggcccccaaatgaatccttagtcccattaacaagggcctaagtcccgcaggcctttccagggtaggaagctgctattttcttcaaagaattttgcccccatgccatggtcctaggtcagacctacctaaatcctttcagatgtcaaacccaggtagggttcagatggcatttagccaggagatggaagggaatccgtcccagtgagcagccatcactgtccaccaggtatctgaagaaaatggaggcacagaggtcaaacagtcatccctcagcatctgcaagggattggtgccaggaccacccgtagatatcataatctgaagatgctcaagtccttcacataaaatgtgacctatgcaatcctctgtttatcttaaatcatctctagattacttcgaatacctaatacaatgtaaatgctatgtaaatagttttttatactgtattttgggagtattattttttattgttgtattgttatttatttttattttttcaaatatttttgatctgctgtttgttgactccttgggttaggaacctgtggatatagagggccaactgtactaagaatctttagctccctctcctggcagatccctggcgagtgaggtgggcctatgttgagtgctccttttgcctgagtgagagcctagaaccagagactgaatgccctaatccaggatttcttgatcatggcaccattgatagttggggtcagataatttttttgttgtgggggccatccttgtaggacgttagcagcatttctgaccactacccactagaggccagaagtactctccctccagtagtgaccttccctccagtataaccaaaatagatccagacattgccagatgtgcccaggggaagacacctgtggctgaggaacactggggccagttctttccctttccccaagaccagtgcatgagcctcagctgttaccactctggtggtgaggaagagttgacagtatcccccaagcatttacttcagtgccacagctgagtggctggcttggcatgtccttggctgtaacatggaaggaggccagaggacagggagcagagagaaaaggggtagccatatcttctctcaacattttttggcttacaaaactaaaccacagggaagggcagggatgaggttggccatacacatcacaggactaggtctttctctccctcctcatctctctctctctttcatgcacatacatgcgcacacacacgcacacacacacacacacacacaaatggacacccctctgccattctgtgtattggcttttctctctcccactgaagacaggctttttccagagacaaaagagtactttgtgcaggaggaaaaagttaacgaatggactgattttgcccaagagattggcagggcaggaataagaggttatgagtatcaatgagagaagagaggaaaggattcattatgatgtccagaccagaaggggaagtaaatgaagccatgaggagctggtatatggggagaagaggaagatgcctgaagatcaaaggtcttcatgcagttgaaaagcaggaaagaagggagtcagagcttgggaagttatccattaagagtcccaacatctgaccagaactgtcaatgtatgtttattttgcttcagcgataatttcacttagacacatagaatcgtagggcagtagagtttcaaagaaacttaagagatccttgagtccaacccagtctatgtggactcttttactaattcttcagtgctggactttgagaatgagacttgttcacaacccctctgtgcttagaatcaaatgagaaataagatatagaagtccagcagctggaactaaaataaatttatgacagctaaagctgattggagaatgtggttttgaatgtacagttgggcttcctaattctttccctcagaatgaaacttatctacccagaactggaagactcccctatcccacaacgcaagaacctgcccttcctagggcaggttgaaaagaagaggagaggagggaagcacaggccttctctgaggaggctgttcccagaaggaggaaatccagaagaacctgagtcatgacatatgcccattttatgtgctccaattctccaagcacacgaaccactcatcctctgctagatagcatgagtttagaggtagagcagtaagtggagagtacttttctcaaggctgcagcaaggacagaagttcccactttataaggtgaggcaaaagtgcttggagggagagaggtagatttccccctgacaaatgccatttaatagagcaaactctgctccaagaacactgaggcccagagaggtgatttcccaaaggtaccatggctctgaaagaataagggtctccagactcctaatggtgaaatttcaccatttcacatgtgtaatcaaaggaggacaggttcttccacatttatcagcataatagcaacaacaatcttctatttcttcatgcacaaggccttctaactccttccttcatcactatcactgcctccacatcctccatctacaccttgccacctctatctacacatcacaccctcatccacacctcaccactaccatctacacctcactaccctcacctatacctcaccacctacacctaaaccacacacctccatctagacgtcaccacctccatctagacattaccacctccatctagacctcaccaccaccatctagacctcaccaccctcacctatacctcaccacccacacctaaaccacacacctccatctagacctcactacctccatttagacctcaccacgtccatctagacctcacctcctccatctacacctcaccaccaccatctatacgtcactatcaccatctacacctcaccaccctcacctatacctcaccacctacacctaaaccacacacctccatctagacctcaccacctccttctagacatcaccacctccatctagacctcaccaccaccatctacacctcaccaccctcacctataactcaccacctacacctaaaccacacacctccatctagacctcaccacccacatctagacctcaccacctcctatacctcaccacctacacctacaccatacacctccatctagacctcaccgcctccatctagacctcactgcctccatctagacctcaccacctccatgtagacatcagcacctccatatagacctcactgccaccaccatctagacctcaccaccctcacctatacctcaccacctacacctaaaccacacacctccatctagacctcaccacccccatctagacctcaccacctccatctgacatcaccacctccatctagacctcaccaccaccatctatacctcaccaacctcacctatacctcaccacctacacttacaccatacacctccatctagacctcaccacctccatctagacctcaccaccaccatctacacctcaccaccctcacctatatctcaccacctacacctaaaccacacatctccatctagacctcaccaccaccatctacacctcaccaccctcacctgtatctcaccacctacacctaaaccacacatctccatctagacctcaccaccatctagacctcaccaccctcacctatacctcaccacctacacctacaccacactcctccatctagacctcatcacctccatctagacatcaccatcaccatctacacctcaccaccctcacctatacctcatcacctacacctatatcacacacctccatctagacctcgctacctccatctagatatcaccacctccatctacacctcacgaccaccatctacacctcaccaccctcacctatctctcaccacctatacctacgccacacacctccttctatacctcaccatcaccatctacacctcaccacccttgtccacacctcatcaccatgtatacctcatacctccatctatacttcacaccaccatacactacctcaccatctccatctccacctcacacctctgtctacaacttaccacctccatctacatctcatcacttccatgtaaacctcaccacctccattcacatatcacatttccatctacacttcaccccccatctacacctcacacttccatctacatctgatcacttccatatacacctcaccatctccaccttacaccaccgtcaatacctcagaacctccatctataccccataccaccatatacatctcaccacctctctctacatgaacctcatcatctctgtctacacctcacacctccatttacacctcacaccacctccatctacacctcaccatgtttgtttgtttgtttgtttgtttgtttgagatggagcctcgccgtgttgcccaggctggagtgcagtggcactatcttggctcactgcaacctccgcctcctgggttcaagcaattctcctgcctcagcctcctgagtagctgggattacaggcatgtaccaccacatctggctaattttgtatttttagtggagatggggtttctccatgttggtcaggctggtctcgaactcctgaactcaggtgatctgcccgcctcagcctcccaaagtgctgggattacgggcgtgagccaccacacccggccaatttactatctttatctacatttcattacctccatctacacctcacacctctatctataccccacatctccatttatacctcatcacctgcatctgtacttcataacttcacctacactttacaccttcatctacattgccaccgttttactgctacttctacaaccaacacctctgcctctatcattttctccatcattcctaccacctctccttttgtcagcagagagccagcagccatccttttggctggagtgacaggtgtgaactaggagcctacctgcatggctgtagtctagagaggtcttcaaggtctttgaggttaaaaaaaaaatgtctctagcttttggtgtcacctgatctctccgaaaaggtcaccttggagcattttacaaagattgggttagagatgcctaaaaataagtacacatgtttatgtaaactcattgaccacaagtacagactgccactatttccaagccatgccctaatctgacagctgaacatttaggtacttgcaatgtgataagatcctttatcaacatctcagcagtcctcaaagctctaacaacttaaaagttggagacattaaagtgagctgtaattttgagccaactggggtcatgccagtacataacaacaggcccacgtatctgtaggttcctggaaatgccactgcccctctctgggcctcaatttttcattatataaagtgggcaaccttgagataaggctggattcttcaagttctcttccagctctaacatccctccaagacagaatccaaaaagaatctgggttaaaaactatgcagggagataaaatagcatttcagaatcaaggctggaatataccactgccataaaaagatcaccaagttaaaattcaagaagaaatttagagcaaaggcatctgcctatgatcatggccagctctattcagaccctgctataccctggtctgtcagtcaaccaggcatccatccctgaccctgcaggagcgtccctccccccaccttggtcacatggctggccgccactgagcctcagaagtcaatctccaatgccccaaatactgttcagcctggaaaccacagagagcccttcttgccacccaacaggaacagagcaagtggttctggcctccctgggatttggatcctggtttccagagctaagaacacaaaggtaagtttgcagctggaagcttcagagaaagtagacagagctatgcagataagggaaaatgtgtttcatagcatgaacacagagtatttaagagtaagcttcacacacactgaagaggagaataccaggaaagctgggcaaatcttccaaatgagtataggatatttggttttcctttaaaaattatactgtttttatcaccctggccttgaggtttttgggtgcaaaaccactccaaattaacagaaatgacaggaaacttgttctgtctgacaccatggtaagttagttctatcttgttctcatctaatagaactgaatctttctcttctagtacgtaaatttctgttgtctttgtcaaatgtgttagactggctgaaatacttatgaagtagcaaaaaccctgagacttacctctttcccagaaaaccatgggaaaataaattatatctgctaatgtagcatctcaggatagaaacagaataatggctagtctcctttcattacacatttttgtttttaggttttggatacggtacctggttttgctactgctagttttcttagggatatttgtttgttttgtcctttctctcctggagcatgcgtgggtgtttcagtctgcagggccccgaggcaatggacaagctaggggttgagagggtagcctttccctggcttctagcttagctttctaaagcccagcatgaccccgtgtcattcttgtcgattcagttcacaaaataatcccagataagcccttggggaagtccttttctgaaatactctgggctgtcagaagggtgcatcagacaccatgttggctggtctagagttcttagatatcaaggtcaagtggcttaaaatatggggtggaaagaaaagctccccaaaagctgaccagtgaatgtggcacaacctttttactagttaccttttttcccagagacatggatgtctaatcttaaggattcattactatgctttactcttcttccctagtaatgaaactattttgttctgttcccagtgtctagtgcaaatatctggaacaaagtggatactcaataaggatttgttggattgaattgatgtgtccttgtggatagggaaggggtgggcacctaaacaccagatgattctatcacaagggctctgatgactaaaacgtgtcatacatctttaaagctagctgtgtcaccaccaccttgctgctttgggcatgcagtctgcttgggcaaggacccctgtgtgtctgtttgctaggatagcactctgatccttggtcttacaggcttaaggtgttttgtttgtttgtttgtttttgtttttgagtgcagtggtgccatctcagctcactgcaacctctgcctcctggattcaagcaattgctgtgcctcagcctcccgagtagctaggattacaggcgtgcaccaccacactcggctaatttttgtatttttagtagagacagggtttcaccatgttggccatgctggaatcgaactcctgacctcgtgatctgcccgcctcgtcctcccaaagtgctgggattacaggcgtgagccactgcacgtggcccaggtgttgattttgtcagtagggttttggattctcagggatcccagatgtgatttcaggctagtggtaggggcaatgaaatggaaagtgacttttgactcaggacagaagagaattttgtgtgttcccttactgtaaagccatgctcaacaccaaggcgatctatgatctaaagatggatgggggaataacagtgagctagttgggcagggaagagactggtgttacaggtcctttcatttgctgcatgccagaggctgatgtgttgctagcacaattcctttggcaagatattgtagtggatgattgtactggttagtactctttggatacaagtaactcaaatcagctgaagctagttgaagagaaaagagggtttttaaaatttttttatttttttaaacatcaaatgcctttttaccaaggagggacttattataataccagggaagtcttgtggaccggagttcagccaggcctcaggaagggcctggaacccagaagtggaagactgtcagtaacccataccaggccccctctgtttctcacatctttatttctctttcgtctttctccctccttccttctcccttccttctcccttcctcctcccctcctttcctttcctttcctttccccttcccttccccttccccttcccctttccccctcccctcccctcccttcccttccttcttccttctttccttaggtttgagaatcaaaaagaatccagtttgaaccctggctccaccatggctggttctgtgatccaggacaaatcacttaactcttagtcttcatttactcatctataaaatgtgggtgaaaattatatacctcactgaattatagtgaggattcaataagatgatgaaagcaaaatacctgacattcaactaatacacattatatgaaatgctggaggtagaaattctgttgcatgaattaggctgggacttttatggtgggcagtatagttgccagtcagagcagagctaatccaaacacttccccagggccaacactcagcttcagatggatggactcctttgaagatcatctcagggagtttgggttcttctacttctgcatattcctgggagggagcttctctcaagttgtgagaagttgggatctagcacagaggacatgaagcaggaatggtcttagctagtccagaactggaaggtatgcatctacctgaatattatagctacattatagctccatacttctatagtttgtagagttctcatctgtgtttgcatatgtattgtcatttgtcagtgacaagcaggcatttcattatttttccaacaaactttcttttccaatctgagaatccatagtacttcaaataggaaataacacattttaaaatcatgttggaaagctctatttcattttcattagtcaggcacttgtgattgcaaacatgagaagcccaactcaaacatgagaaaaaataaagtgaatttaacagctcaacacaactgagaaggacagttcaaaattaactgactcagggagtcacagtgttatctggactctgtttctctacttttcttgaatgcttccctccatgtgacaggcaaaatagtaacttccaagcttatcagcttagcagtgccagagtgagcagagtttttggatgaatcaagcagaaatgtcctgggaagaattctgattggcccagttaaggacatgggatcattcctgaaccagtctctgtggctggaatggggtgtgtttgaccagcctgggtcacatggcctttccttcagaggcttggggagacatggagtctccccctaagacatttgaaggtggttgtctatgggaaaaaaaatctgttactcagcttctctgtactcttcacaccatactggagtaggaagatatcagctttttaaaaatcaccaactgacccaatttaataaaaaatataaattgggagttactttcttaaaatagaggttttaaatgtggtccctggatcagcatcatcagcagcaactgggaacttgttggaaatgtacatttccaggccccaacctagagctatggaatcaggcactctggggatgagacccagcaatctattttaacaagctttctggagctgctcacacgtgtaatcccacctactttggagactgagatggaaggattgcttgagcccagaggttggaggctgcagtaagctgtgattgcgccattgaactccagcctgggcgacaaagcgagaccccaactccaagaaaacaaacagaaagcagccttctaggtattatgatgcacgctcaagtttgagaaccactgccttaaagggttctttgttgtgtaattctgctaagtattttaaacatgattcactttgaacaaatagatttaaccattaattttcaaggatacaattatcacataaagtaggaacacatggcatattaaattatttactttaaaacgtttaaaataaaaaagctataatttaaaaatcaattaacacatgtaagagctttccataaaaagcaatggaactccattccagcttcctccatatgccacagttccacttcccaaagataaccactaggaattcttttagctttttctcctggctaccttttaataataatgatagtaataattattcctgctatttattgaagttagatattagccacttacaagtgaatatttaactatcttacaaccacagacatctcttttttatcctcccaatgtagaatatcatcaccatttttagttcattcaaaaatcagtgtttatactcatgattacatgccatgatcacattttattccttgcagagttttaatttttccctggtatttctcattgctgtcttttttctttgcattttctgtcactttcttgagttgttctaaaatccccaagagtgtatcaaatcttttacatttcattttttccctgagtggctcgttccaaagcctcattttctagctcttttgaggactgattgatttttgaggacacagctgtcatctggggactgctcttcattattctgattttatccactctctcctgcatctcattgtcttctccttcttgattaatgatgggtaacttttttaaagaacttcctaggaagttatgaaagagaagtaaaatgattttttacatgtctggaaatgtcttctacccctactctggactggtagtttggctgggtggagaatgttaggttggaaacattctcccttggattttgggtggctttgctcattatcttctctctctcttttttttgagacagagtctcactctgtcacctaggtggaatgcagtggcacaatctcagctcactgcaacctccacctcctgggttcaaatgattgtcgtgtctcagcctcccaagtagctgggattacaagcatgtgccaccacacccggctaagttttgtatttttaataagagacggggattcaccatgttggccaggctggtcttgaactcctgacctcaggtgatccacccgccttagcctcccaaagtgctgggattacaggtgtgagacaccgcaccctgcccattatcttctcttatttaacttgctgaggaggagtcttctgctagtctgatttctattcattgacaggtgacctgtttctgattgttttactctagaagtttttgggatctttcttttcttcatagtcactgttctaaaatttcataatgatctagcaaagtgtgaggagtttttttcccagatattttctgtgcagagtgctcagttgacccattttgcctgagactattatctcatagtgttggggagacctcttagttatttttaaaaatacttttaaaaatttaataataaaatacctcaaatgtgtacaatatgacaaatattgatatattactgtccagaattaacagatgttaacattttatcatattcgtttcatatctacatgtatatctatcatctatccaaaataccaaagatcatcaagcatcattaaccttatccttccccagaagtaacctgaagttggtgtgtatcattcctctacataattttatgattttattacttataaatgtaactataatcaatattggtagtgttttgtttgttttaaagttttatgtaaataatatcattttcttttacaacttccttttgttctcattatgtttttgagatttatacatgttaatacataaaaatctagttcattaatttcaactgtccatagtcatccattatgtgtcagttaggaaggcctcagctaaaagtaacataaaacttggctagcagtttaaatatagagattttttttttttttcagataacaggaaatccagcaataagcagtccagagctcagtgatattctcaggaacccagatttgtcttatccttctgccttgttcttagcctgtgcctttggtcttcatacctgtcacctcattgttgcaagatggctgctttatctcaaagtctcaaggtccgtgcaagaaagcaggagggtaaaggacaaactgtgcattccaactgtgtcactttcaattaggaaaataaaagctttcctgaaagtcttacccaatggacttccacctaaatctcattggctagaatagggtcacatgactattcctaaactcagtgactggctaagggcaaccagaataccgtgaatggtttatatagatcccagctcatgcctgagcctagggaaggtgactactggcaatcaagggccctgtgtctctacctgaacaaaataaagttttgtaaataggcaagcagaagagggaatggttgttggacagtgtaggagacatgctagatgactacccaatgcgcattctccctttttcccttactgacagactcaatattattttcccagtaaaaacttactttcccagagtcctttgtcagatgacccaggtgtggttttcagtaaccacatctgggtcacctttgtcaacacataatttttagtagaagtatatcccaaatattgtgctgaacatatactcaaagttatttgttgttatctgaaattcaaatttaactgggcaaactgtagtttcatttgctaaacctggcaactctatccaggaaggaagaagaaggaaaagtgaagaggctttcttctgaaaatgctttatctaggaagggactccttcctcaggttctttctcctgtagctcttcagccagagagagctgaagggtgtctgagggaagtgtttctttttagttggccatagtgctactgtggctggagcagaagtcagaaagtcagagcagaaaggggaatgggcatcagggaagtaactagcagcatcctccacaggtgttttatactccccaaatagttacatccagtggtgatattcaaaatatttaacaaccaacatggcactgacattgaccaacccaaatgaatacctgatcactaaaaatggacaccaatcataaatagcagccataccaatgcgtatcggtggaatatcaaccctgtttctattgctgttttcaggaaaattaacactcacttgatttattatgactgtgtaaatattgctcacagttgagtatagtgtaccatgattacttttcctttctatgactattcttgacaaagtttttgtatcctcttgcaacagtcaaacacatcaagaccatttttcagatccaggtttttttcctgaagacatcctgtccagagcctgctctaagatgtgcctgttgctctctggactgctgcagggttcttctccggtgactttcctttgcctatcttttgtggtgaatcccgtttcccagacttaatttctttcttagtgcaagtccttcatcttgctagagttcctccttcagtcacttcctgaaaaaaaggtgcatcgaaggtaaatttttgagatagtttatgtctgaaaatgcccctattctaccctcccacttgattgatagcttgattgggactggaattctaggttggaaataattttgtctcacttttggaagcatgacttcattgtcttgtagcttccactgtagtgattgagaaatctgatatcaattcttgtttcagattcttggtagatgacttatttttttctggaagcttttaagatttctttatccatgaagtcctaatgcttcataatgatgtgacttggagtggattttttaaaaattaattttttctgagctgatcgaaagttctttcaatcagaaaattcttccagatctttcagttctggaaggtattctcatgttatttcattggtaattttctctccactatttttttatctctcttttgggaactcctattattttgatgtttgggcctcctggattgatcctctggttttcttgttttgtcatagtatttgtttaatctctttttatttgtgttctattatctgatatactccttcaaatttatgttccaagtcttttattgaaaattttcttctaaggtatttttaatttcgaaaagttctgtcttattctttaaaaacttataggttcataggtttatagcattctgcttttcttgtcgtcatgaatacaatgtcttttcttgtctctgttgtgatttcctctaatttggtcttgagagctgtctctggagagtagccagaaaccaagatagccactttctaggagagctctaaccaggaggagagtaaggtttagatggtcaggtgagaccaaatgaaaccaaaatgcataaaacagaagaaatttattatttacagatctcaaagaggttaggggtggctgatgggaagtcaagacgcagtaggatgttcaatcagtgaatggggagagagagagagagaaaaagagagagaatgcactatattgcaaacaatcatatagggaggggaagttttaactaggccaaaggagtacaactaattgggtttcaaacaacttatgtcaggccaaaaactggatgccaagaaagcaactatattaaacaaacctatgacaatctccttgaagatattaactatctttgtttttgtctttgttttgtaatctttgtacaggggtcatgcttatcttttattattccagttttagtatatgtgctactaaagcgagcaccagctacatagttttttaaagaacctaaatgttttaaaatatatatttagggagtacaaattcaggtttcttacatgcatatatttcattgtggtgaagtttgagtttagtgtactcatcacccgaatagtgaacagtgtagcaataggtcacttttcaaccctcacccccttcctaccctcctaccttttggagtctccagtgtctgttatttcactctacatgtccatgtgtacgaattgttagctcccacttataagtgagaacatacagaatttgtctttctgtttctgagttatttcactgagggtaatggcctccagtttcatccatgttgatgcaaaagacatgatttcattttctatgactgattagcattccattatatatatataatgtaatgtatatattacatttccttatccaatcctccattgattacacttaggttgattccatatctttgctattgtgaatagtgctgcaataaacatacaagtgctggtatcttttttaatataatgattcttttcctttgggcatataccagcagtgggattgctgaatcaaatggtagttttatttttagttctttgagaatcctccatactgttttccataaaggttgtactaatttacattcccaccgacagtgcatgttttctctgcggcctcgccaacatctgttatttttggacacttttttttttttttgtgagacagagtctcactctgtcgcccaggctggagtgcagtggcacaatctcggtctgcaacctctgccttctgggttcaagtgattcttgtgcctcagcctcctgagtatctgggattacaggcatgcaccaccacacctggctaatttttgtatttttagtagatacggggtttcaccatgttagccaagctggtcttgaactcctgacctcaggccatcccccccacctctgcctcccaaagtgctgggattacaggcatgagccacctcgccaggcctagactttttaataatagccattctggctggtgtaagatggtatctcattgtggttttaatttgcatttctctgatgattagcaatattgagcattttttacatgtttgttggccatttatgtgtcttcttttgtcaaatatctgttcatgtcctttgcccactttttaatggggttatttgtttttttctttttgagttgtttgaattcctcacagattctagatattagctctttgtcacatgcgcagtgtgcaatatttttttttcattctgtaggttgtctgtttactttgttcattgtttattttgctgtgtagaagctttttagtttaattaagtgccatttgtctatttttgcttttgtgacatttgctactacatagttttaatggtttctttggctgcctacattgctcctgtttccttggactttttcttttcctgtttgttttggtatctgtcattctggtgattcttggctggctgttcatgttttgaagtggagctgccaaacagctgccatgtggccaggctggacttgttgaatgatagacttacagtgggcaattggatgcagcccttgccattttgtcagaggtccccaaaatgttggaatctggaagttctccaatgtcctgcctggagggcctaaacttcattagggttctaggagtccagcaggcaaagggctgaggggctaactgcatttacttaactcctttttgtttccccagtgaaattactcctttttgccctcagctgtccagggatcttctgtcctggctttagtctcctacagggcccctccatattctgagtagaaagggcattataggagactagagcctagaggagagacctgaggatttaacctcagaactccttatgaagattttccaccatctcccctgtgttcagcccgctctgcatcatggtcttgagatatccctattgcctctgatgtcctatttctatctttgagaaacattttgtatatgtagaggctgtctaatccttgaaggttcagataaaacatttaaaaaaaaaactatctgttcctggtgtttatttttctttgcattatagaaaaattttcaaacacaacaaaagtaaaataaatgatgatgaccctgttaacttaaagatcacatgatctatgcatttggagagaagactttatttcttgtaaagggttacagcctgcaaggtggccatgttacaggatgggaaccatagcctcagggttagatcagagacaggcacttcgaaggaggaggggaaaggcaggaatttaagttgactgggttggctaaacatgcatattcagtaggttacaggaggatctatgaatattcatgaaggtggtcctgatgcatgtgtattgaacaaacatgcatattacgcatgcccatgttcaccttgggatggagccataacatttaaatgtattacattaggcattatacgttagaaggtctttgtaggacacaaatgcgttcaagtgcacagcctctgtaaactgaccagaaccagtccatggttcatgatcttcttatcaggagggagttactaaagtcagtcttttgtccaatcaaagctatagttatggcttatggagcagggggttggttagtcagcatctgctggtagatgtgctgcaaattgttctaatattgcttgtctcaaggccagtgcttgcttagctgctagaggaaaagaaaaaccgtgtggcagttaggacacagtttattcttcaagtgtaggcgtgtataacttaacccttgcctggcctggctttaggtcttgtttacagtttggtaccttattgccataaagggtctgttctgtcagtcttattctcaattttaacataaatgctggtcagttatgtctacactgcaaaagggagatgatataaccaggtgtgtctgacctcctatcctgtcttggccaggattttggtttttaatgtatctctgggatccccttggccaagagggagtctgttcagttggtggggaggcttaggattttatttttagtttacaactctttttttttttttttttttttttttttacaactcttttgtagcataacctagcttcaataattatcaatacatgactgattgtggtgtctttcctacaatcattttaattgttattggttaatttaggttttctaatttttttaaaagtcaattttgatacttctattgtttttgtagagaagtatccatgtattagccttgtggctgagggctatagttccagaaacagattgtccagatttgtttttccatgtgggtagtcatttaagctctctgtgtctgggtttcctcatttgtaaaatgggaataataatgttatttatgtcataggattgttgataagattcaattaaatcatacatgcaaagcacttctggcacatagcaatgttaactattcttattatttaagttttaaaattaattggcatgaattttttaatggaattataatttttaaattctcaactatattttatgtccctttttcagtcctagtgttgtttacttaaaaacaaaagcatagattgcttttgttttttctttttcgtagagatagagtctcactctgtcacccaggctgtaatgcagtggcacaatcattatggctcactgcagcctcaaacttctgggcttgtatgattctcccgcctcagcctcccaagtagcttagcactacagcacaccatcacacctggcgcatatatatatgcataatatattacttttatatatattattatataagcataataaatttacttttcagaggcttttctgtgacgtagtatatgtgctctctttgtaaatgtgtcatttgtacttgaaaaagaagtgtgttctctgcttgttggaaattattcttcaatttgtttatatgtccttttttttttttttttttcttttcgtaagacagagtcttgctctgttcccccggctggtatgcagtggtgcaatctcagctcattgcaacctccacctcccgggttcaagagattctcttgcctcagccttcctagcagctgggattataggtgaatgccaccacatctggctaatttttgtatttttattagagatgcagtttcactgtattggccaggctggtctcgaactcctgacctcaggtgatccacccgcctcagcctcccaaagtgctgggattacaggtgtgagccactgcacccagttatatgtccttttgtcttagttttttatctgtattaaaatctcccattatgactgtggatttgaccatttctccttgaaatcctaccctttttaatgtatacattttgaggctgtgttccttttactttatagtcatgaaggtgaaggaggagaaggctggggtaggaaagctggaccacactaaccacaggaggagatttccggatcagaaaggtgaggtcactttgaggacttgatgcaaatctcaggaggcactgagaattctctgaatgtctttatgacagctctttcagcaggagagtctagggagcaggtcccttttcctgactcatccacagtgtctccttgaggctggtgggaccagccttcatggtatccccaggtgactgcatggtcaagctggagacaggaaactgccactttgcctatgtggattagaatatagcttccccaacacaaaatgtaactcacctaattttacaagatctgcaaaccataataaatgccaaatatcaacattttatattaatagattcccaaactgacagcacaattaaaaccagtgcaagaggatgttgaggtggcaggtatttctgttgctccagaattgctgactttagctgcccaaagcctcctacacactacagagaagaagccatggggcttatgaaaaggcaatcagatgggcggctactgccatcgttaccccagccccacttgaaggaaaataccaacctcgctgcccacctagaggctcggtgagctgcagaatgtgtagagccactctggagctgtcaagcaagaaaaatgccctaaagagttgctaggagaacttggcacatgtcctgagccaaactgcaagatacttaccgtgagaggagaggtcttgtagagccacagaggagaatgtagacttgggggagggcaagccactccccacagttcaccagctaaatcaccatgctcttttgattatgatagaagccaagaaaagatgggacaatttagattcagaacagaaagtaaaatagttttttgacagccatctcctctgatttctataataaatatactcttcctgtgtatagtcccttacaatttgcataatcatgttcttatacatgatcccattctatcttttcagaagccagtttggtagagaaaggattttcattcccacattacagatgagttcaccgagtcccagagaagcaggatggccacagatcaagtaaaggacaagccagggagcacctagggcagctgcctcttgggttggggcctttctgatatacctgcttcttttcatttccattcctggcctcaagggtggagaataggaacttgctgttggaagacccaaatatgctaagcccttagagtggaactacttacctctaagtgctagtgtctactgcttatctcaaattgcagcttgcttaaacaatgcagtatagggaagggaagttccaccatgatgtggggaggtgagaggaggaagaagggaaactagtcattctgacacccgtgccctaggaagtgaggccatacttcataagaatctccacttcgttttcttcatccctgttacatccaggagagaatgggatccagaagagcatgcagtggggtgagctgggactttagacagatttggacactgacatccaagtaacctgacccctagtacctaggaatgcaccaaccagagtagactcataaaacatctgtctaaagcatattcaacatctctctaaagcatattcaacttctctctaaaaggcttagacatgcttctccatagttcagctgagaaacagtatagcgttatttgaaagtggacatagattagttctaactgtatattgcaaagtctagggcaaacactagaattttttaagggatataatttatacactcagagatgagagaaaacagaatcatataaagtgctcagttaaaaccagaggaggagctgggcatagtggcatgtgcctatagtccaagctacccaggagacagaggcaggaggattgtttgaggctaggagtttgaggccagcctgggcaacacagcaagaccctgtttcttaaaaaaaaaaaaaaaaagaccaaaaagggggaagattaaaaaaaaaaaaaggacaagtgccacaaacacaaaattgttgtaaacatggtagatattaattcactgatctcaataatcactttatttatttatttagagatgaagtgttgctctgtcactcaggctggagtgcagtggtgcatcttagctcactgcaacctctgcctcccaggttcaggcaattctcatgcctcagcctcccgagtagctgggactataggtgcccaccaccacgctggtttattttttatatttttagtagagatgagatttcgccatgttggccaagctggtcttgaactcctggcctcaagtgatccactcacctcagcctcccaaagtgctgagattacaggcatgagccactgcacccagccaataattacttcaaatatgaatggtctaaacatatcaattaaaaggcagaggatgttaggcaggatcaaaaaacaagacccaactatgtgacaagaaacctacattaaatataaagacacaggccaggtgcgatggctcacacctgtaatccccatactttgggaggctgagattggaagatcacttgaggtcaagagtttgagaccagcctggccaacatggtgaaaccctgtctctactacaaatacataaattagccaggcatggtggcatgcacctgtaatcccaactactcgggaggctgagtcaggaaatcagttgaacccagcaggtggaggctgcacagagcaagactctgtctcaaaaaaaatgcatatacacacacacacacacacacacacacacatatacacacacacatatagagatatagatagataggtatagatatagatacagatggattagaagtaaagggagggaggaagatataccatgataacactaatcaaaagaaagcaagaataggtatcttaatttcagacaaagaagaattaagagcaaagaacatctctttaacagggataagggagggcattgcatcatgataaaagggtcaattcttcaggaaaacataatagtccttaacatgtatgtacctaacagcagagcatcaaaatacatgaggcaaaaaaatgacaaaactgaagacgaacagacaaatcagtgattatagttgtggacttcaatacccatctaccagtaattgacagatccggcaggcagaaaatcagtaacgatatagttgaaaggaacagcatataaatcacctggatttaattgacatttatagaatacttcgtccaacaatagcagaatgcacattcttctcaagctcatgtagaatatccaccaagacagaccacattctgggacataaaacacacctgaacaaatttaaaggaacagaagtcatgcagagtatgctgtaacaccacattggaattaaactaaaaatcaataacagaaagattactggaaaatcccaacatatttagagattaaacaatacacttctaaataatatatgagtagtcaaagaagaagtcttaagaaaattttaaaaatattttggactaaatgaaaatgaaaattcaacttatcaaaatttgtgggatgcagcaaaagcagtgcttagaggaaaatgaataacattaaatgcatatattagaaaagaagaaagatctaaaagcaacaacctaagctcccatattaggaaacaagagaaggaattgcaaaataatcctaaagcaagaagaaaaaagggataataccaaatagagcagaaatcagtgaaattagaaataggaaacaatagagaaaatcaatgaaactgaagctatctcttaaaaagattaataaaattgatgaatctttagccaggctaaccaaggaaaaaagggagaagacatacattaatatcagaaatgaaaggtgatcattattgattccatggacattaaaaggataataaaggaatattatgagcaactctgtgcctacaaatttgataacttaggtgaaatggactaatttattgaaagacacaaactactaaaactcacacaggagaaataaataatttgaacaggcctattactattaaagaagtaatagataataataattaacaacttaccaaaaaaaaaaaaagagcaacaggccttcatgatttcactagtgaattctaccaaacatttaaggaagaaaggatatcagttgtctacaatctcttccagaaaatagaagcagaaggaatgctttctaactaatcccatgaagtcagcattatcccaatacaaaatgagataaaggcatgacaagaagaaaaactacacaccaatgtcccttatgaatatatatgcaaaaatcctcaacaaaatgctagcagatcaaattcaacaatgtgtaaaaataattatacaccatgacccaaaaggatttatcccaggtatttaaggctggtttagtattcaaaagtcaattaagataattcatcatatcaataggccaaaggagaaaaatcacacaataatgtcaatagatgcagaaaaagcatttgacaaaatccaacacctattcataataaaaacttgcagtaaactaggaatagagggaaatttcctcaacttgatttttaaaaaatctacaaaaaacctatagctaacatcatacttaatgatgagaaactgaaaactttcctgctaagatcaggaacaaagcaaagagatcccctttcaccagcccttttcaatatcatactggaaattctagctaatgcaataagacaaggaaaggaaataaatgtatatagtttgggaaagaagaaataaaacatctttgttcacagatgatataactgtctatgcagaaaatcccaaagaatttaccaaacaactcccataactaataagtgactgtaacaaggtctcaggatgtaaagtcttaggatacaaaagacagttgcttttctatataccagccattggaatttgaaatttaagacatgatacactagcaccaaaaattttagacataaatctaacaaaatgtatacaggatctacatgagaaaaactataaaagtaatgaaagaaatcaaagatctaagtaaatgaaaaaatattttggccaggcacggtggctcatgcctgtaatcccagcactttgggaggccgaggcaggcagatcacgaggtcaggagatgaagaccatcctggctaacacggtgaaaccccgtctctactaaaaaaatacaaaaaaaaaaattagccgggcgtggtggtgggcacctgtagtcccagttactcaggaccctgaggcaggagaatggcgtgaacccgggaggcagagcttgcagtgagctgagatggcgccactacacttcagcctgggtgacagagtgagactctgtctcaaaaaaaaaaaaaaaaatttcatgttcatgcgtaggaaaattcaacattgttgtcagttctccccaacttgatctatagatgcaatataatcccaataaaaatcttagcaagttatttttttggatgctgacatattgattctaaagtgtatatggtaaggcaaaagacccagaatagacaacataacactgaaaaagtacaaagttgaagaactgacactactcaacttcaagacttactgtaaagctactacaatcaagtgtgatattgtcaaaagaacagacaaattgatcagtggaacagaataaatagcccagaaatggacccacacaaatataatcagctgatctttgacaaagacacaaaggcaatttaatggaagaagaataatattttcagcaaatggtgatggaataactggacattcatatgtttaaaaaaaaaaatgaatccaggccaggtgtaatggctcatgcctgtaatcccagcactttgggaggccaaggcgggaggattgtttgagcccaggagttcaagaccagcctgggcaacatagagattttgagactactaaaaattaaaaaaaaaaaaatagctgggtgtggtgatgcatgcctgtgatctcagctattctggaggctgaggtgggaggattgcttgagcacaggaggtcaaagcttcagtgagccatgatcataccactgcactccagtctggatgacagagtaagactctgtctcaaaaaaaaaaaaaattcagacatagtccttacacctttcaaaaaatcatctcagagtggatcttaaacctaaatgtataatgcaaaactacaaaacttctagaagataacatatgagaaaatctaggtgaccttaggtctggtgatgagtttttagatacaaccctaaaagcacaattgatgaaaaaaaaaaaatgataagctggactctgttaaaattgaaaacttctgctctgtgaaagacatttaagagaatgaaaagaaaacccacagaccaggagaaaatatttgcaaaaggcatgtatctgataaaagacttgcatctgaaaataccaaaagaacttttaaaactcaataaggaaacaacccaatttaataatggacaaaagatatgagcaaacacctcatcaaagaagatatacagatggcaaataagcatataaaaagattctaaatgtcatatgtcagttgggaatttaaaattaaaacaataagatccactaacacctattagaatggctattttttaaaaaactgccaataccaaatgctgatgaggatgcaaagcaataggaaatgctcttccattgctggtgggaatgcaaacgatataaccactttggaagatggtatggcagtttcttacaaagctgatcatagtcttgtcgtccgaaccagcgatcatgttcctaggtatgtacccaactgagttgaaaattatgttcacatagaagcctacatatgaatgtttagagctgcactattcattatcaccaaaactggaggccaccaagatgtccttcaataggagaatggatgaacaaactacagtacattgatcggtggaatattgttcagagatagaaagaaatgaggtcatcagcaaagcctgagtcctttcctctcactctcctccccggacagcatgagcttcaccactcgttccaccttctcctccaactactggtccctgggctctgtccagccacccagctacggcgcctggctggtcagcagtgtggccagtgtctatgcaggtgccgggggctctggttcctggatctctgtgtcctgctccaccagcttccagggtggcatggggtctgggggcctggcatggggatggctgggggtctggccagaatgagaggcatccagaacgagaaagagatcatgcaaagcctgaacgacctcctggcctcctacctggacagtgaggagcctggagactgataacaggaagctggagagcaaaatccgggagcacctggagaagaagggaccccaggtcagagactggagccattacttcaagaccattgaggacatgagcgctcagatcttcgcaaatactgtggacaatgcccacattgtgcagatcgacagtgcccatcttgctgccaatgactttagagtcaactatgagacagagctggccatgcgctagtctgtagagagcgacatccgtgggctccacaaggtcattgatgacaccagtgtcactcggctgtagctggagacagagatcgaggctctcgaggagctgctcttcatgaagaagaaccacgaagaggaagtaaaagacctacaagcccagattaccagctctgggttgaccatggaggtacatgtccccaaatcttaggacgttgataagatcatggcagacatctgggcccaatatgattagctgcctcagaagagccgagaggagccagacaagtactgctctcagcagatggaggagagcaccacagtggtcaccatgcagtctgccaaggttggagctgctgagatgatgctcatgaaactgagacgtacagtccagtccttggagattgacctggactccatgagaaatctgaaggtcagcttgggaaacagcctgagggaggtggaggcccactacaccctgcagatggagcagctcaatgggatcctgctgcacctggaatcagagctggcacagacccaggcagagggacagtgccaggcccaggagtacaaggccctgctgaacatcaagctcaagctggaggctgagatcaccacctaccactgcctgctggaagatggcaaggacttcaatcttggtgatgccctggacagcagcaactccatgcaaatcatccaaaagaacactacccactggatagtggatggcaaagtggtgtctgagaataatgacaccaaagttctgagacattaagccagcagaagcagggtaccctttggggagcaggaggccaataaaaagttcagaggttaaaaaaaaaaaaaagaaatgaactatcaaaccttgaaaacacatggaggaagcttaaatgtatattgctagttgaaagagccaatatgaaaaggcttcataatatatgattcctgtaagagtgaaagaaaggaaagaaacacgaaaagtggctcggcagtcaaagacagttttactttggagaataaacctgagaggggtttctggccgatttgggtcagaagcgctctctcttacagactaagactatttattttagggtaagagaacttaccacaagcttggaatgtttctgtttggggaagaagttttggtggtgttggaatgtctctggtcagagaggcagttatcctggggctaacatctctctggccagaggggaggttatctcagggctggcatgtctctggtcagggaggggttttgaatgtttctagttggagatgttatttgtggcttatggtcatgctcaccttagccattaggctgatgccctttggatttaggtggtttttgatcaaggtgaactttagaatggcagtgcttgtccaacaagatggcaatgctcctgctctgtcaattccaactctgtgatattttggaaaaggcaaaattgtagagatagtaagtaaaaagggggttggagccaggcacggtggctcacgcctataataccggcactttgggaggccaaggcgggtggatcacaaggtcaggagttcgagaccagcctggctaacatggcgaaaccctgtttctactaaagatacaaaaaattagccaggcatggtggtgcgtgcctgtaatcccagctacttgggaggctgaggcaggagaattgcttgaacctgggaaggggaggttgcagtgagccaagattgtgccactgcattccagcctgggcgacagggcaagactccgtctcaaaaaaaaaaaaaaaaaaaaaggaaagaaaagggagttggagggaggaaggggtgggatgaagaggtgaaatacaggatatttagagtagtgaagctattctatatgatatataattgtagatgtatgtccttatgcatttgtcaaaacccatagaagtatctatacaatagaagagtaaactttaatgtaaactatatagttaataataatgtgtcagtattggctcattaattataacaaatgcaccacactaatgtaagatgttaataatagggaaagctgtaggggcagaggtaggattagggtcgaggtaggtatattgaactctgtgtgctgtctgctcaataattctgtaaatcttaaactgtcctaaaaatctattaattattttaaaaattgttgacttaagacaacactgatgttaaactgatagcaatgtcctatctgagaggtgagggaattccagctacctctgtgtgctttgcccattaccctgggtttcaatagtaatcaggcttattagtgggattctgaattagggctcttggtaactttagttcttagaaattttagtttacaaagccagctttgtgaaaccctcaataactcacttttctgataagtagtctatgtagtccttgattgttagtaaaaatggctctcagtagaaatgcatatgactttctcataacaatcaaagagggcacttggcattttgaactacatctgtgacccactgagggactttccccttaaccacgtgtcataagccatatccagtaatcactgttccggacaagcaagaacgggggaatgggagttctgctcattctaacagaattctaattatagcactgagggtattccctccagcaactgttgatttggttcattaatggaacttggtcaaacccaagcctcagggcaatgaccccatcctggcactccatgtcttccattttgcttctgcagcccaatctctttgtaactgatgaatattatgaaaaaatgccaattttcagtaaccctgcctcccctgtcttttgtgccgtgtccacagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcgtgagttccttgaggggtacattctggggagccatcctgctggtgtgtccagatgggacccagcagggcaggggggattttctggagaatgtgggtaacgctccacatggctcagcctaacctctctggccccctctgctctgcttccattgttggccaaccttcctgctcactgacacttttggtcagactgacaccctgtctttctctggggactttgagacctcgactctgatccattctatgttgatttcatggtttgattctcagaattatttccctcatttccaaattccaaggaccatacggtcattgccctaagaaccaataatggacatgcggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagccgggcgtagtggcgggtgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaataataataatggacatgcttgttttgtatgaggcattgtgctcagtaaattgaagttcttgttacattagctccaccctctctcctcactggagctgaaagacctggtacagaattgtgtagtcaccctgcacggtagcttgcaagacacctaggaagctttcttccaggacaacaaagcccccaggccttcctctgctccttcagaaaatagttctgggctaattaaaaatcagtcttttgctctttcctatggaaagaaaatgatcaatcttaagaggagtaaaaaggactggaatccttagagcacaaatgtgacattttactgtgactttactgatgtttctggggacgtgatttcactctcagcatatcccaaacctgcctaataaacagtatgaatttggtttctactatatatagctcactgtcttgagtgtggaaaagttggtttattataccatctataccttccaaggagtgtcagaggcagtgactgcatcttagtatcctggcaggagacctgatgcacctgctctcacaggccatgggagctacccccaaccctgcagagccctctacaacccccatcattggcattaggttgaccagggcctgtggcttttacagagtaaatgtgcctttgtaggagatggggtaatggtaaatcctttggaggagtccagtgtaagagatgggctatagttaaaatacaacacacacacacacacacacgcacacacacaccacatgcacaggcatacacagacacacaccacacacacacaaaaaaacacttccacatgcacacacacacacacacacacacacacacagtcctgctcaggagtgggaacatcagagaccaagaggaaagcaagcctgctgggaagacctcttgcccccgtgtgggttctggatgcctcacacatactgacatggtctctgagatgttcccctgtcacctcaccacctctcctacattcaggattgaggtcgtccttggaaggtggagtctgctgggtccttcctgagccagagaagaagaaagcagtttagatttggtgccctctgctcaaagagtttagaagaggtgacatagaacatcacagaagtagttatagatggtggatttgacattgctttggtggtgtcttgttcagttaagtggacactgattttaaatgcaaaccaaaggaaaaagaatgtagaacgctttggcatatatatatttttgagacgcagtctcattctgttgcccaggctagagttaagtggcgcgatctcggctcactacaacctctgcctcccaggttcaagtgattctcgtgcctcagcctcgcgagtagctgggattacaggcacgtaccaccacgcccagctaatttttgtatttttagtagaaacagggtttcaccatgttgggcaggctggtctcgaactcctgacatcaagtgatctacctgcttcagcctcccaaagtgctgggattacaggcatgagccaccacgtccagcccttttggcatatttgtaccaaatatattggtgcatttccttcaccgtctgctcttcctatactatgtgtgtgtgttactggcttgttcccgacagggctgtggagtaggaaagggagaatgggagagcctaggaggacagggaattgtaggccatgtctcataagctggagtaaagtaaaaaccccttttaaagggaaaataaagtcttgtgtacccatgaaaatgcatttgtatatttgtagggccccaggaagccacatattccaatttgagaaataatctaactaattagggttttattccataaaaatatcttccaattatgaattataacccaaattttgctgttccatctaataaaaggaatatttttaagattatcaaaatggaagcaaaatttaaaagttcaagtaaaacctttctacccctgagaatacattccagaccccagttccagacactccggtttaaggaagccacaaagcctggtaacaaagtcaccaaccacagtgatttttctgcagcccatgggcattgagttggtttctgctgttcttcacggagtggaagtctcaaccctcagtctttcacttctaagcaaaatgggcattgtatgtgtgatacagatataaaccttgctcttgccacatctcagggatagtgccaatgccctgcagaagtcaaaataaaacagcgccagaatcattttacctgcctcatctggataattgtctgaatctcccacttctctttgctgtaggacacctgaccacatatgtttttcctctctgagtgtcctgtctgttctgtaaatccatccagacacctaggcagggggcccagctggtctggctgcatagcccagcaggaactcccacttcagagaacaggggcatcctgcagagtatgaggggcctgggccaggcagggtggctagatgtgtctgggcctgagggtcaggcacactatgcagatggaggattgagcagagaccccttcagttcctgccttacagaataatggcaaagatccaataagacagtatatgtgaaggggcttggtacctgtgaaagccccctgagaatgatagttcaatatcatttttaactaaatgtataatattaataatcataactataaagttgaaacaaaggccaggtagctgacttttattccttccacagagacccacgagggtggctttaatatatgctgcaaggttcctaacctccaggacagttttgaaatacacaatccagctgcctgacgtgttagatgtgaatggggcttgggtgtctgtacttttctattaagttccagtgtacctggttaaaaaatacactatcctaaagaaatttgatgcttccttgaaccacatttagcttacagaaccctgtgaagtccctgctttaactctagttgaggcccaagtaactgctggtcctcattcccacagcaggtcaggggcaggaaagaggccagcccaggcatccttgtccttcttgtactggctccatgcgctacatggaaagcagccccttgctgcaaagttgctctctggatcatgtcagagctccttggagaaaatatcttgcacctggagatgacagacccacaaacagataagcataaattggtgggaggtgcgttgatggaggtctgcacaggaaactataggaggagaaacaggagcacataggcctaggtggtgagtggtggcagagggggcagcacaggcttcctggagcaggtgacacctgtcatgagtcttaaatgataggtaaaaattagctagaaaaggcagctgggagaattaaggaaaaggaaattcatacatttctcttttctagctttattgaagtataattgacaaaattatacatgtttaaggtataaaacatgatttgatatacatacacattgtgagatgattaccacaatcaaattggttaacaccttcatcaccactcatagttacctttgtgcgagtgtatggtaagaacacttaagatctctctaagcaaatttcaagtatgcaatacagtattattaactatagtcaccatgcagtacattagatccctggaatatttttatctttgaccaacatctccccatcttccacatccgacccctggtaaacactgttctgccctctgtttctatgagttcaactttttcagattccacatataaatgagaacatgcaatagttctggcttatttcacttagcgtcatgccctcccggttcttccatgttgaaacaaatggcagaatttccttcttttttatggctgaataatattccattgtatatatttgtatatgccacattttctttatcccttcatctgtcagtggacatgcaggttgtttctgttttggctattgtgaataatgctgcagtgaacatgggcacgtgggtatcttttcaagatactgatttggcttcctttgggtgtatacccagagatggggttgttggatcatatactagttctacttttatgttttgaggaacttccatattattttccataatggctgtaccaatttacattcccaccaacagtgcacaagtgttcccttttctccactttcttgcccatactagttatcttttgctttttgtagccattctaacaggtatggggtgacatctcactatggttttggttttaatttgcatttccctgatgattagtgatggtgagcactttttcatatacctattggctatttctttgttgtattagtccattctcacgctgctaacaaagacataactgagactgggtaatttataaagaaaaagaggcttgatggactcacagttccacatggttggggagggctcacaatcacggcagaaggtgaaggaggagcaaaggcatgttttacatggcagcacgcaagagagaatgtgcaggggaactgctctttataaaaccatcaggtctcatgaaatttatttatttattgagatggagtttcgctcttattgcccaggatggagtgcaatggcgcaatctcagctcaccgcaacctctgcctcccgggttcaagcaattctcctgtctcagcctcccgagtatctgggattacatgcatgcaccaccacacccagctaatttttgtgtttttagtagagatggggtttctccatgttggtcaggctggtcttgaactcccagcctcaggtgatctgccttcctcggcctcccaaagtgctgggattacaggcatgagccactgcgcctggcgagatttattcactatcatgagaacatgggaaaaacccaccctcatgattaaattacctgccaccaggtccctcccatgacacatggggattataggagctacaattcaagatgagatttgggtggtgacacagccaaaccatatcatatgtcttctttagaaaaacatctattcagatccttggcctttttttaagggtctcactgtgttgcccaggctggacttgaactcctggtatcaagctatcctcttgcctcagcttcctgaggcactgggacaacaggcacatgccactgtatctggcttcctttgcccatttaaaaataggatttttttctttttgctattgagttgtatgagttccttatatattttgggtatgaagcccttatcagatatatggcttgcaaatcttttctcccattctgtgggttgccttttcattttgttgattgtttcctttgccatgcagaagccttttcatatgatattgttgcactagtttatttttgcttttgttacctgtgcttttggtgccatatccaaaagaaatcactgccaagaccaatgttaaacaacttttctcctgttttcctttagcacttttatgttttgaggtcttacatttaagcctttaatccatttcaagttaattttttgtcagtggcataagatggggtccaattttattcttctgcacgtggatatccagtcttctcaacaccatttattggagagactaatcttttcaccttgtgtattcttaccactcttgtcagatactagttgaccatgtatgtgtgcatgtttctgtgctttctattatattcccttggtccacgtgcctgtcttaatgccagtaccatactgtttagattactatagctttgtaatatagcttgaaatctggaattacatcttctcaattaatcctcacaccaacagtaaaagggagatattattatccccatcttcagattgtgaaactaagattcaaagagatgtagcataatgcagatgttaatcagtgaatgtgggaaataaaaacagatctattgactccaaagactgtgcttgccctttcactacattgctttcctttataagatgtcattggtcagtcaccatattggaccctggctgataatgatgtcctttcaagtagccaaattgcctcatgttgaaaggaatagataggtaggaaataataggccatagcagttggtttatttattttctctctctccctccttaccacaccttcccccaatgtgaatatattaataatttaggaagtcaatacttagtagccaatcaattttgactgaagcagaactcatatgatgaatagaatcatcaagctgtggtgaaagtcagtaggagccagggtttctaccctggggggaaaaaatgtgttttctggctgtgaaaacctcttgagaggccattaggagaaagaggattagaagcagctttagaaatgtggttgcacttccacttttctaggctgctaataagaactggagccagtttaagagaaacaaggtcagtcaagcccaactggggtgtgtagaccctggagtctcagtattctcatctggagagtgaaagattgttgcagggtggccaattgtttcagtctgcccaggactgagacttgtcccaggatgagggaggaaggactttcagtgctaaaaccagatcggtcctaggcaaactgcatggttgttcatgccagattgctacgagttgttaaatgagagataaatagatattagatacctcacatggtgcatggtgcatggtaggcacttaacatatagttggttcactttatacacattaacccaatttaagagcaccacgcccaaatctttttcctctaaagtgggcatttgtttgatttggctgccctcgttggtactgagaagcttatgagatccttctgatggaaggagtgtgaaaaatattcaagccttcatctatttgccaggtattgagcagcgctgggatcaccaaaagatcaaaattaccctaagatgagaagtaaaggagagaaaggctttctattaagacactggaacctcacaaggttccaaagccttaggaccaaagacatgtttcatgttgtctttcttttctgataagaaaggagccaagggttaggatagaaaataagtttatctctaaaacatctcctgcactaaggagtccctgaggcaggccacgtttcaaacatgggagcaaagacaactggctttcttttttttttttttttttttgagacagagtcttgctccgtcacccaagctggagggcagtggcacgatctcggctcactacaacctccgctccaggttcaagcaattctcctgcctcagcctcctgagtagctgggattacaggcatgtgccaccacacctagctaatttttttttttttttttttttttgtatttttagtagagacgggtttcaccatgttggccaggctggtttcaaactcctgacctcaagtgactcaagtgatccacctgcctcggcctcccaaagtgctaggattacagacgtgagccacagtgcctggccgacaattggctttcttttagggtttgaaactttaaaattggggtggcttcctcacctttgtctacttaatttggatcttgaaggaagtggtgaagaggggagaagtgagaaaagagaaaaggaggaagaaaaaggagaaaggataaagatcattctagaccttttatgctccccccaaccctggggctggggaaggaagacaaattaaaattacctcaaggaagtctgtttctacaccactctcttcttgccctttaacaccttaaaaccaagatcgccccgaattttcaacatatactgcattccctccctagccaagagggctgttctcctaaaaaacaaaaacaaaactcaagcaaaaaaccctaccaggagagaatcttgagttagtgaccttaagaccttaaggggaaatgggttgagagcctgaatttgcaagtgaaccaatgaaaatcctaatataaagtttttataaccttattcgatgtggttaactaaaatagactccagcctcctcgccacattctagaataggcccacacctttgcttaaatgtctgtgaatttccaaaggcttctagtctcagcgttgccctggctccaagtccctgcttggtggactcagtctcacagtgcttcacctttggcatctgttctctgctttcacctccaggaaagcccaggtatggagttctgccctgctgtggtttcctcaaaattggtcgtttaaggcacataggtgagcagcaggctttgttgaaggttcagaaccatggagggggtttactttgtagagatactcaattttttctttttcttttttgttttgttttgtgttttttgtttttgagaaggagtctccctctattgcccaggctggagtgcagtggtatgatctctgctcactgcaacctctgcctcccagattcaagcaattctcttgcctctgcctcccgagtagctgggactacaggcacccgccaccacacctggctaatttttgtatttttatcagaggcggggtttcaccatgttggccaggctggtcttgaactcctgacctcaaatgatccacccacttcggcctcccaaagtcctggaattataggcatgagccactgcacctggccgagatactcaatttttaaaatgagatattagatatccctgttcttaaaaatcctctggccactgaaggtttccccttggccaccttcctctgtagtttcaccttcctaccatatttttggcaactcccaccccccatcactgccctcctgagtctcctcgtatctccttgcttctcggtttctgagccccctctcctcagcgccccctctccaacacacacacactcactccactcactttacctgtcatatgatttacctcggtctctctcaccttagctcagagcccattttcacccaactggactcataatgtgttgaactaaacacaaagaccatctatcagtctagcgcttatgcagcataaaagaactgaaagagggccaggcatggtggctcacacctgtaatcccagcacttcgagaggctgaggcaggcggatcacttgaggccaggagtttgagaccagtctggccaacatggcgaacccagtttctactaaaaatataaaaattagccgggcgtggtggcagacacctgtaatcccaggtactcaggaggctgaggcacaagaattgcttgaacactggaggcggaggttgtagttagctgagattgcgtcagtacactgggcgacagagcaagactgtgtctcaaaaaaaaaaaaaaaatccaaaaaactgagaggcctttaaattttcttctctcctttctccgtccccactggcctctgtcagatgaaagaagcgggatcaagattcaacttcctactgatatcattaggctccatacccctcttggcttggaaggaaaaagcagagcaactgttcagtttgattttaaatgacagcttcttcattatactgcatttatatctaccaaaacagaacaataaggacaacatgcaaattgaagactcttggtgacatttttaaatcttaaatcatgagtaataattgccttttacccttttggttttccagaaacgtctgattctccttcccttgtgcgccaatgagatggatgtcgttgttctctttttgctgttgggtcttataatgctcggggcctttctgatttcacactgaggttgttgcccttcccaggcctggtaggtccagagtggcgtagggaactcagatgggaaagacggagggatctcttacctgaatttctcagctagccttgactgagtctcccctgacccccaacatacttaggccttctccagccttggctccatccacaagcacttttggggggctggccatgcacatgccaggctctgccagcccctctgacccagctgagcttcctcccttatccaaggtcacggagtgtttcctttgcctctctttctttctttaggcctgccctgcctttttttactccccgctcttttacttttcacatgactaggcttaatctaactattcttatgacagtgactcaacattcttttataacctttacacttatggttttcaagaaggtactcagaaaaaaatctccacactctagaatttcatacaaaggggactcatgattaagaaggtaattttatcacaatgccagaaacctatttgaactggcttggggaagcagagagagaaggggtgtggggagagattgtttatattacaagaacaaaggagtttctcacagtcccaaagcaaaacgaagagccgggctcaagtgggtgagcgcagtgccttctcagccccctctctgggtgtacacagccctttcccacagcttcgcctctaggctgcttcctctctttgcagcccagccctttctgcctcttccatttaccagctctgtctcccagaaaccatcaggaaaggcccagctaactcagagacccaattcaaaattcacaggcttgggacaggtgtccaatgaaccattcctgctccaattcattgtggccaggagcacaggtcacatgtcacacaaatacagctgcccagggtcatccttatgggaggaggggacatgggctgggcagacattccaaagccacccaccccaggaaggattcccgtgaacacagcaagtcagcagattctctcctcttcctctctcagagggcacacttggagtttgtatacagccttctagaaaaagaatgttattgcccatgaaactaggactcagggcctccaagacctacttcacacagttggcaagaatggttttggctcctttgggttccctctcccagtccccaatagtcagtggcctggagtcacccgaatccccccatccctgccccctctgcttcaccctcagctccatttccttgttcttggctcctctcttgctgaggccagcctcagcaaatatactcccgagtgtcaggcagtcaaatccattcacccagcaaatatgcattgagtacacatgctgtgtgaacccatgtcaggggccagcagtgcgatgtgaacaagataggccctgacctcacaaagctgaccgtgtagccacccatcagggagccgatgagagagagaatgtctgaaaggacttgcccagagctgaggaccccaggatcgtgtcctgatgttgacttccagatggccataatggctcccagatctttactaagagttgaagtccacactgcttgctagtttgcaggccactagatcattttgtgctaagtcagtccccacccagtaaaagcatgattctttgtgtggctttagtgtgcctcctgaagcggtccccatggaggttatgtttctcccagcaactgctgttagaatccattcctatagttgggctggcactttgtgactcttgctgttagctatagaacagaggggctattacctgtggcatttctcattatgtggattaacttctgacgtgctgcacacatgtgggatccgcagggcattagagaaaccctgacccagtggcccagcatgtggtgagctaaaccttctgtgggcagaagggaggggcagagacagcgtaggggcctgggatggagggccagaggtagcatgggaggagcatggagtctagaagctgagaaggattgggcccttggaatgtttagagggaacaggctggtaactggtagtaacagaggaagcatctcacctgctggcatcaacaataatagcaatatcacctattgagtgactggtgtacacgagtgctgtgccagccagtcacattacatgtattatctcattgaatccctgccacagtccagtgaggggggcgtgattattaccgcttcatagatgaggaaactaaggctcagtgggagcttgatgtcttgccaggatcctactgctagtaatagcagagtctggagttgagcccaggtctgggctcttaaaacaccacatgaataaagagggtctttttgggatccttggccatctttttttgggtattgaggccacccacagggcctgacttggtgtggcctgctgtggccactcagaaggagctgggtcaacctcagccacagtgcagtggaagctgcagagcctgggaccctcaggcagggcctggtgtcctctgcttctgttttctcagctttaaaacgggcatacttgtggccacgtgtgatggctcacacctgtaatcccaacactatgggaggctgaggcggaaggattgtctgagcacaggagttcaaaaccagccttgcaaaacatagcaagaccctgtctctaaaaataaaataataaaatgggcgtacttgatcctcgagcctcaggtatgaaaatgtcaccagtggagccagcctcaatggggcagtgtagggggagaatgtcagatgtctgttctcccccaggctctgctaacctgtgttggggcctagggggcctatggggtaaactgggtcttggttttctcatccgtgaaatgaagggtttggacttgaccatcactaagctccctcccagctctaagacttagtgaattcagggtttgtaactccctggagcagccaccactcagtgacctccaatcaaccttggcacattctaagtactcagtaagcacttgttaaaccaaacccaggagattaggagtttctcagaagagcaaaataattccccagtggagtttacctcacactctgaagtgacgagcttccactgtccgtgggctctcagaaaacacctgccgagtggtgacacttggcactttgcctgagaggtggaggaacaggaagtgtatcaggagtttgggtttaaagttggggaggaaagaaaccagctacatagcacattatcgagcactgcttggtcagtgtgagaccccacagcaaacactcccctccagcaaccccactccacctttggggctgtgtggtggagaggaagggccctgctaggttcctctccagccagctcacctgccaccaaggctcctaaggaggccctggggaatctcacagcacatcctacccctgcctttataaaggggcctgcagagaggatcctgggctctcctagagaccacaggcacataggaagcactcatggggaagggggtaaaggggcagttttgccagtcctctcacaggtcctcagctgccaccacccctgctgctgtggagacccggcttcctgcttgaggttctgctgcagccactgagcctttctctctctagtgcacctgagatttctctctcaccctctcacttctctctctctcttgctcacttctctctctctctctctctctctctctcacttctctgtctctctctctgtctctctctctctcagatctttaattaactcagtgtagcttttctctctcaaacacttttgcataatctttctcacacttacacttaccacacctatattctctctacatatagcctctctctccacctccccagtccttcacacattccttttctctctctctttttctcccctcaaaccccccttcttctctccccacacctcccctggtgcttaactggaaacaaaagtgagtttgttgtgtgaagaagaggacctgtggaagtagcagccagggaggcagcagcggaagcaggctggggccagaggcagcatcgacagccagggaccccagcgctcagctgttccagggagcaggtaatgccccaggcagaactggtttgcatcctgctctctgcctgtctcctctctccaggacctgtccatttatttgccttcttgtctggccttgaaggggaaaggggattccagacttagggaatggcaggcacaggggcccaaggagtagcatgccctcctcttcagggatgtggtctgctgtggctggggtcggggtggctgggtgagggacatgctagaacctagaaaggcaggttagggctatattatgaggggtggtttgagccatgtcactgacccctaggctttaggcaatagagagacattgaaagtttttcaactggtgaataacataatcaaatctacattttattttattttatattttattttctttttcatgccatcctccaaggtacatcaaatctacattttaaaagagtagttactgatttctgatcccagggagaattggtatggcccctcagaatcaagcagtcacagttttctcaattttaagaaaaaataaggttattttctcaattgttggttttttgtctataaaatttctttaaacatttggtgtctgctagcaagcgccagcaatcaataagacaatggaaaggatgtaagttaaaagtaataggctgggtccagtggctcatacctttaatcctggcactttaggaggctgaagcaggtggatttcttgagctcaggagttcgagaccagcctgggcaacatggtgaaacctcgtctctacagaaaatacaaaaattagccaggcatggtgacatgagctagtactcccagctgctctggaggctgaagtgggaggatcacttgaacccaggtggtggaggttgcagtgagccaagattgtgccactgcactccagcctaagcaaaagagtgagactctgtctcaaaaaaaaaaagtaatagaaaaattgagaaatttaaaattcatttaaatacatgagtccatgagttctgtagataatagtgtgttctgctagtaaaatgatttctaactcatatgtatagtgttttatggtgctattcaaagagaaccatgactcccaggagcccattgtgtgaacatgtttgaaatgttttaaaagcacactctactgctacatagggaatgggattaaatgggacaaccagaggcaatggcaacagtaggtggctattgcagtgataggagcagatgatgagagccagaaccaagatggtggcaatgggtggggaaaaaaggagagagccaaaaaatgtttatgaagcaaatgaaagacattagtgtccagttggacatgaattgtgaaaaagaaggagcttcaggaatgagtccagcattgtctagatgggtaggtggctagaggtgctattaataaaaacagaggagagcagggctgggttgatgggagaagggatgcagagctgttttgaatatgttgaggttgacttgagaaggctgccgagcttccaaaaggagcagtccaattgtcagttggaatgttcaatacacatgggtgtattgcctggacacaagggtgacctcatttataaaatgacaccacaaataacgtgagctagcccagaaggagtgtggagagagaagagagaacaagatgaagcagaatcctgggcaagatcaagatttaagtgttagccaggcaagaggaactagggaaagatattgagagagaatcttcaaagagggaaaatatcaagaaactgccacgttataagagccataagtcacatttcagttcagagcggcgatgatcacctctgaagttccagagagataagccagaccatagcttctcagtgctgttggtttgattgattttattagcttattggtttgacaattaaaataacaagagggatctgagggcaggggttgtgaatttgggtgcatggcaataagtgagattaacgggacaccagtaagaagtagtggggactgtggcaaactaaaaagcatatgtttacctaagaaggcaccatcatcaactctcatggattgttgccaagcaggaacgtgggcacagtgatcagaacatctgacttttcaagaaaagtcagagatctggatttctatatgaaatcttacaattctttatcttagcaatactttcaaaaaatttcatactctgcgaggcctgaattaaacacacctttgaactgtcagtttgaaacctctgcctttgtcaatgtccttagcgtggtgggggctgagccagtggcagcaggccgggaactgattgggcaaggaggagatggagaccatgagcacagaccactactttaggaagtatgggtaaaagaaagaagaaggcaagcaggagagctaaggagacaggcagggtcagggaacctgtcttgggtaggaagagctgtttctaggctgagagaaagagggtggagagagggaagttgaagatccaggtgaagaaagactagctgatgaaataaggatctgaaagagttgaggggatggaagaaaggatgttgatggatttcatgcctggaggcctttattctcttggtgaagtggggtaggagttgaatcaagaagcttgaagagaggagcaaaggttagggacagccttgagggacacagtgagggcgctgacaaggatgcatggaaggatgccgcacttgagacttgctgaggggaaacccttacagtggggctcatgggcctggatgtgggtgttggtggtgaggggctaagcagctgttaccttccaagccctgtgtcaggcatttcattctcttacctgttgtattcctcccagcagtcctgctcactcaactgagttcgcttgtgaataagtggcagccccgagactcacacccttgtctagctggattgggattctatttgattccaccacactaccactccgtgctgccatccccaccccagccatcccccagcccaagccctcagacacacctgcagaggagactgggccagtgaattcttgtttgggcattgcctggctggtttgattgggaagtcaaggggaaagaatggaggatgtgatgaagaaaagagtagaggtccatgaagaaataagtgaggacagaagggaatgatgaactgaggaaacaggctggaggaagggaagacctgatgaggcccaggagacagtgaacgagagattgcgtcggggcagggcagtggggttcctgaaaatttcaatatgagtgtgaagatgaggggaagggaggtgaggtaatgatgactccagggtgtctagcctgtgcagtggggtgggcagggatgcctttagtcatggcattggtcaccactttgacatcatgccatctctctgtcccttgctcacgtgctgaaccacactcaccagcacgtttccaccacagggtgtctggaacatgcagagcactcttcctccagatctgcagagtggctcgttctcatttttcaagtcacagctccagtgtcccctcctcagagagtccttttgtgaccatgctatctactgtagctcccctggtcattttgtttattttagacaacttatgattgaaatggtcatttatggatttgttgacttgtttattctctgtctctatcactagaggacatgctcaagagagcaaggacacataggtcttcttcatagctttatttggcacatagtaggtattcactggagagagagagagatgaagaaaagtaaggaaggaaggaaaagaaagaaaaagagagaaagaacacaggtgaagtgtgtttgggagaggaatgtcgagttttgaggtgcctgggagacacccaggaagtgacttccaatgggcagctggaaagcaggctggggcctcaggaaatggactgccatcttgcccaggaagaaagtgggcccacatggtacaagggtgtgcaagctgtccttttgcatggctgactgccttttcaagaccagtgttggaggatggcttgcttggggcccggtgggaagaagaaccccctcgggtggtaagctgaagttgggtcagagtgcttctcacttctctcttcagttctggttcttgctactgccctggcttcgaccatttcccatcattcttcactgccagctgcaagaccctggatctgaatgcagactaaatcttttcatctcttttatcttaaagagtatctcgcccacctctgattcatggttacaggaggccagcatcacccaggagctggacttagttttacagaattagaaaatacttttcccttgtgcttgcctcctactccatttctgttggccttgtggtcctcctgccttccatgggacactcagcagacctgctgcccctcttttgcagggtccccagctgctgagcagctccaggacatcctgggggaggaagatgaggctcccaaccccaccctctttacagagatggatactctgcagcatgacggagaccagatggagtggaaggagtcagccaggtgaggcggggccccacgagggaggtgggcacttcagtctcacacagcctgggcttgcctgaccctcctggtgggaagtggcaccttgtaccttgagagcttcctggtccacaaagaccctcccagctgccttccttggtgtccagaactaaggagcaaacagaaccttatgaattcctcttcatcctcaaataaattaaagttcaagtgggaagatagaacagtcatccatgaaactctgagagtaatacaagggcatataccattgtccctccatatccatagggcactggttccaggaccgcctgctgatggcaaaatccgcatatattcaagtctcccagttggccctgtggaactacctatatgaaacaatggcccatatatgcaggttttgcatcccatgaatactgtatttttgaccccatttggttgaagaaaacctgtgtaagtgggcccatgcagttcaaaatccatgttgttcaggggtcaactgcattcttctcgttgttgttgtttttccagagacagggtctcattatgtcgcccaggcttcagtgcagtagggtaatcatagcttactgcacgcaggctcaaactcctgggctcaagtgatcctcccgcttcagcctcccaagtagctggtacttcagtcacatgccactgcatccagctaattatttttattttttgtagtgataaggtctcacttttttacccaggatgttctttaatataaaatggttcaaggtaaatgctgtaaaagggaaagtaacaagcaggctggggtagacagcgagggcttcttggaggaaggagaaggtgtgccaggcacatcaagtctgaatggtgggaaaaatccagatggagagggctatctggcagagtttggggctgcagagttggagccatggagaaaagcgtgtggagcagagagcactccatatatacggagagcagaaactggaggggagccgcacggagaagtcgcaggagccaagggaggggcagggtaagaatggttggcactgctcatatccccagtgcctgtgacaaaggggccttgggacttaactggactgttcagcagtgcccaatgctcccaagagcccaaggggaaggaaggctatggtaagaggcagcgggagggaccttcggacaggaagacagactgccgatatttctccaccttctttacatgatgccactctgcccccaggagaagaatttaatttgatttaaatcaactttattaaattaatatttaatttctttcattagaaataaggaataggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaagaaataaggaataagggctaggcacagtggctcatgcctgtaatgccaacattttgagaggccaagacaggcagattgcttgagcccaggagttcaagaccagcctggacaacataggaagacctcgtctctacaaaaataaaaataaaaatagaaaattagctaggcgtggtggcacacacctgtagtctcagctacttgaaaagatgaggtgggagatcacctgagccaggggaagttgaggctgcagtgagccatgattgtgccattacactccaacctggacaacagagtgagactctgtctcaaaaaaaaaaaaaaaaaggaataagatttgtcaggtcgagtgtagctctagagtaccacaaaccattgtaatatctaaaatattttcactcctcgaagaaacagtttttgcccccttgggggcaattatgcccaagttgagagtgcatagactcaaccgtgcccaggtctgtctctgcatgggggccactgtgacacccagagcctgacagctgcccccaaccatggcctgggctcttccctcgctcatctccctcactagcctgggtagttgctgtgcagagccagaaggcacaggtttggacacccccaggttttccccactccacgtaccatgtatctggaagaaaagccactgggtgtactagtaaataagtccctgcgggcctcagagaggaacaaatccccagctccacatctgggcccggtccctgtgtggaagccattgaatctcttcctatgatgccgttctttgaacacttacggtgctgatcgattcacggcttgtctcctgcaagttgcacagtgaccctgagtgggtggaattttcattatccctattttatagataggaaactgaggtgaaggggagcaagtagctcaccaggggtcagagcatgtaggtggctgaatatggattccagtccaggcctgtctgacttcccacttgagggataatggactttgtcttcctttcctcattttctcagccctttctctttctgtctctaacttccagtgactgttttgacttccagggaagaacataggtctggaagcaattctgttggggtcagagatacatggggagagctgcagagcccaggatgcctatccaagattgacagggaagggggacatttcaaatgaccaggacccaccctgggttattatgtcttaacacctctgaggggccagggcctgaagccactgcccgccctgaacgagggcctctcctgcccagagtgagcaaatagagaggaggaaatctgggcagggccttctcagaggcccaggaaggggaaggtgccttctccacaccctggacagggtctgcatccagaagccctagccatggttgccaggaccagaccctccacgagggcctatcacacacacccgtggagcccttgccaagaaggccttatggcccccagagacctgactatcaccaaaggcaaaccacactgtctctattctctcagagtgtggattcacaaagccctctgcactccagacccagtgaaggaaccaagaaactgtagatgaggatgtttctagaagggggcttctcctaaaacataaaggggtctggcagttaccatctgcaaagtggtaggtttccctgcaaagcaggctttctgaagatggcatctgaggaggtcctggaagaaaggccatcaggacctcaggataacctggctccaaccagcagtgagaagaaagcaatgactagaagttaaagtggtcgaacccaattctaggcagatcccaaagaggagtagcttgaaggccagcttgcggacaggaaaatgtgggaagagagtagctttctcgacttctgctccacccttttctactctctacagctaaccccatctggtttccagataactctccaaggtatgaccagcaagcccctagtgaagtcagaagaagggtttgaccatcagccaagaagcccaccatgggcctgaacagttttgctgggccctcctccaggcaaactacaaggttagaggtgcttgggtcagagctgtttgaggcttgtcacccccacaaaaaaatagcagtttcttcagttgacaggccagtggagccactcagggaagctagagatctcagatgttttgagaatctaagaatcagtaaatcataatgggttctgggccttcttagagtaacaggagaaaatgatagggagtaggggacagcccctcacacagacactcaggctccaagacggttatggtccacaatgcccatgtcaaagagaatcggggaggggacgctttaataaaagtatttaatttgctgcagggagtgtttgctttattgagttaggagattaacagagtgaaaatctcaaatccgcaaggaattttccctggcagtgctttgtcgggagttattagtttgggggatgtttcaggcccttggaggagtcactcctggagggatttaaatggctttttgagctctgctgagcctagcaccatgcacataatggggactgtgtgtgcagcgtcatttctaatgtgatcaatgctggtaggtcaggctgttaataagatagatttttattaactctgtctctagcattcccatgagggaaatgcagctggctgtttgctgataatgaccttgcctgaagggagggctggatcagattgggtgggggcgaccacctgactgtgagcaaactatttacccagaattctatcctctctcatgcccacctctgcctgactgcaagtggaggggctgggaaggagaatgacctgggttggaacccacccaagtgtggagggccctttggggttactcagaaataaccagagcttagcgcctcccaagagctgtgaaagcaaattccaaatccaagctgcttctggtctcaactcagagcagaccataaacacgaacctgccagaagattcttatgagacacatgctctgagaatgttcctgcagtgaccgggaagggcaggagaagtgggtcagttgttgggtcaaaccagatcagtatgttttcaaaagccctgaatggttctatgcacataggcagggatgctctcactccatacaggatggagaaagctgaactatctgtttcaaccctgaaatcaccctcattaagatcctgtatagtccaggcacagtggctcatgcctgtaatcccagcactttgggaggctgaagcaggtggatcacctgaggtcaggagttcaagaccagcctggccaatatagtgaaaccccatctctactaaaaatacaaaaaaattaaccaggcatggtggtgggtgcctgtaataccagctactcaggaggctgaggcaggagaattgcttgaacctgggaggcggaggttgcagggagccgagatcgtgccattgcactccagcctgggcaacaagagtgaaactctgtctcaaaaaaaaaaaaaaaatcctgtataatgccctcttaacatcatttcccatcttagtatggggcagtaggcatccccagccctctggtctcaccacccatctggaatcaaccttccagtggagccagagctgcccactcagtttgaaggagagtaggatgctgagctcccagtgcagaaatcaacaaacttggttcattcatcaactaatatttattatctgcaagccctgagcctgctagagatataaaaatggaacatggcagatgctgcccctgctctcttgggctctcagtctaattggacactgaggcaaataagggggcatttggtaatgggggcactgtgaaagcagagcataggggcatctaatccaggcaggaggggtcaaggaaggcttctaggaggaagagatgttcacattgagacctgaaggatgggtcagagttagccaggagagggtagggaagggggaagaggcctctggaatagggcaaacagacacatagaggaaaaggcacaggtttcctgtggctggactgtagaataggaggcagggaatggcagggctgatgatgcagattctatgccagccatgttgcagtgttggaacttggtgctgagagcttcagaggaccacagaagggttctaggtgggaaaaggacagaatcgtgcatatccttaagagagttcatctcactttagtgtggagaatggataaaagggggcaagacttggctagttaagaggctggtccaagggagagatgctggcagtagggatagagagaaggggtagattgagacaaaatttaaaaggtacaattgacaagacttgataacagatggcacgtggggacagatagtcagggagacacccagaattccaacctgagctagtgagtacctcatggtagcagcttagaaaacacaaatgtagtagtaaagttttattacattggatatttttaaattttgttttgggggcagttgataatgagttccattttggacaggttctatttgaggaaactccaagtggagatgtccaggggtcatcatgtggccaccgtgtctggagttcagtagagaagcataaatttgtgaggcatcagcatctaggtggaaatcaagcccacagaaaaggataaggttgcccctgaggtctgtgaagtgagaagagagcccagaacagagcccctaggaacttcagtatttgcaggatgggcagaggaagaggaacccacgaaagagactgagaaggggcaaccaggaggttaggaggggaatggaaggagggctttgtcctggaaatcaagggctgagagacattcaagatgaagggaggggataagaagtaccgcaagaactgaagcgcatccgcaggatggacctactcccgcagtctgaggaggggtagggcagaagccagagggcagtaagttgagaagagttaaaagtaaaaagctgggttcacctgacagttcttccaagatgcttgtccatgaagggcaggagtgaaggaagcctcttaaggagaacatgggccaagggagatccttttgtttttgagggtcagcgaagtctgagcacatcgtaggcttacaagaagtgtccagggaaaagagagtcatttaaagggaaaagaagctgagggaggctgctggatggagcaaggcggccctgggcacaggtggaggggctcctagcagggagttgagggaattccaggccggtctgtggtttgaggagacaggtggggtggaaaagcgactgtaggagctgcagatggctggtatacatgagccaggtaagcagctgcaggctagcagccatcgctctcttgttttattgcagtggagtcacacatggagatttatggtcagatgaagatttttaaggttgtttgacttccaccttctgctgatctagtgttctgaataattatactctttgtcattatccagctgcttttatgtccagtatctaacttggtccttccctctctctatgctagtccaacactgacacttgaggcttatgttggtgaagtaggaaaaagggatttttatatgaatcagaacctggatcaagccccaggtaaaaggttccctgaagtctcagaggccctgggttccatccagtgctctcacagctggcagtgtaacacagaatgagggctatgctaggggctttcatccctcagggacttaggataacttacagttattccagggtggagctgcaaaagagaccttcaaagtcctgcaatcagacaggggaagcacaagtccacacccatggggacagccaggcagtgacacaaggccatcacgcggttgacccaggatagtacaatcagattagttggccagtgagtgagattggaaggctaattaagtgaggagagatgggagggactggagcactcaggaagctcttcccagatagggcacaactggctggcagctcctcagaacccttggagctggtctgcaggagcaaacacctcccccaaccaaagtcatccctggatagctcactcagttgcagctgtcagaaggggaataaccccaccatcagaccaccttcatgtcaaaacccctacttgatttacctattcatgtatatttttatatatccaaatatatatttaaactttttattatgaaaaatttcaaacacaaaaagtagagagaatggtccccatcacccagcttcatcaaagtttcatatttatctatctccaccactttttttgtttgcttttggggattttttttttgttgtttgcttttgctggggtattttaaaggcaatcctgaatgttgtaaacatttcagtacacatctttgtgaattagacttcattgtaaacacaatgccgttatatttcctaataaaattgagaaaaattccttactataattggttatctagtctagattcagtttctcttactgtctcaaaaatatcatatttctgttggtttatacaacttagaatcaaaacaagatctacacattgattttggtggttatatctcctgtcttgttaggatcacagccatcagactccagagatgccaaaggaagagtcctgcctaaaagccctttggcaacagtactttatttttttttttatttttcagtctctgagacggagtctcgccctgtcacccatgctggagtgcagtggcacaatatcagctcactgcaacctacgcctcctgggttcaagcgattctcctgcctcagcctcccgagtagctgggattacaggcgcccaccaccatgcctgactagtttttgcgtttttagtagagatagagtctcaccatgttgccaggctgttctcaaactcctggcctcaggtgatccacccgcctcagcctcccaaagtgctgggattacaggcgtgagccactgctcctggccggcagcagtactttacacgagagtcaagagccccccacccagcatctccatctctggctcccacagcctaatcttgagtgagctgttggggactgtttgcgatgcccaaggggagagaaatgccactgtcatcgtcaggaggtttggggctacaagtaacagaagcccactcaggctaactcatacaaatggagggagcatcactgggacactgggatgacttcatagtccccaggggcatgatctctcaagggctgggtctgggaagctggcctgtcctctttctctctgcttctggtctctgcttctctcagggcatcttctttactcttctgcaaccagcttcttctgcttgtccctgcctttggccaatcctcagcttccatgttcacatccaccctactcaagggaccatcccacagcgattccaaattcttcatggagaatctgatctgtccaactttgattgccctatcactgggacccagatcagaggtaggaggtatggggaggactcgctatatcctagagagcacatccccatggaagacagggagagcagacaccccaaatatgtctttcatacctgtagtaatgaagatatacacttaacgtaagcaatcctttggccacagttctgcctctaataccaaccagaactttcagaattcttcaagttgcctatgagagtataggtggtgcaattttacaaactcaaactcatcttcctcttgaaggagagagagaccacaccccatctctgtccatggagatctgctgatgtaactgcagcactacatcaatccctagagcagcggaaaggtggaagctctaacttctgagtctaggagagctttggagaggttgttttatccacacctttcttctttcattccaaaaatagttgaggggatgttgtgttaggtcctgtgggagaattaaaatgagtaaaatatgaatctgttcttaaagagcttatgatctagtacaggtatcagcaaacatgttcagttaatggccagacagaaaatattttaggctttttgtgcacagatgatctcttcccctgtccttttatttcccctcctctccccgctcctcttctctttttctctccttctcctctcctttctctcttctgcctactctttctccttctttacaatgctttaaatatataaaaaccatgcttagctagctggccatacaaaaacaggctgtggggtgcttggagcccatgagacatgatatttcaaccccaatctggtataaagcaggcatgtgctcatacacacagctaactaaaacccagggtggtatgtgcaaagtggtgagaacaggctctagaatctaaagacatgccttcaaaccctgtctcttatgagctgcatgaccttgggcaggctcctcatcctctaagggtctcagtctcctcacctgtacaatgaaatagtcacagacctacctcatgagacagatttaaggattaaatgagataatacctgttaagtgcttagcatagtgcctggcacatagaaagccctcagtaagctttagctgttgtcgtgattaggaagtgttatgtgataaatgataaaaagtgtgatgcgagttagaggaaagagaggtctcctcaaccttggcccttgggaaggcattgtcttcccaactgggaaggagaggtgacttttgaacttggcccagaatagcagaggtggaagagagtgcctaggtgaggagagggcctctcctgagaggcagtgaagggaggtaccagcagactctgagggaggcagaccactgcgtagatgacagtcccatggggcaattacagggacttcctggatacacagacaagtggccctcagagaggttttggttccagaagcctctccttgaaggagcccattcagaatttttcagtaactttgtctgatgacattcacttagctgtgggctctccttcaaccctgaatgaggacatggtgtgcaggaggatggacccttcaccaaatgcatgagcttgggagcagaggccacccccattccattcaccacagctccctcgaatgccacacctctgccccatcaccaccagctgtgccactgcagttcatcactgtctgggaaggagtgtttctcctgtaatgcccaaactgtactgcatcaccaaaggccctcagcggaggttcctaggccaccaaaaggaaagactttcattcaaagggaatcagtcagccatgggaggaagtggggttcattgcagaacaatctaagacagaaggccctatcaatctgatcctagtcctagacatatctcatgagtagagatgaaagatcatcctaagtctattaaacactggaatcacttaactaatgattaactcattctgattctatattcagcaactttttggtgataatttggcttaccctgtatatctgcccatgaggagagaatgcaaaggctagaggatgaacataacaaacccctataacgattgtaaatctcactgtaaattaaataaattggccttcaggtttatgcatcagcctttgtgatcttggttagcattagacagtgtcactggacctaatcatctttgggacactaaaaagataaaatttctgagcctggaccggggtgggtgccccaagaggcctgtgaggcctttctggtgctcatcagccccttctggtagcttctgaacttctccatatgtgtgctgacccttgacccatgcctgccccctcagtcttttatactttataatctttcaaatttactgccaagtttggtttattaacatatacatggtatgcaaagtcataatccgttgtagaaacaacttgttgtactatctcacatacatattttcatgcatgtgattttatgtagcatgaattagccaaataaattgtaagaatgggccagaatttgcttaggtgtttctcccgtttttttgagacagagtcttgctctgttgcccaggctagagtgcagtggcaccatctcagctcactgtaacttccgcctgctgggctcaagtgattctcctgcctcagccaccttgggcaggctcctcatcctctaagggtctcagtctcctcacctgtacaatgagaatagtcacagacctacctcgtgagatagatttaaggattagatgagataatacatgttaagtgcttagcatagtgcttggctgggagtagctgggattacaggcatgcacaaccacgcctggctaatctttgtatttttagtacagacagggttttgccatgttggccaggctggtctcaaaactcctgacctcaagggatctgcctgccttggcctcccaaagtgctgggattataggcgtgagccaccaggcccggcctcaggtgttccccttttgaaaaatcttccttccacagatcattttttagtgcctctgtcaaagactgaaccaggggagtatctgatgattcctcagacatctctaggaaaattcttaacgggcttctaagtgaattaatactggtcttcagtatctgttgggaaattcagtatcctgatatgactcatatgaagttaaaaaactttgctggatattgaaggaaaacttacatttcttacttttaagaaatgaatttgttggagttacaaaatgtattacaggccttaggcagaaagcacaaacatgtcttgatgctttgtaactaatacacagaagtcaagcttttgggtaatggggcggggtgggagagttacagaataaagttggtgaggccacatagatagagtgaccacagggatatatactttacaaattttagctgagtaaacttcatgaaagaaacaaattcacacaaatgtaattcttaaaacaaatgtttggaggcaacatagccttagcattaaaggttacatacattgggagattacattttttaaattagaatgtcctaggggggattttgcaaacaaactaaccaagacactatttaattataatgatattcaaaatagtatagatagaagcttctcttcaatcacaatgtttatgtatattctccagattttactcttatctaactacacataatgggcagcctgttgttttatcatctcaaggatctgtgtcttccttttaaaaaatattgatgtctgattgtcagtcccctgagattctgatgtaattagtctgagattcagcctgggttttagaatttgtaaaaagctcccagatgatcctaatgcagccattgaaaactgctgatacttactctagcccagcaggatcagtgggagttacgaagtttccatctgaggagacaactagaatagaggtctcttggttttcagccctttccagatcctccttgaaggagaacctcctcttctcccatcctgtggtttgagcattggaagccttgactgtacctggtagctagcgccatgatgctttctcctgctcttgttattaattgaacagcaatgtcctctaattatatctctgaccgagttactaggcacagaaaaggcctcagttctggccctgctttgtgtgacagagagctgctttctgtgacaagtgacatttcaaggttccttttagctacattccagtcaggagcggggcacctggtgcccaccctggcatgcagagttgggggtctacacccaagcttgggcaaaatccctaaaagttaaagctttgctggataatgaaggagaacgtggagattttctttccacttgacctgcttccccaactctaataccccactttttgaagccaaccatggtacacagttcactttgcaatgagttgtttgggattacacatgaaccttattatcaggcttttgcaagtttttaaacttggctttgaccagaggctttttacagaggccattcctttattcattctggagaatgtttaaggattttattatggaaaattcaaatttatacaaaagtagtatatagcagaatgaacccccacctgcccatcacccagcttcaacagttaacagctaactcatagcaattcttgtttctctgtcccccacctactaccccagacacacagacacacatgctaggtcaggttgacacaaatcccagacaccacatcattccatctgtaaatatttcattatgtctctaaaagataaggcctctttctttctttttagagatagggtctttctctgtcacttcagcttcattgcagtggtgcgatcacagctcactgcagcctcaaactcctggacttaatcctcctacctcagcctcctgagtagctgggactacaggcatatgccaccacacctggctaattattttattttttgtatagtggagtcttgctttgtttctcaggcaggtctcaagcaatcctcccacctcagcctcccagagcgctgggattacaagtgtgagccaccatgcccggcttctgagtatttttaaatatacttaaacaaaatgagttttaagctttttttccccagtcatttcctcatagcgagatctcacccaaagtgatcagtgaggtcttgctaccctcaagcagaagggagcaagcatttaatgcaattgatctgggcaggagaccataaggggacaccagagaggaagaaatggcacctgtcttcaaaaagcttaatgtatatttggcatttgttatataccaaaacaatcataaaacatgattggctacaattaattattaatttaggcactgagcctgaattaattaattattttaggctctgagcctaagaagttagaaactttacctaggatagtctggagcacagagttgcctggatcccacccgtttttattctgatgtcaactggtctaggatatgactgagacatgaagattttaaaggcatctagggtattcttatatgcaagcaagcttaagaatcactgtcctagaacagtggtttctaaagtgcttcaggttgagaaccatcctagggtgttataggagaaataagcagaataactggcagaggctttgtggaggaaggggcattctcgctgggcagtggaaaacagagaggaaagaggacattctacatgatctcagaggtgatctgcagaccagcagcatgagcacacctaggagcttattagaaatgtagaatctttgacctcattccagacctgctcaatgaggatctgcattttgacaagatccccatgcacattagagtttgaggcacactggtgtagtagaatatgtactgtaaatggacttcagttataaaatcagagaaactaaagcatagcatgactgtgctagaaaggagaccctttcagctagtgttcttggagccattctaagggaaagaggccatgtcctgctgtataatgagaatcagatccatgtgagctacgtttgcctgcgttgggaccccatataagttgaactatccctaagtcacaccattctatgtacctacagagcaggggctcctgaacccacagggtgcagtcagataacccgggagtttccatggcagggtcaccctcctggtggggtaaccatccaggcattggtttttgttttgttttgttttgttttgagacggagtctcgctctgtcatccaggttggagtgcagtggcatgatctctgctcactgcaagctccgcctcccgggttcacgccattctcctgcctcagcctcctgagtagctgggactacaagcgcctgccaccacgcctggctaattttttgtatttttagtagagacagggtttcaccatgttagccaggatggtctcgatctcctgacctcgtgatccgcctgcctctgcctcccaaagtgctgggattacaggcatgagccaccgcgcccagccccaggcattggtatttttataaatctctccaagttattctaatggacagccaaggttgaaaaccattgctatggatctttggtcctccatgtttccttttccattcaaggtgaaagtgagctaaatttctagctgtagccattgaaaacacaaaattaagttccaggtagcaagcttaatggttcaacatctggattcccaaaatagttatagaggggactagagcggtgtccctagttaaatggtctcatattccggaatttcttaaatcaaattttctggattctggtagcagagtctagttctggcattggcttaaaattggagacaagtaatttagtgtttatgcaggctattctcatgtgggttatcgcccttgtctgtgtgtctatggggttaatgtttggtgtatgcctaacacagtacaaatagttgaagtcctgagaggtggagaggactgcatgtctttgctatctgctatctggagttagtagaggatgtttcaaagaggaagcattgctcttatcactccttcaggtggagttgcatttgtatgggcagaagactgaagaatgggatgtcaggggagagagctgcctgagactgtctggcctaggatgtttgtgagacagtgaagacagcaacccactcaactggccccatgcactgggccacatcacacctttaggtgggtgggtaagaccatggagtagcaaaagagtctttgggagcagggtgacagttcagtttatcttttgtattatttttgagaaaaaaaaaacaataaaaggcaagctgaataggaggtcgatcctcaggaagaaaagttgagcatcctctcaactaaaacatttggactggccgggcgcggtggctcacgcctgtaatcccagcacttttagaggcggaggtgggtggaccacctgaggtcaggaatttgagaccagcctgaccaacataatgaaaccctgtctctactaaaaaacaaacaaacaaacaaacaaacaaacaaaaaacaaacagccgggcctggtggcaggcacctgtaatcccagctactcaggaggctgaaacaggagatcacttgaaccacggaggcagaggttgcagtgagccaagcttgcaccattgcactccagcctgggcgatgagagtgaaactccgtctcaaaaaaaaaaaaattttgaacttatcctttggtctattccttgtaaactcttatgttaatataccttttagaaacatcttactttcgatatcacatagtcttggatctgccataatttaaatgatatttcccaaacagatttctccacaaaaaggtcagctacaacttgtctgcctggtctctggctccagcccccatgtttcaggtcttcacctcccagtccttctctaattagatctccccattctgtgtccatctgattccccaggatcccaccaggtgcctggttaacttgtctcaaataaatgtatggaatgaaggtgttaaacatagataatgcaaaatatacagttacgtgaagaggaaatctgatgaaggaaaagatgttcaatctcactagtaatcagaagagtgcaaatgtgagataatttttcaactaccaaatgaacaaaggtgaaaaagaatgaaaataccaaagtctgggagactttagggaaatgtaagatctcattggtggcagtgggcactgacataagctttctggaaaacagtttggtaatgcttgttataaatgtaaaaatgtgcagacacagtaattccacttctgagagtttatcctaaagaaattgtggagcaggaaccaaggatgttccaaccagccttaattaataataaagaataattagaaataatctgaatgtctaccagttgagaactgttcctatcaattatggtacattcagacagtggaatactagaaggacttcagaatgatgttaatactaatagagatgaaaggatgtccattagatactatacccttaaggtccttgtggtgccattaatgtacagttaatgcaaacacaggcatatgtgcatgcatgcacgaggagatctagaatggcagttaccaaaatatcaaccatcaagacatcagcatgatgcctcctggttggaggagctttgaatgactttgctttcttctttttttattgttcctaaaattacaaaagtaatattctttatttttaacttaatagctaacattaacagagtgtatcttgtgtgctaggcactgctctaattgctgtacattattattattactgaagaaatcaaaggtgatgagagattaagtaacttactcgagattttcagctagtaaatgatggagctgttattcaaaacctaatagtgttgcttcatagactgtgctcttttttaaaaaaaaaaaaaatgtagacggactctcactctgttacccaggctggagtgcagtggtgccatctcggctcactgcaacctctgccttccaggctcaagtgatcctcccaagaagctgggaccacagctgtgtgccaccatgcccagctaattttttgggttttttggtagagtcagggtttcaccatgttgcccaggctggtctcaaactcctgagcacaggcgatccacccacctgggcctcccaaagtgctggaatcacaggcgtgagccacctcacccagcctaaccagactgcactcttgctacactaattcgccccaataaagtgaaagtcttaaatcccgccccaacaacaatcctactcctctgctcaaagtaatcattgttaaccatttgacatggatccctccaaaacttttgctttctccagacacatgtgtgcacacacacaagtgtgtttttcttttttataaaatgggatggtagtgtccgtcctgtcagtatgtgagttcacccacatattttttatttatttctgggggatattccacaacatggacatacagaattgatgtaatcatgcttctactgaaaacctggtggtttccagttctttggcctaacagacaaagcttcatcgagcgtccttgtatacatattacagggtgtggcagtgtaattatattcctgtgatcgtttcctagaaatcgaaccactgggtcaaaaggcatgcacactgaatgttgaaacaggctgcccacaccaggaaggctgtgtcattacacctgcagcagatgagaggccacctccccatgttttcactgacacaggaagttgtcaatctttttaacttttgccagtattaaaaaatgaagaatgttatttcatttgtagtaatttaaaagtccatgattactggtaaggttgagcatcttttcatatgtttattggccatcttcatttcttctcaggattgtttactttctattggataatttgagttaattggttaatttcttattaattcaaaggagcattgttataaatattagtattttgatgctttctttgttgcagatatttttctcagtacattacttttctttgaacttgatttatatgttattttactatatagaagttttcatttattttagttttgtgcaatcaaatctgtccatttttttcctttatggttttataccttgtttaggaagtctttctccacaatattctccaagaatataagaatactctcctatattctcttctagtatatttgcatttttgcttatagatttatttttatctttagactttaatctatgaagaatttagtattgtgtttggtgaaaagtagggatttaactttctatttttaggttggttgtcttttaaacaactccttcatcaaaatcctaattccgtgactgggcgtggtggctcacgactgtgattctagaactttgggaggccaaggtgggctgatcacttaagcccaggagttcgagaccagcctgggcaacatgatgaaaccccatctctacaaaaaatacaaaaattagccaagcgtgatggtgcatgcatgtagtcccagctacttgggaggctgagttgggaagatcacctgagcacaggtggtcgaggctgcagtgagccaaaatcatgccactgcactccagcctgggggagactctgtctcaaaaaaaccaacaaaaaacctgaattcccatggatatacaggtctgtttctggactcttgtgccactgatcccttgtctatatctggcctggaatcacaccgctttaattactgaagcttctccgcaagtttctatatgtgctaaggcatgccccatccccatttctcttcatttttgaactttcctcaccattctcctacatttaccttttttagaggaactttagaattagatagtcatggtccaaaagtcctcccttgggatttcagttgcaatagattggagctacccatgcatttgtggttgacatcttacaaaggggagctaggtgtctccggccaggactccttgctcccctggcactatctgaggcctttctacttgaacacccagcccatgattccaagtcttctagaaaggacagatccctacacatccttggtttaatttctttccttccctggatggcatgtgaatttttacctgaactttcagaggcaaaaagagtgaaaagcatggaaacctcagaccttgcaggggaactcagggagaaatacttttcgtcagggaacatttttcctgctcccagcaaaccacactgaacactcatgtgtgaacagcctgagataatcaggttccagttgaggctttttaaaaaaacagctttattgttctagaataacttaaaattctctaattgtaagtgtactggtaaatgatttttagaaaatgtatggaattgtgcaactgtcaccataatccaattttagaacatttccatcactcccagaagatccctcatgcccctgtatacttctctggatgccactttccttcacatgacagtatcaggaggagtgggggacaaatgaggggatccccaagagatcctctgcctgtgagtctgggaccaacaccacaaccacatacatagcatgaacccacatgacacccctcttttggggagacccaggtgaggcctcctcctgagggccctggccacactgagccccatccttacccttccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcataggtgaggcaggggccactgtgtgcatctctcctgtggtccctgcaaaccagggcagctcccctgacctcatgcctgccctcaagtctgtgtgacggcccgtctctgacacctgattctgcagagaccagctttgactctgttgctcccagggcaggatcatagtcactccaagtttcagtaccatgtagacctccagtagagaggaaaagaccatcctccaaaatgccatccagaaatgtggtaaaaggggagagggcctcttgcatagtcagagatacctcttgccatgacaacctgtttcttttcagggtaaaatgggtcatcattcatctttaggaaattagctgtcatttagtggtgtgtcgaagggaggagttggcttgccttaacacccctaaaaatttttgtgagttttgttctagcacattggattttgccagaagtattttgcccaaaatacttttctaaaaagagttcattttaggactaaaaccattgaacacagtacttttgtgcctcctggggcagtttcatatgtactgtttatttcacttttcataagaacattgacagaaagagcagacacacacacacacacacacacacacacacacgtgcccttgaacaggaggaggccaagagttggtgatgtgcccagttttccacagctagtggcaaagccaggagtacttccacaccccctctgccacatttaatcccactaataacaggtgaaactgaagacttccataccctggagctgttctgtcccacagggatgaggtgtgtatgttttccacacagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaagtgagtcaggccttacgctggtaggcatgggacatgcagggccagtatcaggccctggtacccgggtgagcccaccttaggggctgggagtttctggagaaattctgatgttctggggatccctcagcctccttctctggcaggcctgtggggaccccagccacactcccgtgttgttcccaccaccagagcagaacaatttctagggagagagttggttcccagccagggctgcatgtggcagatcactttggggcttgagatgtgtcctaatgcctgggccccaccttggagagttggagtcaattgttctggggtatggcctagaaaaagagaagttagaatgcaccccaagagattcttatgtcacacagcattgggaaatgctggtagagatggcttgctatggaaaggacccaaaagtttcacatcaaaccccctagagaggtcaagagcctcagcagaaaatggaacacatcagggtggtagaaggggctgggcttatctcaagagtgccagggcttgtagatctggtggctgatgtcactctgattagcaggacctggggccatttagagagagtggcttgttgcatgtacacatctcaaatctccaacattccactatcagtatcccagcctagatgcccagggacactagccctactgagcctgtcagacaaacacagtaaccagagcaaagttgctacattaaaaacattgaggaacctctttaaatgaattacttaaaaatgggaagtgggccggacatggtggcccacacctgtaatcccagcactttgagagtccaaggtgggtggattgcttgagctcaggagtttgcgaccagcctgggtgacatggcataaaccccatctctacaagaaatacataaacctcatggcttaaaccccatggcataaaccccgccttacaaaaaattagccaagtgtggtggcacacacctgtagtcccagctaatcaggaggctgagatgggaggatcgcttgaacccaggagacggaggttgcagtgagcagagatcgtgccattgcactccagcctgggcaacagagcaagtccttgtctcaaaaaatcgctcccaaaacaacgggaagtgtttaacataccataatagcaacagatacatactcagcacttaactacattctgggcactattctgagtgctcttcctgttttaactcacttcatcctcacaaaaatgctgtggcgtgtaggtacggttcttgtctccattttacagatgagacgcctgaggcacagagagtttaagtaacttgcctaaggtcacaaagccattaagtggtggaatcagggatgaacccaagcagtctactacaccttgtgcccatttaatgcactgtgtatctctctcactttcaacagtacagatattctctctaatcttgttcttttttttttttttgagacggagtctcactctgtcacccaggctggagtgcaatggcgcgatctcagctcactgcaaactctgcctcctggattcaagtgattctcctgcctcagcctcccaagtagctgggattacaggtgcccaccaccatgcctggctattttttgtattttagtagatacagggtttcaccatgttggccaggctggtctcaaactcctgacctcaggtcatccacccacctcagcctcccaaagtgctgggattacaggcgtgagccatcgtgcccagcctgtaatcttgttcagactattgacttgcttaaattaaaaaaaaaaaaaaaaaaagaatttcttcccagaaggggaagagacatgtcttgccacccagttttatttagttaaagtgaactaacccaagaggcttcgctacaccagcaaggctgtcgaagccaagtcccttctgattctcctcccagatcgcagtcctgcccggagccctggtgctggcccgagtctacaccactccacggaagacctgcggatgcggcagagtgcaaattacggacgtctgtgtgagtgtgtgctctgccgctctgtggcagctttattcaggctgtggcagctgtgacatggccacattgccataggtgggggagacaaagcccaggatctgccaagaattctcagggcatgcatcaggaggagcctaactttcactctaaacccaggctgctctcagggcctcatttactaccataatattcaagtcattcctctgaaaaatgaggctgtcagtcacatcctggtgtaatcaatacccactcccatattctaggtgtttttatcttagtctgtaccttcatcttcatcaaactgacattaaccctgttttttggtgaaaagctttcctggaaatggaatcaaaaacaggcaaggtcctttccttcagttcagtcaggcagcattcccatcactgggtggcagtctcatgccaccatggagaagaaatgtgggcagagtcacggccccttttttctgggaatggctggtagggggcggggtgtgggtttgaggtgagaggtgacagacaggttttacatgcacctcgtcagggatacacagacaggcgagctggggaaaagaaaggagcgaacttagaaagtgaagtgaaaaagaaaaagcagtgaaggactattttccttcaggtacttttactaaaatgccaagatgttaacaagttcagcccagtgctgtacccctgtccaggcccaaggagtgacttgggggcaatgcagcccctgcctgtggccttgggcacagcaggcatttgctgcagtcttctctctctgtcctgatgacccaagtcctcttagtctccccagctttgttatgccacatagggatgcccagtggcagtgttcagtgggtacagagtggcttcgggaagaccttccactcagttatcattgtatatgaggtcacctccctactgacactgcttaggggtgggaaccactgggacaagaggcacgaatggatgattgcagctttgtgtgaaccaggtcatattcaaggtgggcacccgccatgaggtggcccagcatgcagaacacagcgcacaggggaaggatcagagaggaggagacactgactgagtcttggagcataaatagaagttttccaggagcaaggaggaggaagagggggttctaaacaaacaaaacaaataggaggttgggggatggaagagaaggagctggagctatgaaaataaaaacattagtccagttcacaggaagtgcaggagttaaagggaagagagagtcaaatcaaagagggccttgtgcacccagcaaaagaacccgggttttattctgaagataatgggaacccctgggaagcttgaagcaggagcatgctgtgatcggatttctgtctgagtaggaataatctagaaggggcaacattggaaggcagagactgagcctgcattccagaatggagaggaagggacagaggtggaattgaagtactggtgggaagtaggaggtgaggaagagggagggcccaaggctgctcctagatttctgtctaaagggctggtggatgggagggaggggcattgagtggaatgtgtccatgaggaaagtgatttgggggcaggtaaagagttgcatttgaggtgccagaggggactgctccaaggagtctgcagctcagaagaggagtcagactaaagatccatcctgggcatcctcagcccaaatgggtgttggaaacaacaggagtgggagcgattgaccagcggagaggctgaggcacctggaggggatgagagcaaagacaaggccctgggatgtccaagcaggagaggatcctgggacagaaatgagaggaggagagccaagaggagcagcattctggacaccaggagtggcacaggccaatagccgagacacgataggtctgagggtgtccaccagattgggctagtgggagaggagagctggctttctctctcttaacagaggaaggaactattgggcagttcaaataattggctatcactgttctcatgggaagcccaccttccttccctctgccagcctaaatccccagcccatgtttgaagactctcaccggtcatggaggacagaggtgaaactgctccccctccagcaaattccaagctaagtgacacatggaacctcacctaataatgcgtctgtgtccctcctcctatccgggcctggtgcagagccacacccagagtagacagcctggtgacatccaagacgttggggtggaggagtagagactagagtgtggtagattgaggagggagaaggaaacagtggaaactggagtctaacacctctttcaggaaagcagccattgaacagaaggaaagtgagaggatgctagtttaaggggactgcaggattaagggggagggagtttgctttggttatgaacatgggagaggtacatgagtagggcccataggaaagggacctgcaagagcctggcttcccctgatggatcttcttttccttttctcctaggtcatgcccagagcagaagcatgaatgacatttctctcaccccaaacacagaccaggtagtaaaacccctgcacttagctgcaatggagggccagggcaggaaaaagtctttggtttcaggagcagggatcccctatgggcagagttccactcctacaaaggagtgggagttccaggaagatccccagtggggactctgggctgcctgggggactttgccaaggccagtagtcggggaatgacggagtcccaggtgctggctctgtgtcaggccctgggggtgtgggacagagaacatgattaaatgaggcgccagctgtccttgagcttgggatttgttggagagagaagaccagcacacatggcttcatctatcctgtgatccacaagcacctttaaagatgggatagggactggggctggcagagagacagaaaagaatctccctgtggcgagaacagtggtagttaattagactgtccaatagtgcatcttcttcctgtggtctcccatgaactgggctgaaaccctcgtgatgagatcagaattctgcaaacaaattgggtccagttctaaggcccacagccccagaatcctgtgactgtgccccttggggaagcccagaggaggcccccttaattccaactcctgcatacctcaaggacaggaggccccatggtccccttgtctatctccccaggagtaggaagaaagatgacaaaggaaacctgagacttggcgaggagccttcaggagcttgggtgacctccaggccttccagccacccctaagtttggtggaaggcaaaaacaaagtcagcccctcatgtcagtgtcccgggcacaaataaattaataacaacagtaacaaaatcaatcaatatttaagctccacaccacatgcactacactgtgccaggcattttctgtgaatcacaaaggcactattttcattcccattttactcatgagagaacactgaggcttacagcagttaaataacacaccaaagtctatacagctgaaagacagaactttgatttgacctaggcagtctaactccagagcccttaacttggaagtaatttaggaactagtcagtattctggaacattatttggagaggaaaaccacttttactcatgcatacagacagtgcaactgtgataagaaagcattacctagtaaaagttttttataacctgttttaatgaatgtgtgagtggtaataataacactagctgtccctttcaccagacagtgctttcttgatttggggattggaacccatcacctagcgccagcatctggttctccttgctgatacttgatgctgcttctcggtatttgcagcatcagtggtctctgctattgggtgctcttcaggtgcaagcccagaggcatttgctctgcaggctctttcttcatcattgatttgtgcaaagctaaactccatgcctgccctcagctggcagattcccagtgaacagagagtagattcagacagcatcgttgtgctgcagtgactctgcagtgcagagccagattggagtccccaagggttcaggaagtggagtcagcagggccctggttatacaagcccacatccaggctttgggcaagccagggttggttggaacactagcatgctcccatttctgggatgccacaaccctggccttcttaccaaacatgtcacaacgtgtaaggaaggaccaactccctggttaaatttctcttatcttctgtattacaagtgggttggttggatggccaggtgtggtggcacacacctgtaattccagcagtttgggaggctgaggctgatggattgaggccaggagtttgagaccagcctggccaacatggagaaaccctatctcgatcaaaaatacaaaaattagccgggcgtggtggcacatgcctgtagtcccaggcatgtgccagacaggcacgagaactgcttgaacccaggaggaggaggttgcagtgagccaagatggtgccactgcactccagcctttacgacagagtgagactcttgtctcaaaacaaatcaaaacaacaacaaaaacaagtgggtttgttgggacaccctgaagcattgctgcttccgaagcctctttctccagggtgctcctgcccagcccgtatctcctccccttccctggaccccctccctgcctgatgctcggagacggtggctgccctgttacacccagccctccaccctgaagaacgctgcttagtaatcagctgaccatgcctgagacaaagggactttttgagtcttggggactccggtgttcctgtcaattcctgctttttctcactatgttaggatccttggggctgctgatggttgcccaggtggttgtggagggttattttttttttgtctgattggatttaaacgattataagggtagtgccattgctcacgagcccctcctcgtgctggtaggccacccagcccagtgtgtatgatgcccccacatgagtcgaattgggaaacagctgtggggacaaaatggcaggacctgttgaccatatccatgcccatagctgacccctccacagggacaggaagaggcacaaggaagctgtgtcttcactgaggctgtgagaaacaggcctgtgcccgcgggaaagactgcagtagaagggggattggtaggaaaattgtgatgttcacaggcgctctcttcagagctgtcctctacccccaggcgctttcccactgtgtcagcgactgtggactgcacccagtcctgccgctaccccaactgctcccctccatcttccgacaaaattatctctgtctcttgtctgtccatgcccttgctgcccagagggaaagcaatctgaaaaaggaattcattctaagacgttaaggactaagaagagcttgaaagtaaccatccctggggtatcttcagcataaaagaggactcaggaagttataaacgcagagagtgggaatacatttgggtggagggcttgtctccagtacctctcacatcagaccccactggctctgcctgtgtgaccttcctcccatgaagtgacactagccagagagactggagagaggccaccttgatagtctctgctggaaaattccagaagtgatgaatttccttgggaggtcccctgggggtaatgtgggggcatggaagtctcccacagacttggagactggtccaggaattcctgtgagccaggaagctggtggcaaagggaaaataaggcctgtttactctgaccatcagaacaggcctcctcctccccacagctaccaaaagtgaaggtggagaggggaggtctgggtggctgaggtagaagcactgagactcccatctgctcagcctgaaggaggccatccaggcctgatgtccggcaaccccggggctcttctctgacccctcaacccacatctcagtggagccgttttcatccgtcaaggaatgtcttagtcaaggaaagtcgttgccagttccttcccatctacaaggcttaatggtgcctggggttaacctacattcagtctccccatctgcagaatcggaggagtacttatttattctttcagtctcttggcaacattgggagaatttttttcaagttaggcctcaaagcagtctgaaggggagtgagggagtgagagcaggtgggagtctccttggctatctcgtttcccctccctgtccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccaggtgagagccattgaaacctgtccccacgccactctcaggtagccagtcagcagtgcagtcagcaagcagtgctgttgactgttagtgttctcaaaggcacctctaaacgtggaggctgctgggaagggaaatcttctgactagggaagagttttagagtttattaaaaataataacaaaagaggccaggtgcggtggctcacgcctgtaatcccagcactttgggatgccaaggtgggcagatcatgaggtcaggagttcgagaccagcctggccaacaaggtgaaaccccgtctctactaaaaatacaaaaaaattagccaggtgtggtggtacgcgcctgtaatcccagctcctcgggaggctgaggcaggagaatcacttgaacccgggaggcagaggttgcagtgagccgagatcatgctattgcaccccagcctgggcaacagagcaagactgcgtctcagaaaaaaaataaaaataataaataataaaagagaaggaggcaacaactaggagagaagttgtcaggtaagcttgggcagcaagacaaaggtgaggatgctcaagggggagcctcatgggaggggaagaggaaatgttcctccaaagcaaacatagggttccatggagggaagtaaaaaagttaagaatgggcccagcgcagtggctcattcctctaatcccagcactctgggaggccaaggcgggtgaattgctcgagcccaggagttggagaccagcctgggcagcatggtgaaaccctgtatctactgaaaatacaaaaaattagccgggcttggtggtacacgcctgtagtcccagctactcaggaggctgaggtgggaggatcacttgagcctaggaggtggaggttgcagtgagccaagattgcgccactgcactccatgcagcctgggtgatggagcaagaccctgtctcaaaaaaaaaaaaaaaatgcatactgttcagggccagagaattctcttcacttgcttctgtttttccttctcactttcatgctcctcttccttaatcttctctgtctcctcctccatcttctttgcagatttctgtttatactactgggaccttctgggagagcaaaatcctacaatgaaattggccgtgccattgcaaccctcatggtagatgatgtaagtggtaaccagaagcttgtactcctgaattttacagctcctgcaccaagcactgcaccttcattcattaacttatccagccagcacatttgagcacctactgtgtaccaggcactacataggatgctaaagattatgagaatcagggaatagtcattgtcctttaggagaaccaatcaagtgtgagggacagattgataattgtaaaactaaccatgtgctagctgcccagggggtcaaggagggcttcacagatgagggggctttaaagctaaggaggagcaggaggaaggtagacccagcaccaggctgtgaggcaagcattccaaacaaaggaaatggatcaggctcagagaagctggatggaggtggtttgatataggctcagtgtaagagcttcaagggcaggaggtaatactggagaggtgagccagagactacacagagcctgtaagcagagctgagtcacactctgtccccagagtgatggggagcctagaggactttaactctttttccgtttgtgccaagaatactcactggcggtgcttgcggctgcaggctttaccctgagataacttttccccacgaaatgtctcacttttattattatttttgcattgctcttatatgttgactttggaaacaaaagacatcattctacttaaagcattctgtttttagttgtggcatttccatttacaaaatacactaactctcaatcattgaaaatatcaaatcctagaaaactagcattcctacgagtgatgctaacatcattctcgaacagtttttggcctaagattcatttgatgaatccagtgtttccaaaatagatgattctgatcattccaatgattccaatgttagttctttttagaaataattctaagaataatttttatattgcattttcacattgaaaatcagtcagatttgcttcggcctcaaagagtgtgtttatgtaaaattaaatgagtgctggcagtgagctgcactttttttttttgcctaaatgggaaagggttaaatgtgagcatagtcccatcgaatctgtaagtcagaaagcacactctggagacagtgtgaagaacacggcctgagcctccaagggcgaagggctggaagtaaaaaatggttatgaaatatctgagctccttggactgggctctacaaaggttttctaatatgtatgatgtgtggaaaactgaaaacagaaaggttaagtaacttaaccgaagtcctacaagcaagaatatggagacctggccttcagatccaagagaggctgtcttcccccagtgcctgctgtgtcccattgtgccatattttaccaatgtactatagtctcattccaaaaactgagagtgagttggcagtgggagatgtggttcaaagggattcctttaaaaactagatgtgatatgctcccaggcatttcagaaacagacccgatctttcttttctccctcctctctcctcgccagctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggtgtgtatgagaatgggcagtagggagagaaaaaggaggcttcaactctgtcggtatcattttatttctctttaaaatacatctgaggctcagcatagtggctcatgcctgtaatctcaacactttgggatgctgaggcaggtggatcacttgagcccaggagtttgaaaccagcctgggcaacatagtgagatcttgtctctacaaaacaaaaatcaaattaactgggcatggtggcatgcacctatagtccctgctactctggaggctgaggcaggaggattgattgagcccaggaggtcaaggctgcagtgagctgtgatcatgccactgtactccagcctgggcaacagagtttgaccctgtctcaaaataatgtttaaaataagtttaaaaataataagatatatcagaaacaaatatggctaaatgtgaacatttgtaaaatctaggtgacctgcgtgtggatattgttagacaattttctgcatttttgtctgtcttttaagatatttcataattttggttggagaggtgaggggtgctctgggggacccactctccttcatcccccttctcttccaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggtgcccaccccaggcctcccagtgaccctgctgtcctttagacttctcccttctcagctgccctctagggacttttcccaaccatggtctgtagtgcccactcgaggtcacccctgccttctttccctcccagagcccttgaaccccatcatggatccccaaaaggttgcctcaggagaggggaatttgagacccatacaagaggagaggaacccaaacttttctcttagatatcctttggtgcctgtttcctgggtctgctgtaacaaagtaccacaaactaggtggcttaaaaccacagaaggttactctcctgcagttctggaggccaggagttccacagcaggtgttggcaggaccaccgtgctccctgaggctccaggtggaatccttcctggcctcctcctggcttctggtggtggccagcagtccttggtgttcctggctggcagccgcatcacccccggctctgcctctccaccacatggcctcctgtgtgtctgtcttcacagagcactttcctctttgtgtatggaccccagtcatgttggaatagggcccaccataatgacttaatctaaactggattacatttgcataggtgttacatagatgttaggaccttaatatatcttttggggggacacaactcaataacagtaccttttttaaaacttaatttacctattcaaaaactttttttttttttaaagaaaataagagaaagttctcctggcctgggtttcttttccagctcttggagtcattcaggttgatctagatttaggaaaggatgtggccttgaaaatctacatataaatcatgactttgagaatgaagtcatgttttatatgcccttggctttataccagtggttctcactgtaagcagctttggccctccttagtccccctacccccgagcccagggaatttggcaatgtccagagacatttttgcttgtcacaaccggagaggggagatgctactcgcatctagtaggtagctgctaaacatcctgcagtgcatgggacagcccctgcagcaaaggagtatccagtccaaaatatcagcagaactgaggttgagaaactctgctccatgctaaggactgcattaggggctatgggaatagcaatcccagtaaacagtgtctccaaacctaaaatcttccactcagctgttccagatagcaaaatcaaaaaacaaacaaataccaaccagttataaggtttaggatctgttcttaatgaatctgttataatctgggatgcttctgtcaccgaaagttagacactcctgtgttcaccaagagcaggcaccctgcagatggtcagggatgtgaggaggaccaccatctgtggaccccaggacttccattctccatggaatgttaggtctaccccaggacatattcccatcagactttccctctccaaaaccctctatgtccacccttcccaatgtgggtggtgccaaccacaaactcagtcctacaggaattcatccctggccctaaatgttctggtggaaagatctttgccccatccaccctggtcaagttcctttcctcgccccagactctgcaagttcttgtaaatagccctgcccctgcactggtgttagtggtgagaaagcagcccctgggcctgtcttgagcaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcaggtgtgtgcgagccggtgccctgagtgtaaaagtaagatctgccgccacctggtggcagcaggaagcttcatcctgtaatcccaaaaccaaggtttcatctaccatccaggttgaggccatcactatttgtaatcctttacgcttcaagtaataataatataataagacaatattaaaagatctgaagctaaatctcattactaaagaccaaacttaatgattatttaaataggtcaaaccgttaaggggaatcatctgctgtgttatttggtacttttcccactgatgctggagtgaatttaatcagcacaattaatggagtgctaattgtggccttctccccacactttttaaaaactaaccttgaattcttagtttggagttaagacatttttagaaggatggtaagctgttgccatgacaacaactcaggcctccctggggaaaacagctcagcagacacctgccaatctcctaggcaagggtcttctccaatggaggccttcaaagtagagccattggaaagctcagtaccccaaggagaagacccatttgtcaagctgccttttgggcatgtccacatggctgcccctcaggattccccatggctgcccctcaggatcccccagttcacacagctgacattgcgtcccttatcttccctcctgacgtgctgctccctgcccttccccagcacagcaggtgataccgtggttcacccagctgtctacaccggaaactaagcattatccttgactcataagtcccagctgccccatgtggccctcaccacatggccctacctggctctcacgcctcatctcccagcattctctttctcagcattcctaccctccccaaccattctacattctgttttccatcaatcctgatcatcttttggttcttcaagtacatgctgtttttcagctccagaccttttagacactattccctcttcctgggacactgtttcttatcactccacttaaccctattcccctggccaattctctgctcattttttggatctcagcttccacttatctacttctagggaggccttcctgactacatctttacctctactgcgtgctcctgtggcaccctaaacctatcccagcacacctcttggcagtggctctcaaccagggacaattttcaccccaggagacatttaacaatatctagagacagttttcattgttataactgggaggagggttcctactggtatctaatgtgtagaggctgtggatgctactaaacacactacaatacacaggacagaccctccacagcaaagaatcatctagcccaaaatgtccattgtgccgaggttgagaaaccctgctatatgggaattgcctggttacttacctgtgtctcccactggaatgaagatatgttatcttgttcagtgatgggttctcaatacctttcacaatgcctggtacacagcagacactcagcggactttgaataaatgaatgatctgacctctaaaagcaccaaacagatgtttagatgaatgaataatcagatggataaatgggctgtcctctgggagtagaatggacacagagaaaagcacatccactgttttctaggccctgggtgccagaaggaagtcacatggtacctttatctagatggaattaaacagagtgacaatggccatggtggcaagttgtggagggtgtaggagatggagaacaggatttagggaggaaagggcccagaacgaaggataaacactgtggcctgggcccgtggagagatcgctggggctgcagcctgtgtggagagaccgcttctccttcctatgctgaaccacacattccttgtgcccccagggagtgatggagagcttcctgggcactgccatggctggctccttgttctgcctcttctcgggacagcctctcatcattctcagcagcacggggcccatcctcatctttgagaagctcctcttcgacttcagcaagtaggtgtcccttggtggcccccagtgcctgctctcgcatttggggcagtatgctggggctagggcaggggaataggtcccaagggtaggtggtggtgcggtggtgccaaagccatctttaactatgggaagggctaccaggtggcccctcctgactcctgccagctacctgcctttaagacatcttagtgcatattggcacagcccatagggaccagccacgacaagaggagaaaattcacaccactcagtttgtgagcaatggtgacttgataggcagtatagtgtatgaagtcttgggctgaaggtcagaaggttacacccagacccaggcagctcccatcactactccaggctcagttgcctcctctacaacatgagggtttggaccagaccatttccaagggctgctccaaccctgttcttccaaaattccctgtttttcactcactctggtgtctgttaccaactgtgagcactgagatgtcttggcaccttcctgcctcctccataagatctttaaaaaaaatttttttttggccgggcgtggtggctcacacctgcaatcccagcactttgggaggctggggcgggcggatcacctgaggtcaggaatttgagaccagcctggccaacatggtaaaaccccgtctctactaaaaatacaaaaatcagccaggcgtggcggcgggtgcctgtaatcccagctacttaggaggctgaggcaggagaatcacttgaaccagggaggcagaggttgcagtgagccaagatcacgccattgcagtccagactgggtgacagagagagactctttctcaaaaaaaaaaaaaagttcttataaagatgaacactggacccccatgaaatctcaaagatcagacaactctgcccaagaattgtccctgtccccagtctttcacagtccctgggagggcatcagtgccacaggaggacagataagccacttaaggatgagtctgaggagtcaagcacagccaggagccctgggctggaggcccctcacctcccctctgccttccagaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacaggtgaccggtaaccccagacatgccgtgggccctcacctaccccaccggccccctgatccttcaccacagctctctacttctactgctggggaggggccattcagccaagggcttacagttccaagagagcaaatacagggtcttgaacccagtgtttggaaggaaaccaaggggacagtagctctaataagagtcacagggttgtcatcaggagggcacagggatatcctaggaaggagtaaggcatgctttgcctcagtgtggggtaatgtggaggccacacctatcaggagtgccactcaggggttcctgctgcaggccagagatagaactgatggtgcctgaagtcccgcccagctccatcaagtcatgatacgatgagctctccccaagacagagctgcccgtgtggccacataccgtgtaaggtgagaccacacctgagggatggacatccacacagatggaaacatgtccagagtggaggctctgtcatccatgccatctgagaacagttggagaaccggggcttattcagcctcttatgaatatgagagttatgagagaaggactgtcatgtcacaaaggagctgtgttcaccctctgaaaccacaggatgtagagctgaatgaggaacagggagcagaagctccaggaagccagatgctggctgaatttaggaaagaacctacaatggtgggcgttaaccaccatgggagttctcggcccccttggttggtagcaagttacttggacactctctggatgtccatctgccaaggatattgtaaaaaggatccctgtacagatggggtcaacctggtaacacccagtgccactcctgtggagttactttctggccaaaacacctgtcatctgtaaattagggcttcccatagcatctgagcctcctccatagtcatgatcatgcccctaagagctttcagtgggatgtgcccagagtgcccagggtgctgcagagcaggagcaggaggtctatgcacacatctccaagcaccaaggctggactcacagagagcaaactgaggtccagagaccacccaaggtcatgccaagcctcagtttccctggctgtaaaagaggggtctcaatgcgggccctggtggtctcctgggactcctgtggggtttccaaatctataccccgattgagttgaaggaaataagtggatagtgggttcagccccttaatacattactacgggtaaaaaaaatcataagtcaatcgaaaatatttgctgcacaattattgtatgccctactttaggccttgtggaagataaagatgtcctgccttcagagagttcagttttgattataaccccttctctctgtgactgcactgattttgtaaagaagtccagacttttttctttctttttttctgtcattaattttgagttattccactaaaatctaatgacaggtgatgctaccctttgttctgagccaaggcatgttgcttgcccagaggggatcctacctgcaggcaggcccttttcattctgccctggagcaaatcctgcctctgtggggaagccccatcagggccctcctacgtgcttgtatcttatagactgtagattcagtgttgcattgacgtaaattttacacaaacatagcttctagaagcacacatccttgatctcttttagaaaaaatccaaattctgtttatttttattttatttatttttttgagacagagtctgactctgtcgcccaggctggagtgcaatggcgcgatctcggctcactgcaacctctgcctcctgggttcaagcgattctcctgcctcagcctcccaagtagctgggattacaagtgtgcaccaccacacccagctaatttttgtatttttagtacagacagggtttcaccattttggccaggatggtttcgatctcttgacctcgtgatctgcctgccctggcctcccaaagtgctgggaactcaggggtgagccaccgtgcctggccactttggccattctgagaatcatctatacacaggaaaaaacaaacccggggtgctctaggaacaagggccataggatcatataaggtgcattatgagggacataatgaagccacctgttcccaaatagcttcccctctggctttgcccaggtgcctgatgtcacctcattctttggggtcatgctattgtcatggttctcaaaatgtcgtccctggaccagcagcatcagggaacttgttagaaatacaaattcgtagcctcctaccccagacctgctgaatcggaaactctggctgggcacagtggtgcacacctgtagtcccagctagtcagaaggctgagacaggaatttcacttgagcccaggagtttgagaccagcctggacaacatagccagaccctgtctctatttctaagaaagaaagaaaaggagagcgagagcaaggaggaggaggaggaggaagaagaagaagaagagagaagagaagaggaggaaagagagaaaaaagaaagagaaagaaaggggaaagaaaagaaggaagggagagagaaaggagaagaaagaaagagaaagaaaaggaaggaaagaaaagaaaggaaaggaaagaaagggaaggagggagggaaggaaggggggagggagtgagggaaggaaggaaggaacgaacaaacaagcgaaagaactctggagtagggtccaagcagatgtatattgaatcttccaattgattctgatgcactcttaagtttgagaaccattgctctattgaactgttagtaataatgggccgttattgaccactaaaccccagtaagattaaaatttcagtttcttcacagaaagtaaaggaactagaactagaacaagttagttttgattaagataacatggaaaggaaaattctacacatttaggagactgggatgaggggggagaactgtggagggtttctttcccggtccatgggccacctacttagtaatgggcccatattcctagttttactgcgaagcccagtcttactatagtatactctcactctttgtcactcttcatcataaaagcttgtttgggggcactctctttcaatttgcttttgcttccattgtaactgatttgtattctatttatgaatgctgcacacactgatttggctgctttcaatcccaagtgagtaccactttgtaaacactggaattttaaaatgtttgatacttggaccctttctgaaattttccatgttatatttctttcatattcatctcaagtggctttcagataaaccctacagagttctcgatataaaagaattgataagcataagcagaagacatcaaaggtggtctgaagacattgggtagtgaaaaagacatctgaactccccaggctcaagcgtcagccaggagttctctagcatttgaatgagaagccctgagccagccttcctgcccggcttctctgtctccatcattaattgcacatcatgttcttttggtcactgatgtgaggaaaggcaatagaaccccaatttctaataaatgaagccttcctcagaacaatcctaacaaacctctgggttggtagagcttctaggaatattctgccctgggtcaagatggaattccttagccacccagcgtcagcaggcctgggagtgagcaacgtagcagttcaggaagaagagagagggcagcaggcctccaaagcctgacttcctatgggtggccacatcccaggggagcctggccctgtgaatgaggagcaaaggaaggacagactgcagaacgggggagcagaagggtccacatggaaaggagagacgggcaacagtggttccttgaaactctccctgtagaccgtcatgtgatccacatgcagttagggacactgaggccagggtagggaagtacccagcaaggaatgcagagagagccgctgagagcagcacctttgggttcccgattctgcttcaggacctggactttggtttaactttcctcaacttgcatttggcagattagaaaagataccaaagcaacaagttatttcaggcctagctgacctttaataaaaagcacatatgggctgggtgcagtgactcatgcctgtaatcccagcactttgggaggctgagataggcagatcacttgaggtcaggagttcaagaccagcctggccaacatggtgaaaccttatctctactaaaaatacaaaaaattaaccaggcatggtggcacacatctgtagtcccagctactcgggagggtgagacacgagaatcacttgaacctgggaggtagagattgcagtgagctaagatcacgccactgcactccagcctgggcaaaaaaagaggctggaagggaagggacgtatctgtggaggtgaacagggcagggaagttcatggtgtagagctgggaagtttataggctctgggccagcctttctgggatgggatcatggctccgagtatgaactgtgtgaccttggatgaattacataacctctctgggcctcagttacctcatctgtaaagtgggcatacttggtgaagatctgggaattaaacaaatgaatatatgtaaaggcttggcatagggcatggcatagagtaagttctttgaacatttttaagtctaaaagcccagtggccggtgaagattcacaaggcacgttatcctccagtttgtcttagcactttgtcttggctccagattccttatttcagtttttaaaaccagctgttcgtggtcaggcaggtgctgtcctggcccagctggtctgtcagagctgtggcccaggctctgtcccaccagcccttccctaactggggcaaagtgaggaaggtggagagggagctgccctcacaatggaagccaggccttggctctaaggaactggaaggagatgggaaggggttgggaatgcagctcccagccccacagctgctgaccctgccccgtgtcatgtgctcatccacagtgaatacaaccgtgttcaatgcttcagccccattggcaccagacaccaacgcttctctggtaagtcctttcctcttatgttagacatttgagtgcttttgtttgtaggaggagggagaaaagattttggaaatgagaccaacttatggcctcccagacttgcagaggtcaactccagctgcacgtcagggtcacctgcagagctttgtaaatgaacacttttttcttaggtatatactgtaaacatcccacttaaaaacatgcctcattctgttaaatccatgtttttttgtgcgttttttttttttttttgagacagggtctcactgtgttgcccaggctggagagcagtggcgtgatcttggctcaccgcaacctccatctcccaggttcaagcaattctcctgccacagcctcctgagtagctgggattacaggcacgcaccatcacgcccagctaattttttgtatttttagtagagacggggtttcaccatgttggccaagctggttttgaactcctgacttcaagtgatctgccggcctcggcctcccaaagtgctgggattacaggcgtgagccaccgcgcctggccccctcatgtgtattaataatatgatacgagctgggtgtagtggtacacacctgtaatcccagctactcaagaggctgaggcacaagaattgtttgaacccaggaggcagaggttgtggtgagccaagatcgcaccactgcactccagcctcggtgacagagcgagaccctgtctcaataataataataataataataataataataatatgacacgcacacaaaggaaggggaagtagagatgagggatggtaaatagagcctcacaaagctgtaagcaaagcctgccattcatttttctgccttcttccttctctttctgcctaggacccccaatttctagcagtgccactctccagccccagagagtttattagtgtttcttcctcaatgaatctaatgtgtcctttgcacaccttagtctctggggcctaaggtatggtctgcctttcccagtaatgacagtggtcttcaggagccagcatcccagcctaagtggcttaatgatagaagttcaattccagatgaaggtagcacctggtaggacttgggggacatttgtgagcttttactgtctccaaggttgcttcttaagttattcctgcctaggcaattgactgctctgcctacacacatcctagttggcaatttaacttaatatttttcaaagattagggtttttttttttttgagatggggtcttgctctgttacccaggctggaatgtagtggtgtgatcgtatcatcactgcagcctcaaattcctgagctcaagtgatcttcctgcctcagcctctcgagtagctgggactacaggcatcagccactgtgcctggctaatttttaagttttttgtagagacaaggtctcactatgttgcccaggctggccaagtatcaaattttgagagagaaagaacagaatcagtcagtgcctatttctgaatccctattatatgcaaggggccatgtgcactgaaggctaaaaaagacatctaagaaaccaacacagaacctgtcctcaaatttgtttttaatatatttgtagagaagaacctgaaaagttatgggacagcataagcagaatgtaccatgcattaaatataggccaaatgtgtacatcaatcttgaaggcaggaaaggaggctgctggagaggccaagaaaagcctcaaagaggaagtagaatgcgatctggtcttcaaggttgggaaaaagttggctcagcagagaaaagcacattccagactgaaggaacagcatagacagaagggcaagagaggaaaagcacaaaacctgtgcagaggctagtgggtgggctaggccagctaagatggggtgagggtggggcttggaacactgtctcacagtacacatcagagtgtgtctcacagtacacatttatatatatatatatataaatttatatatgtatatataaataaatttatatataaaaattcactgttgtgtatgccttggattttaggcatctgagacaccaaggtggggaatggctgaaatgacccaagaggggactgacaagggaggtgatcccccatatatgaaagggtgtgacagaggggatggaggggagagaataaagatgagacactccaggaaggaggcgtccacaggacctgtggttggttgatgggagccaggcatcctgcctctgcacttttcctacttgctagcacagcagtgcatcctagaacacaatgaagaaacacatgtgagctcctaatcttcctagggagcttgtcattccttgaaccagcccgtccccaggaacatcactctggggggctggggtccctcagagggtgggaaggtatgctggctgcctggggactgcagtgggaaggacacagctgactcatcaggaagatgctgacccattctctcctgtgcttggtctccaagtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtaagctcaccctgcagttaggaggggacctgcagtcagacagctgctgagtcccccagagagggttctggtccaccgacaggatggactccatgcgagcactggcccactggggtttttcaagttaagtcagagagaactgtgttcccttgttggctggtccccttgacaacacttggtattgtcaggcttttatctttagtctttgtctatagtagtatctcattgtgttttttaaatttttcatttccctgatgactaatgaagttgaaaatacagctattcctgtgtttattggccacatgcccaattgcctttctttttggaagtgtctgttgaaatctcttgcacattttgggttgtctgcctttctgatttgcaagagtttgttatatattctgggtagaaatgtttttgtgattatatgtgttgcaaaatcttctcccactctgtgactgtttttttctttttacatccttaatggcatcttttgattaacagaaattcttagttttattgtaattgaatatatcaaactttcctcaaggcaaatattggacagcagatattcttgtatgttaccttctaaaagcttcattgtttttcctttcatgttagatctacaatccatcagaattgattctgatgtgtactgtgagacagtgtttctttgtgattttatatagtcaattgttccagtattttttaaagactattctttctccattgctttgcaatacttcctttgccatatatcaaatattcctatatgacagggtctgtttctgggttctttattctgtttcactagtttatttatatatcagtatcacagtcttcatttctgtagcttataagtctttatatctttgtctcccaagctctccccttttgtcctttttatataatattttcttggccctttgcatttccacatgaattttagaatcatcttaaatttcaccaaaatgaaaacttgttggaattttgatgggattatctttgcctctgtttgggaagaattaacgtctttcaaattttgagtttttctgatttatgaatacagtatacttcatttattttggtcttctttctctccataatgttttatacattttgatctttaagtcttgaacattttttgttagagttattcctaggtacttgatttttttataccgtcgtaaatgctaactgctatgttattattattttattattattattatttttgagacagagtctcactctgtcacccaggtgggagtgaaatggcatgatctcggctcactgcaacctccgcctcccgggttcaagtgattctcctgcctcagcctcccaaatagctgggactacaggcgcctgccaccacacccggctaatttttgtaattttagttgagacggggtttcaccatgctggccaggctggtcttgaactccttacctcaggtgatccccccacctcagcctcccaaagtgctgggattacaggtgtgagccaccgcacccagccctaactgctgttttaaattttattttctacctgtttgtggctggaataaaagatttatgaaaacagcacttgcatacataagcagtaactgtgccgtggggtggggggtactcggaagaatttaagcaactctttcccaccgtaaactccattagcagtctcctaaagccatcttaactaagtattacagctgctactgctactaatcataatgataaaatctttgaaataaatagttgaatttttcccagattttctaaagactaaataaaaggtgctttaggaagcttcacagtatataaactgagtaaaaaaatagtttgcttacaacacaaatgcaccatcaagacaagttctcttccttcctgcccacttccagtccagagcacatccctcaatctcctcttatgtaaaaattctcaagcagtcactgtatctgagagtatctatctgttgcctacaggatgaaaagtaattcatgtggcatgaaattcttgtgccaacaacattttttccgtcacattacttaaaaattgctcagttgggccaggcacagtggctcacgcctgtaatcccagcactttgggaggcccaggcaggcggatcacgaaggcaggagatcgagaccatcctggctaacatggtgaatccccgtctctactaaaaatacaaaaaattggccgggcgttgtggtgggcgcctgtagtcccagctacttgggaggctgaggcaggagaatggcatgaacccgggaggcagagcttgccgtgagcaaagattgcgccactgcactccagcctgggcgacagagagagactctgtctcaaaaaaaaaaaaaaaaattgctcagttgccttctggaatttccggttgcagagaggaatgaggccacaccattttatactcatcagattggtagacagatgaaggtcttgggacaccagatgttggagatggaaagcagtaggtgggaatgtagacagatacatccaatttggagagcaactgacactctctgattaggttggaccatatgaagttgcccatatttgactgtttcaacctacaaaaaaagtcaagttcatgtggtttaacttaataagcattcatatggttttgatgtatatgctaggaatattatagaaaaggaagtataaacccagcacactacttggttctgctgtgactaatatttatatgatcatgataatataaagctgttactaattttcaacttttggaattgacttacagataaaacacacaagccatgtgtttacggaacaagaaatgattgttctcagcttcgacaatggaaaggtcaaagtggaggtgtgacaggaaggaagaggggaggaggagagaggtggtaggaggatagaggcagtggtcctcaccttgcaagatggagaatgagagatattagccaaagctaatggaaggagatgtttaattattatcacttgaaagtacaaaggaaacccataggagcttaaaattaactatcaaagattaggaataaggaaaggacaggaggcacagtgtaagtaaaggtaaattcttatcaatagataatcccttaaattagtaaatgaaaatattaaagtatatgcatattagttaatgacatggagggaacctctggaacaagtaaaatcaagcagacatagtggatagatctggaaggcggggctggattgagaaaaggggaggtgggagactttgcttttcctcataagtattttccactatgtgggtttttaaccaattacatatgttatgttaataacaaatttaaagagaaaagggggatgcagggaatgaagtcaatgtactgtcacctgcccctgcccttcaaattgccttctttgaaaagatattaaaaaggccacagggtagacgttgggggaccatctgtcctgagacttctggacatagagttggtttggaggggaggtcggaggacattgattcagaatgggcaggaaggtcaggttcagaacttggtctaggaagggcctccaggttcagaacctggcctaggaagggcctcttgagaaacagcggaacaagagactcttggtggacaaaaggtctgagtgtagccaatgatccccagtggaattggggagcctccctcctagcccaggtggggtacaacaacctgtcacaggcttgtaggaactaaggtttgcttcagagtccagcccttgccctcatcatacctgctgggtgccccagttcagactgtcataccagaacacatcttcagcagtggctgccatggccatatggatcataacagatcccacattgaccaccatatgccaagcactctaaatgtgtcacagttcacttacacctttgagggagatactaccatcatctccattttacagagaaggaaattgagtcttggagagatgacacgcttccccaagctcacacagttagcaaggagcagagcctggatttgagcctagttctgctgccttcagagcccagactgtaatagttcacctctttgctgccggaggactggggctgcctggagctgggtgggtgctttactcacttcttttacttgctcatctcctgtctgcaggtccgggccctggtggctgacttttccattgttttctccatcctgatgttctgtggaatcgatgcctgttttggcctagaaactcccaagctgcatgtgcccagtgtcatcaaggtttgcccctttccctcgctctgggcatccagtctgcctgcctaccagctgcagattctttcccctctgtgctgatcaaactctcttctcctcttggccaagagaccattttagttctctgtgtgccacctttcctgaacacaggctcccaggagccagtcctttgaggtagggcggggaggggtaacatattcaccaggaaatcctgatctatagtcacgaggtgaggaaggcactggaattcaccctccaacccagcagaagcctcttgattcctatttgagtgtctccagttccctgacctctagcaatctataagctgggccaaatgggatccattgaaactgatcccttagaacagtgattctcaaagtgtggtcctcagaccaatatcatggcatcacagtcacagggaactcgttggaaatgcaatttctcggccccacctgtggaatcagaaaagctggggggtgggaccagcaatctgcattttaacaagcccttcaggtgacttggagtatgctcaagtttgagaaccactgcttagaaattacccactagttagaactggtgacatatgcttgtagctaaacccagccctactccctcataagagcaccaaccggccaggtgcggtggctcacgcctataatcccagaactttgggaggccgaggtgggcggatcatgaggtgaggagattgagaccatcttgggtaacggtgaaaccccatctctactacagatactaaaaaattagccgggcgtggtggcgggcgcttgtagtcccagctactcgggaggctgaggcaggagaatggcgtgaatccgggaggcagagcttgcagtgagcggagatcacgccactgcactgcagcctgggtaacataacaagactctgtctcaaaaacaaaaaaaaaaagaaagaaagaaagaaaaaaaaaagagcaccaacgatctcaccagagtagggagtccagattctagaacttaccctccctgtctttaaggttttttttgttgttgtttgtttgtttgttttttgagacaaagtctttttatatattctcctcattctgaacatgcaggactgaactgatgttcagcattttacagacaattctataatgctcccagacaggtgactcaggagaggcagaagcagctggccctgggcccacccatttctttattcttttctgctgggcctcattcctgctgtttgttatttgcagcaggtgactgtgctctctctcctggctgccctctgaccttcacctccatgtttcctgacaaaccccagggctgttgcagcaaattaccttcttagttttacagacactgtctgcatgcatgctccttcccatgtctgaatttagtctaaagttgcagctacctaaggtgtttaagggaaaagattgcacttgaaaagtacccaaagtcagggaaagttgaggaggtgggacagcaggccaggcgacaagtgccctgggacaagggagagaggaaagggcccctctctgtttgctcccactcagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaaggtaaggccggtactaggagcagaggcataacctctttcttcccacaaagtcagaaagagcgaaggaaggacatgatgcttctttcagtactttgggccaggaaaatatgaggacagagactagagttcccacttggtgtgttgagggggaaatgtgacctccagatgtgggtaaggccaccagggctggagtgactttctgaggaccaggaccaaactaggctgggccactgggcacaggctctctgtctttcccaaagtgacctcgagttcttatgagaatcagcagatcctgacaggggctcagcctagaacactgaggcagaggaacttccttagccttcctggtctctgcaactccccacccagcctgtgagcctgagaagactcgggtcaccccctcccccatccaggtctggaccactttaggtgtggcctgtcccagctggggcccctcaggaaccgcaaagaccctgtggccaccttctgggcccttctccccagagacccaaacccagggcctctccaagcttgaacatccctctcttctatgacccataccccttaggcagttcaccctttcagatggggtggcaggacacacccacctctgcaatccttgcaaggagcacctcaggccccttcagtatcttctggaaggcagggggtccttgaaccatgttccacagaatggttgcatccaggaggaactggctccccagaaacttctccctcccccaaccccgctcctgcagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcaggtaggaggggtcagggcctagggatcacccaatggggaggggcccactcggggaggagaagctggctttgcctgccacaaaaggatttggacaaaaagggcccccgctctgacggcccaagaaccacagggacaggagtgctatccctggagggagggaaggagagagacagaagtccagctctaagtggggctttttacctactgggctccaagcagtatgcataccccatccataaatatgcacacgtgccagacactcatcttcatcagccacccaaggtccccacaaggcttcgtgctgtcctgcccttttcctcttcctcaagaccctccaggcccctactgccctgatggccctcctgcgggttcaggtcctgctcagtctctattcctccagaaggctgtcctgggatcacccccgctccccagtctgtggccctgcctgttactcctgttccttcacttgcctcttctctcacgccccatggtaggcagagaagtacatcttcagccccttagggcctccagggcgagaccacaccaaaccctggctttctcctacgtggctgccctaagaacttctcccactatcttgagatacttggaccgcccagcctgcccgaatgaggcttctctgcccgactgcagggctcacctgcctcccacccctgacacctgctctgctggtgtcctcttccccagatcctcattcattgtgccccacaaaaacgaaatcttaaaatcaaagggcagagtaatagcattttatctcgcatgtatcctcacaataggtgccattattatctgcatatactgaggctcaagatgggcaggctcctgcccaatgccacataactagcaagtggcagagccaggatccagtccacatcagtcctgctcaagccccccagctacaagccactacactaagcggcctccctcaatgctcctgcaagatgcccttgccccagtcaggggccgcctgtcttcccacatatggttcagctgggcctcaggcaaccaggcagagcttcatgcagaagccctcaaggccatggccttggacacaagcttcaggtgcccacagaggggcaggagggccagagtagttgccaggcatttcctggtacaccctgaccatgtgttcttctctgccagggaacagagagtaaccggcatcatcgtcttcatcctgacgggaatctctgtcttcctggctcccatcctaaaggtgaggtcctgcactgtcacctagggcctcgttgcctgagaaagcagagcggatgccttaggcagggagggggtccccacatggctagggatcactggcctatcagccccctaagaaaggcacagtcttggccgggcatggtggctcacacctataatcccagcactttgggaggccgaggcaggcggatcacctgaggtcaggagttcaagaccagcctgaccaacatggtgaaaccctgtctctactaaaaatacaaaacttaaccaggcatggtggcacgtgcctgtaatcacagctactcgggaggctgagacaggagaatggcttgaacccgggaggtggaggttgcagtgagccaagatcgcaccactgcactccagcctgggcagcaagagcgaaactccgtctcaaaacaaaaaaaagaaagaaaagaaaaagaaaggcacagtcttactaggccaaagcaatgtttccacactgtcaccgccgttttctgtgatactgcagttttttatcatcaccaatcctctctcccacccatcccagggccactctcacctttctggaggatactcttccctctgaaagttctgccaagttgtagccctgcttagatcaggaacttcctgaatggggtgtgtttccacattgccagggtttggggctcatgaagtttaaaacttgcagcaggaggccaaacatggtggtacatccctgtagtccggctactcaggaggctgaggcgggaggatcacctgagctcaggaagtctggggactcgagtgactttttcccacacagcttgaagctcctcttgcttatgtcccaccacaacagctaagagactaagtcaagtaggggtacaatggaggcaggcgtcccccacaagggtctctttctggagagactccagaaagcaaggtgttcccaccaggcttccctgctctccactccagccaatcgcccatcactctccctttcccttgatcagtgcccacgtaagactttcctttcttgaattaagtttacctgtaattgcctcaaccttttgccgatattatttttcctctttgaatatctcaaaacagctcatgaccaggcatggtggctcatgcctgtaatcccaggactttgggaggccgaggtgggaggatcacttgagaccagcctgggcaacatagcaagacccccatctctacaaaaaatacaaaaattagccaggcacgatggtacatgtgaggcatgatcacttgagtccaggaggtcgaggctgcagtgagccatgatcatgccactgcactccagcctgggcaacagagtgagacctcttctcaaaaaaaaaaaaaaaaaacctcattcagaggtgaccttgtaagaaacaaacgctaaagaatgatgattctggctgatgtatttacaatggaaaatatttctggcttgagaattggtgctgggcatacccgagcagtaagtaggaggctggcattttttaagggatatttcccttgtgggggaaacaaattacacacaggagggcaagcattttgtttattgaaaaatatattttaaatggccagggactacttacttttgtagagagggttctaaggtgccattgtgtatgtcaattttgacactgtttaacatacaagtatttgcattaaaaagctcgaatcaggctgggtgtggtggctcaagcctgtaatcccagcactttgggaggccgaggcaggtggatcacctaaggtcaggagttcaagaccagcctggccaacatggtgaaacccgaaaccctgtgtctactaaaaatacaaaaatagccaggtatggtggcacatgcctgtagtcccagctactcaggaggctgagacgggagaattggttgagcccgggaggtggaggctgcagtgagccgagattgcaccactgcactccagcctgggcaagacagagtgagactccgtgccccccccaaaaaaaaaaaacaccttcgaatcggccaggcatggtggcccatgtctgtaatcctaacactttgggaggccgaggtgggaggatcacttgagaacaatagtttgagaccagaatggccaacatatcgagactctgtctcaagaaaaaaaaaaaagctcaaatctaagaacagacttctttaggggcaaaaaattcctctaaagccctcctagtgttggcatagtgctctgtgctctccggagtgctctaacatgaccacaaggaggaacagcctctgctcaccatggggagccacagctgcaggtgaaagagagaaggtaaggggcagaaacagctgagagagacagcggaagaatgctttgaaaggctgtgaagatttggaatcattcttgtagagtgggatgaattctatgatcccatttttgaaaaagcaaacaaattgcctgtgtgcaagtttggagggaaggatacccgccaaactattggtggttagttggtgatgagtgctgattagtttacacacttttgttctgcttcttttgtatgtgattgcgtatgaggcatgatttctgtttttttttggtttttttggggggcgggggggtttgtttgtttgctttgtttggtttttttgagacagagtctctttcgcccaggctggagttcagtagcacgatctcagctcaccgcaacctccatctcccggattcaagcgattcttctgcctcagcatcctgagttgctgggattacaggcatgtgccaccacgcctggctaatttttttgtatttttagtagagacggggtttcaccatgttggccaggctggtctcaaactcctgacctcaggtcatccacctgccttggcctcccaaagtgctaggactacaggtgtgagccaccacacccggccggatgcgtgatttctgttaagtgtcccgggtactcgctgctgatgtagatcagctcattaaaagtccccatgcccctgcaggctgagcagttttaggggaccctcagctgaggctggaggtaggaagaagctgggcaggaatgaggagggggcagtctgtggagtcttctcactttccagaaggcatttctttagccagaccacatggcctccgcacggtgcagtgaggggccaggccaggagagcagctgcatgctgggccagctaccccagccagagaaggggcagtacagccccagtgaccctcatcttcacccctgcccacatcccagttctgctgactctctgttcccccaaatatccagtttcctagctgcctctgtggtcaggagccactgtcatccagaacagggtggccaagggccgccccaggcagaggccgatccaaagctctgctctcattttagtgtatccccctgccggtgctgtacggagtcttcctctacatgggcgtggcctccctgaatggcatccaggtaaggctttccctccagatcccttcatgatctggagtcaacattccatgtctggttccatgtcaccaagacccccaattcagttgtcccaattgtccccaattgtcctaattcaatgaaagaataatagtaataatgatactaccacttactgatgctatcaggcaaaataaatatgttaggcacttcataggcctcatataattgaatctatgtaattaggtcctctgatccccattttacagatggggaccggagggtcagaattcaaaatccagaagaagctgactccagtgagcatttcactgtacctctctctcttccctaaggcagctatgcagaagaaaacatttttgttttgttctgtatttactgtgaaatcccagaattcttaaacagtttgtgttacaattaacttgcactttccctgaatatggacaatgtccattttgtggccagctccagggctcctcccctcacccagggctcaggaccctttctctaagaccccattatgcatccgcctagacacctccagcccccctcccgtgcatccttaaggcctgagcagggggcttcccctctctgagaccccacccaggcaccccttcccctagtcccaggacccagcgggccctcggggtctggctgcctggctgagcccccgctgtccccctagttctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatggtaaagtgggcacgggcttccccctcctgcctggcaggttggcctgggcaacccagaggtgcagcgcaacctcccctcctgccaccttctgccttcctgtcagctgtggcctggctccctcgggtcacggaggctggcacagaatgacctgatttgagttgtgagtccaggccagatggtgtggggtggggcagagaggaggcggaggaaggaatgtcagagccgctcagtgagaacccaggagccaccctacctcctggctccagggagggacggagaaagaaaatcagttcaaccaggagaccgagttcccactgccaaaattccaaccagtctcagaagtcgatgcgtactaaatatagatctttccaccattcaagatagctaaatttaaaaagctaaatagtgaagtaggggggcaggggaagaacgagggtcagagatcaagaacaacaaaacccaatgatggtatatataaagcttgagcaagggaaaggttacaggtctttcactattcttgcaaatattgtataagtttgaaattactccaaaataagaagtgaaaagaatgcaaagccaacaacatgttgcatctggccccctagataactcaccgagggcagtgacccaggcccttgccaggagcctggagtgtgtcagcaaatgcctggggaaagcctgagggctctggggtaggggacaaagtaaggacactgaggagaacttgaagtgcacactgctgggaggggtctagtccatggttcttgacccgggctgcccatgaaaatcaacccagatcaacaaatcagaatctctagggaaacccagactttggtatttttatgaggtccacaggtgagcatagacctgcagccagggttgagaacccccactgcagggaaagggagatagatcctccccccagtgccctcaggggcctcagagctggcgaagggaaaggcagtagtagtcatgattagcatttactgagtactgttccactgagtccacaccagcccccaaagcactaataaccccgctttacagatgagaaaatgaggctcagagagcatgagcagagtgaccctggacacacagccagatagggcagggcaagacccacaccctccacctattgatttttttgtttaatttgcatacagtaaaattcaatgtgtgggtctatgagttttggcaaatgtacagagtggttagagacataaattctcaggcattacctgacctgctaaatcagaaactgggggaatccagtgatttgtgtattaattaacaagccctccaggtcctggtgcatgctcaagtttgagagccactaatttatgtatttattttatttgtttgagatggagtcttgctctgtcgcccaggatggaatgcagtggcacaatcttggctcactgcaacctccgcctcccggtttctagcgattcttctgcctcagtctcctgagcagctgggactacaggcacccaccaccatgcctggctaacttttgtacttttagtagggacagggtttcaccatgttggccaggctggtcttaaactcctgacctcaggcgatctgcccacctcggcctcccaaagtgctgggattacaggtgtgagccaccacgcctggctgagaaccactaatttaaagaataactgtagttctccagcccatggcctttctgaggctccccacttcggctgtcacaggctccgtccctcttggtcactggtaggcatggtcactcacctgaggggccagacaagaggaactacggtggagggaaagtgaataatggcttatgggagcttcgagacggctccaaagacaccacaaaaagtccctgaactcagccgactgagggagaaaaaaatctatgcctgagtttgggcattgagaccacagttttctccaaattctcacaaaactttagtctctctccaccacagatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggaggtggggaagatgtgaggccggggcacagaggagaaattgagagaccttctctccacttttgccagggacagggagagggcggcttcttgggtggcctgcagcagtgcctcggcccagtccaggatgggctggggcatctgcttgtcttggtctggggtgttgagggctcttctgtttatgtgaatatcctcagggtgggccagagtgaatgagactccctgtccagggaaaaggtgactggccatgcccactctttccatcactgtgggctttacggccgtgatcacagcaagcgggttcctgtgggaagggccaggaggcagctccagcatggaaggaggttatgaagactgacctccaaagagtggagcagacttggggagaggtgtctaatggggccttataagtagactggactccagacaggcaggaggggctgggaacaagttttgcttgcgcctttgcctagggtattgaggacaaagatggggaaagaggcaggtatcctcgccaaaaggagactggctacatttcccagatgtctgggacaacatggttgccccatctgcccctcttctcccatggtcccttcccatttcatccccaaaacactcagggagtcaacagacaaggggccagtccagaaattatagtgaatcacaaaacatgaggcagaaagattcttaattcatgtgttcattacttatgatgaaactgtccccacaaaaggaagtgacttacccaaaatggacatgtagctacatttctaagaaggaattaagaaaataattcctgactttgctggtttctgatatgctaagctgcctgtgccatctcctaatgctgtgcttggttcccaatctcccaatttgacccaaactcacgtccctgcatccaccctgtcctgttctcgtgattttgccttgtgcagatgaaacctgttcaaggcaaatcccttctgactggctggtggtgattaaaccatcttctgatcagtcagaactcccctggtccttaattactgtgctcttccaggaagagtcccataatgcatgtgtttgtagatgatttgtaaaggtgggttctgaaaacaaagaaacagagactaagtgccttttaaagacaaatacttcttttgttgatactttcaataaatatctgagtggctaccacatgccaagaactattacagggttgggaaaaagaatctctgaattatgatatatcaatggaaaaacaggattcaatttatacaaattcattttacttgtcttatagcaacacagttgttgtgtgaggttcattcccaagtgactggttgctgtgacagataaaactgttttgatgagtaacattcctggaagagttccggtctgtctgatggtgtgtataggacagcaggctaactgtgcccattccccttcagtggaccccagggtatttgcagcatcccctaactgtttagaggtgaacagaatggtggtttgcaatgttcatgcatgcattttccatcttggcaagaaagccaagttgttggccacgcgcggtggctcacatctgtaatcccagcactttgggaggccgaggcaggggggatcacaaggtcaggagttcaagaccagcctggccagcatggtgaaaccccatctctactaaaaatacaaaaaattagccaggtatgggggtgcacgcctgtaatcccagctacttgggaggctgaggcaggagaatcacttgaacccaggaggcagaggttacagtgagccgagatcgcaccactgcactccagcctgggcagtagagcgagactctgtctcaaaaaaaaaaaaaaagaaagccaaattgttgtgttggtgtttatcctcttttcccactgtttttctccagccccagttccctcctccctcggttataaagattcccatggaaagtgtccaatcagatccccaaaacggtatccactgcattgccagtaagtaaaacacatgatgtctctcccttcttactactagtcctccatgtctttcccctaggaactttcatctgtaactcagggggatctaatcattttggatgctagagcagcagtccccaacttttttgtcataagggacaagttttgtgcaagatagtttttccacggaccagtagggagtggggaatggttttgggatgagactgttccacctcagattctcttaaggaatacgcaacctagatcctgcatatggacagttcacaatagggttctcacccttatgagaatctattgctgccactgatcccaccggagctggagcacaggggttaatgcttgctcgcccatgctcacctcctgctgtgcggcctggttctgctactgttccatggcctgggagctgaggacccctgcgctagaagacctttgtccttggcagagatcaaagagaactgggccaccaggactggtactccaaccagatggaaaccccagagcaaagcctgcagactcgactaattctcactttagttgaggcaaaatccctcattccctcctttccccaggtgtccccagatccctgtggcatctcctggccctcttctatgttgtttcagaccacatcagtccaaacatggcccaccaggcctcccatgttttccagtggctgttgaaatggttgagggctcagaaccaagcttttccctttagagaaataggtagcatagcacttgggttataagtcaggcataattggaggtcctcgtggtggttgtgctgtgcctctgtgtgaatcctcagcaccttctcagcagacagctgagagggaggctgcctaggagggactgggcattgcttatggaaatcctgggagattatattactgcctttaacccctcccagcctcagctccctataggtggccagtcctgtcatccaggcaacatagcctgtcccgaggtcttctgaaagatccctaccttagtcccgagccccgtgcttctaatacagggcttgccaccctcaaagacagattaggggtgggtagccagggcatccttcccatcagcactgtccatcataggtacctcaagatcttgagtttctcagactcctcccccactcctatttctctcttccctggccctcccatgcctcacaccccctagccctggctgagcaccttctgggtgaaggagtaactaagcccgaagccacacatctctgaggccccgtattcctcttgcatagtgttggctctagggttagagaaggaaaagaaaggaaatggtgggggaagcccggagaaatatggtgctcaaacctgctccacatctgacatttttcattttcctgccaggaaaaagatcttccagttggagttactcactctgattcttccttcagtgacacagaacttgaccgaaggtaaacactgttaggtagactccttgcgtattaggtaagagactaggaaatggccgggaaggtggagggtctaggatttcccaagctagctgtcctctcagtagaaggcccttgctggcccccaactgggagtcaaaggctgacaaacctgactcatcattcagggccaagaaacaagtatgtcttcttactgacttaacaacatggttacaacacacaaaggtattcaactttagtaaaggaaattcttataaaagattaggtagaacaaaaattgaaagtaaacgttgtggcccagcacggtgcctcacacctgtaatcccagcactttcggaggccaaggcgggtggatcacgaggtcaggagatcgagaccatcctggctaacatggtgaaaccccgtctctactaaaaaaatacaaaaaaattagctgggcatggtggtgggggcctgtagtcccagctactagggaggctgaggcaggggaatggcatgaacccaggaggcagagcttgcagtaagccgagatcgcgccactgcactccagcctgggcaacagagtgagactccatctcaaaaaaaaaaaaaaaaagaaaggaaatattgacagaaaacagaagccaggcgcggtggctcacgcctgtagtcccagcactttgggaggctgaggcgggcagatcacaaggtcaggagatggagaccatcctggctaacatggtgaaaccctgtctctactaaaaatacaaaaaattagccgggcatggtggtgggcgcctgtagtcccagctactcgggaggctgaggcaggagaatggcgtgaacctgggaggcggagcttgcagtgagccgagatcacgccactgcactccagcctgggcaacagagcaagactccatctcaaaaaaagaaaaaaaaagaaaacagaaaaactaggcatggcttaagtgtaatatcactgaaagccaggataaatgaacgctaaggatcgaaaccctggggtactctgtagaatgaattaacagcagggttaattagcaaaggtcagaaagggtatggaggaaagccaacatcagagatcaacatcaaagctaacatcagagatcaactggagatgggaactgttaagaataggttcaaggccagttgccaggagcccccatgccaacaatgtgattgttcttcatgagaagccacccgtgaaaaaggtgagactccctgatgatgacatagtgggggcaaacacagaaaagatgaatttagaggcaagaaaggctttacttcattgttacttgggaagatgccaggggcagtcccactcctaccttgtgccctagaatggacagggatcaaacagtaattacagcacaggctatcccaagtctagaagatcaatctccaggcacagagggcactcatccaagagatttttggggaaacggggcaggggatcttctgaattataaggcaaagctgctatcccaatgccagggtgaaacgacacacttttccccagttcaaccctccctaagcagcagtcccaaagatgctctagcccaaagtgtcacctgtcccagttaatctccaccttccttctcatcccacttccccagtcaggctcctatatatgtgatgccattgatctttatacattagtatacaccggtattatgagaaaagcagtctatcttattttcatttataaaataatctacatgaaattgactgactactcccaatttcaggcagtagagagaaaatttggaccaggttaggggtttccaaaaccctgttaaattacacaaggccctaagacagggtcagaaatgaagaaactttggtaactggagatggtatctcccaacctcattggtgttttactgaatttatgaaaacagatggaggcaaagatcactaaatagcaagattctgtttcagtgaaaggctctgcaacatgatctggtttaacaaagactaagcatcaatgatctaccaggtgcgatgcttaatccctgaggatgtggaaagaaaggcatgcaaacaaagacagagcaccctgtgcaagaatatcggagtacacagggagggagtagcctcgttttgagaatctaagaaagggaaactggaatctgccagacatagagcggggcagagaaaagaaaaggcatttcaggcagtggacacaggcccgaagtaccatttgaaaacacacacaaacacacacacacacacacacacacacacacacacacacacacacctccaaagagcaaagaacactgcaatggatggggcaaactaagcaggcaggactacaaacacagaagactgtgtttgtgtttgtgagaagacaagacactcctgtcttctcacactaaggagcttagattctttgaacccaatgaggaatcaccaaatttgtgatttcaaaagttcaccttggcagcaatgtgaagataggtttacagggtgagaccagatgcgtgactatggctgaaggccaagccaataggaaactgctcattctggcatgtgctgagagttcagaagcaaagatggaagtatttgcattagagccctgctctaggggatgggttcaaaacaccaagaactacgtaatccttctttcctacttctcgttcagcatcaccttgcacttcaaaatatcctgtccagcttcacctgctttcagctactcacggaacccagtgttcatggtgccacaggtgaagatagagatggagtcagactatgacttcacagacatggataaataccgaagagaaactgacagtgagaccaccctctaggatgaagcagcttctcccagatgggagatggagagcctggcttagtcttcactgggagggtcttaacttctctgtgcctgtttccttctttatcaaacagagggagtccgtctgcctatagaaaactggagatctattgatgaaaagtattgcttagatgcaaagctctcccctttgtagtaattaaaatacctaaagctaaatattatattttattttaaaatgcagttcagcatagaaattctaacatttctttggaaataaaaaaatgcttgtttccccaaaccatagctaagataaaggggcaatagtcaattcatatttaaaacaaatatcaatttaaaattgtttaaaggttagatttaaatatagatgttctcaaacaaacttgtaatatacttttatgtcactagaccatctttggaatatttggcaattctgcatattaagaaatgctgaaaaggtcctatcttttctccctgtcacatccaatttcctaagggttatatgaaaagtttgaaccagccgggcacagtggcacacgcctgtaatcctagcactttgggaggccgaggcaggtgaattgcctgagctcaggagttcgagaccagcctaggcaacacggtgaaaccccgtctctactaaactacaaaaaattagccgggtgtggtggcatgcacctgtagtcccagctattcgggaggctgaggcaggagaatcgcttgaacccaggaggcagaagttgcagtgagctgagatggcaccactgcactccagcctaggcaacagagtgagactccgtatccaaacaaaaaaaaagtttgaaccatctgcattatgggccttgctccagaagtgtgactggggctttcccagattgaaaagccagttccaaaactctgttaatgaaagaaccaatgcatctgagtggataaatgtttctaaaataaaatagttcttgttaaagtgaaatttgaaaccacatgttaaatcaaaatgatcctttaaattagtatcactggtttttcatacctggaatcacatttcatgatacatttgggtgggtcctccctgcaaattttcaatgtttattcccaaagtcaaactcccattcatgtgaacaatacaggttagacagaggtaaggtcacattttacattacaactttgcaatattaatcaacctagtactttaaaggaatgattgaaaactatttgggaagataaaaaccagtttcaatgaagcaaacctattcctcatgaaacttaagatcagtcattttatcttcaatccacatttaatgaacaccaaccatgttgatttaatgcctactatgaccctgacagccacagtgcatctgacacttactttctccaaaacaactatgatttaaaccttgagtaaatcacttgaaccttgaggttagagttactatatttgctcaagatgacaaatgcaggtgctttcttttttaaagaaaaatgacactagatcattaacaccttgagtataggacaggtaattgcctctgtaattcccagcgtctagtgtagtgcctggtccatagaaagctctcaataagtgtttgattacatttaatctcagagctcccttccaagggatactgccaagaggtaaagctccaaacctctactcttactgagagcagaatttcttagaatttccagaaccatctcctatgcttaagtataaattcttgtcagacacagtggctcacacctgtaatcccgctacttgggaggcagaggtggggggaatcagcagaggtcaggaggtcaagaccagcctgggcaacatagtgagacccatctctaaacaaatgtttaaaaattagctaggcatgctggcacacacctgtagtcccagccatttcagaggctgatgcaggaggatcgtttaagtccaggagttcaaggctgcagtgagctataatcatgccactgcactccagccagggagacagctggaatccatgtcttataaacaataataattaatttttaaaaaaagtatttatcatccacaccaatcctggggaagctaacaatccacccttaacacatttcagttttaaaacctggctgatctggaatagaactttgtccaaattaaattgtagaaatgctatggattcaagagtaaacctgcttgattaatcaaacaagctggaaaactactgttaatttctttgttgtaaattgatcactgtaattttaccttacatgtcatttatattttgtatatacatgaacattttaatttccatagcttttaacaggttgacataatacttctccatgcagtaagtcagtcattttttccacttgtaactgtaattcaataaaatttaatcctgtctggtcatcttgctccacatttaataatctaggtaagcaggcatggattagagacataagctatacgtcacttacaaaaacatctccagcaaactatctaaacttctttaaactccagagaactatcaaaagaataacgccagctggcagaagaacgaggacggaggtaggtcaactcaattgtttcttctctttctgcctcaagctgcctagagcaggagctacttctgctcgcatgaaagccaaaagccaaaacagacaaacctatccctgcctcaagtattttacagattaagctcctagcttggcacaacctgttgtgatataagactgtaggacaggccaggtgcagtggctcacgcctgtaatcctagcattttgggaggccgaggcaggtggatcacttgaggtcaggagtttgagaccagcctggccaatgtgatgaaaccccatctctactaaaaacacaaaaattagccaggcatggtggcatgcacctgtaatcccagctactcaggaggctgaggcacaagaattgtttgaacccgagaggcagaggttgcagtgacccgagatcatgccactgcactccagcctgggcaacagagcaagactcagtctcaaaacaaacaaacaaagagactggaggacgaggctggtttctccaaagctctttaaacctctgtttgggtgtgggtggcccaggcctgtaatcccagccctctgggaagctgaggcaagaggattgattgcttgaggccaggagttcaataccagcccaggcaacatagcaagaccccatctctacaaaaaaaaaaaaaaaaatagaagaaaaaaaattatctatttaaggctatagaagtaagtgttactgaatataggaatagctacattgattaaatgagaaaaaaactggttaggtcacaactaggagtcataggaagacagaatttcagaaattcataccataccagacagatgtgttttattaaaaaagaaagaaaaccctttaatcagaaagtctgattaaattcaatagtaactcaaactcttaaaaaatttctggaaaagtcaacaggatacatacatcacagaaaagcaggcagctgctgacagttctttggtggaaaagtaagttgcgtacttacccaagctgcccaaatgattatcaagccaagtttgtttttcaaaaataggttttaagatacaccaaagaaactatacaatacaaaaatttaacaatgaagttaaagtatatagcaaaagccaaatatgacaacacacatgtataatgtagaaaagaatcctttcagtcctagaaaactaaaatggggagaacttactgaagggtaacatacataaaatgagtactaatagcaaggaataatcctaaacattttcccaataaactgactaagcctcaaaaggacagcttaggaaaatgattaacatgcagtttttcttttttcctagccaattcagttctacttagataaatctggttgccaatcaatacatatataaattaatttttttctgctcaattactaccattttttctttttcaccttttccctaattttctctagcaacacttttcctttggtttgatcagttgaactcaaaaggtttggtacctaaaatgagtatcaactgttattgcaatagcacttgggaaatgcaatcctagaaaaggcgaatgtgtaactgaggtgcttgacaaagtgaagcatccatcctccatatggtaatgtctcccatattaatcactaggttaatggctgctcctggctagatcacaggaccctgcatgatactggaatgctccctggtgaggtactgcagaggtatgtgcagaaacacccacccatttaagctttcaataaatacaaggcatcattttaaaccatttcagtagaataaattaaaaatattgcatttctattggcctgctttgcttcttgagctggcctggagtgctgtttgtgacacagaagacacagtagttaattagtggctaccccaagctctttagacttcagcacttctcgctcttcaagcctcagcaccttttttgcagcaataatggtattcttcattagcattgccactgtcatggggccaacacctccaggaactggagtgatatacccagctttttgtctgactcctacatagaaacaagacaggcaggctgctttagttatggcaaaggacatgtgtgtactttaatatattattaaacaagcatgcaaggaaaaagtaacatacataagcataaaactcaaaaatcacatctacatcattcaaggttttgtgaacacactagtaaaataacatgcacatacagagttgttcaaggaatatttatacatctaagtaacctataaagaaatctattaaagaaatatctagtaggttaactgtgtgggagttgtaagtataacaataataagcattacctcaatacctgcctatagcattttcttaatttaattttaagtataatttgtccaaagcagaaagcacagtaattttttaaaagtgagaagttaaaaaaaaaattaacctaatgttaaagtgaaaatccttacatacctaggcatgggtttgactgctttaataaaaacagaaagctaggaataggattatcagcataggccgggtacagtggttcatgccagtaatcccagcactctggggggctgaggcagggtgtgaggtgggggagattgtttgaggccaggagtttgaaaccagcctgggcaacatggtgaaaccccatctctacaaaaaatacaaaaattagccaagtgaggtgacatgtgcctatagtcccagctactcaggaagctgaggcaggagaattgctcaagcccaggaggcagaggttgcagtaagctgagatcctgccactgtactccagcctgggcaacagagagggatcctgtctcaaaaaaaaaaaaaaaaaaaaaaaaggaaagaaaaaaaggattatcagcataaaactcggataaacattctatcttaagaactgaaaggagaggccaggtgcagtggctcacacctgtaatcctagcactgttaaaggctgaggcaggcggatcacttgaggccaggagttcaagaccaacctggccaacacagccaaattcatctctactgaaaatacaaaaaattagccggcatggtggctcatgtctgtaatcccagctacttgggtggctaaggcagaagaatcacttgaacctgggaggtggaggttgcagtgagcagagatcacaccactgcactacagcctgggcaacagagtgagactctgcctcttaaaaaaaaaaacagaactgaaagaagaaatctactagtatattctagtatttcaggggtatggttttttcctggaccattttaactttctaggcctgtgatctctcagtgtgaaaatgagaaatctctaacactttttgggaaactccatggtttagaaaaatcacttcatcaaattttcaaacttgttaaaagtcaagaaattgcttgaattatgaaataagtctaaggaaaaaaacaattccctgaaaagtttataactgctctccatcactatgataaaacacctaaaataattctagaaaagccataattttaaaaaggtttctctaattcttatgaaaagcctactaaggccaggtgcagtggctcatacctgtaatcccggcactttgggaggccaagacgggtggatcacttgaggccaggagttccagaccagcctggccaacatggtgaaaccccgtctctactaaaaatacacaaaattagttgggcgtggtggcccatgcctgtagtcctggctactggggaggcttgaagcacaagaatcgcttgaagctgtgaggtggaggctgcagtgagccgagatggtgccactgcactccagcctgggtgacagagtgagactgtctcaaaaaaaaaaaaaaaaaaaaaagagaaagaaacgaaggaagaaaggggtggggggagaggaggggaggggaggggaaggaaggaagggagagagatggagggaaggaaggaaagaaagaaggaagggaaggagagagggagggaaaagcatactgactgggcgcagtggctcacacctataatcccaacactttgggagtcccagctactcgggaggctgaggcagaagaatagcttgaacccaggaggcagaggttgcagtgagccgagatcgcgccactgcactccagcctgggcaacagagtgagactcccatctcaaaaaaaaaaaaaaaaaaaaaagtaaataatctatcctaaatgtccatgaaaggtagtatttattgatttcatttttaaaaataaaatttcaccatttaccttcaaaatccacatctccaaccaacttgggtttggcagttacaggatcgtgaactctatttattcccacatcaatgactgctgctccttccttgatcatatctgctgtgatcagatttggaatacctggaaatggagaaaggaaagatcaacttagtactgaaaacagtctacctgtcagattcttgtctaacttcaatttcaagagaccctgaagaactaatcaacatgttttattaaaacctgttaaaaatatt

SEQ ID NO: 35769 - DNA, 3611 bp, Homo sapiens
agtgcgttacttacctcgactcttagcttgtcggggacggtaaccgggacccggtgtctgctcctgtcgccttcgcctcctaatccctagccactatggtgagtaagccgtgcggctcccggctgctttcagggaagcagggaaaagcgagccggcggggcgctggggccctgtatacagccgggaagggctggcctcagagccgtccgtttggagggcggaaaacgaggcgagaggccagggcgggagtggtgagacctcggtgtgtgtaaatagcgggggcccggaaaggtcgaggggcgccaggatttcttctcggactctggaagggatggggggctcgggctgccctccgccgtatccggagctctcttttgtcgcgtaactgtgtcctgggtgcggtccctcgagtccccgcagtcctttccagcgcatgcccttactccgccttgggtggacgcgcgcgcggactcttccagccctcacttcctcttgagcgcgaaaagcgggggtgggaagcagctggagacaaaagcgcgcacgcgcgaccgttaccttcccgccgctcctgggcgggaaaccgccactgcgctttgcgcatgcgctctgggtcgcgacgcgactagggctacagggcgtgtctcctgttaacctgagtgttctttttttgatgaaagcaataagaggactgcggaagagctccctgtcaatgtaccgctctacaccagtgtattacgacagttcgtacacaacagtctgtagaggccacctgtctctccctgctgcgttaggaattcaggggagcaggtggtggcagtaagggattttgagggaacggaaatcggatcttgacccagatctgggccgccgataatctcctactgcgctcagactgctgtggaggtgttaggctgagcccgatgccggcaggcaagggaggatgggcggcttgggcagcgcctttgcagacgtggccatttcgtgcctctgcagcaccgccggggggcgcaagagcgcgcgcccggaattgctcattcatcctgtgccgcagagccccgccccttgtccctgcggacagacatttcttctgcgctggtctggccacgtgcttcctgtgctaggagctgcccggaaatgtgaccacctagtctaaagtgggcttctggggcctgagcgctggatggatgcccaccttcctgtcttggtcctccaaaggaggaagctgtgactgagctgtcttggtctggaaggaggccttcccggtttaggatgggaaggtaacattcattaaaagcaacgtagactatagtgtagctgttctcaaaagtagtacatcttagaaaaggatctttagaaaagatcgctttagaaaaggaaattcgttttcagattacgtgagtagcctaggtaacacagccagacctcatctccacaaaaaaaatgaaaaaattagccagcttggtggtctgtgcctgtggtcccagctgctccagaggctgaggtggggggatgactggagcctaggctgcagtgagcctagatggcatcactgcactcaagcctgggcgacagaccttatctctaaaaaaataaagattgcatgagtattttgttccacttgacagtcatcaatagattggtttaaattgtgatatcttttttccttcccgcagcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccgggctgtgtttgtagacttggaacccacagtcattggtgagttgacctcagtaacctgagatcccaggatgctgggacaggaggtctgtccaggggcttctcttgtcactcactcactccctccgtccttctctccctcctccagatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggtaagcaccacatataaatatgcatttaatgtggtgtgatagttccagtgcaagttgggtggagtgactgacatcattcattctttggcacctaccaaaatgtggaataggctgcttgctatattaattggacttctaaatcagatagtccctaggttatggacagtttgtggatatgtctgttttgccaattccttgtgcttacatcagtgagatatggttcgtaatctaaaaagttgaaatagaaattctaagataatgtgtcctggcattaaaatattacatttttttattcccctacaggctgaccagtgcaccggtcttcagggcttcttggttttccacagctttggtgggggaactggttctgggttcacctccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatca

SEQ ID NO: 35770 - DNA, 11878 bp, Homo sapiens
cgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgcgcggcccctccccccgccgggcgcgcgcccgctgccccgcccttcgtggccgcccggcgtgggcggtgccacccctccccccggcggccccgcgcgcagctcccggctccctcccccttcggatgtggcttgagctgtaggcgcggagggccggagacgctgcagacccgcgacccggagcagctcggaggcggtgaagtcggtggctttccttctctctagctctcgctcgctggtggtgcttcagatgccacacgcgtcccgggggcccggttctccgctcccctcccctccccttctcgccggaccccgcgccgggagctgcgggaaggagtggagggtcgggcggtggcctcgcggctggcctggcgcgcggccagcgccggtagttagtggggggactgctctgccctcgagggggtagggagctgtggcgacggttgccccatttcgagacaaagcgcatttccccctcccctcccccacccgcgttccggcggaggcgccccctcccccagccgccacgcggggctgggtcgagacttgggcctcccggagggcggcgcgtggtcccgcgtccgcgaggcctggcggcgcgcggccggctgtcccgaggctgcggcgaccgcccagttaacgtggccgccgcgggggtaggcgcgtgcggtgtggcgcagtgcccttgagcccccgtgccgcggcctttgtttctccccgcggatgcgctgaccacgaggcccgcgctcccgggtgggggcgggcacccgcgcttaggcctctggacgccgggcttcagcggcgggggtcgggagcgggtgtttgcaagaggtgattcttttttcaaagtgtcacgaaacggggttgaagcatcttaagttttttccttttgttatttaattaccgattggaaagagggagggtttctgagcagaaaccaagttgggattgcagaacagagaagattcacagtgctttaccgttgtgagttgtttgggtaatcgtgcctggttttaaaccgaaaggattgtcctttaaaaatggaacatggactttattataaatgggacttagattggaaaagacattggtcccctattttaagccatgtgaagctgttttaggtaccaggatccccagtaaagtctttctagactcacatggttaggacacgtacttaagtacatcataagcaatgtaggtaggagcgcagatctactctggatttgtattcacgtttgaaatgtgcgctctctacttgggggttggaatccaaacagaatttgtatttagttaccttttttgtgtcatgcaaacttaccttaactgtcatgcatttttctagtaatagctcttcaagtctgcaataaaaaatggcctccaacaaaactacattggtaagttaatgaaaacctaaaatatgtaaggatttaactcaagttttttttccccacagtataactttgcatctctgtggctgagaaatttacatccacatatttcccagctctcccagtgtaaattacaggggaaaattaagagaaaaacgaattcattacagggagatactggcttggcttaatagtgtcttaactagttcaaagaaggctaatctttgaaggacagtgcaatgtggattttgctgaggatttttatcttcaaatagaaatacacacatttttgcagcgttgaaaaatgttacataaaatggtaaagcccttgttggttggcataatttttcttaaatccccagaattctggagaagtattttcattaaagcccaatttaaagaacaaggtaccttgtgcacctaggttggagcaaaagtcattgaatctttcaaattactttggtcactttatcttgttttaacttactctaaaacatagaagaatattaagtttaattcattgcagtgttttgttttttaaacaaaatgatcgaaatcgcaaatatgagccagaagggagaaaaggctagattttttttttatcttattcagccatgtcatgttacaagtttttttaaaccctggaatattcacataaaaatcatgaaattcaaagttacagttttcacaatatttaacattgcattaatcttaaacacgtaaaggtgaatgttaatgtctcctaggtaaaataaagcatttgtttttggcttgtatgtgctctctctgggtttcacactaaaaagggcacgttagtgatttttaatttgtgccatcattagattctgcattaagtctgtttaccctgcattagattctgcattagattctgtttaccctggaaaacagaagttgtttttgcacgcaattgatagcctttggggtctgttattgtatttagtttattttgtgaaggatcacaggttggccactttaaaagttcttaactttccattttaaaaattcattagtgttgtgagatatgtgtgctgttaatttcacttaaataatgggaaatttattttgactcatccacttttggaaaaaagtgctgggttaaggcaaatatatactataaaagaaaatagtgagcatttgaaactagcttatgaatgccatagtagtgaatgaatactgtatggcattttgtctgcctttttttttttgtaaaccttagtgtgtatccttttcattttctgtatttattgttgactttattttgttagccttctccctttgtggcagtagctgttttgtttttcatgtagtataggtatctgatacacttctgtctattacagtttgtctttgctcctcccaccattattcctaccttcttgtactgtacagtggcagaaagctgtttgggcccagtactcaagtatcttgactaatgagaatcataacacctgacttagaaatggtatccaaaaacgtcaggtgtttgctgcatgtttttgtatttcaggggatttttattttgtgtgtgtgtatgtgttacctatatgcttgcatagcttgaaatgcccttttgcagtcttgaggcctttcttacatatctgtctgcacacttcatatgcctgcatagcttgaaatgtccttctgtagccttgaggtgttcttaacttttttctgcttgctgctttacttgtgggatggctttaatgattgagcaattaaggtttatcttttttaaatagtatttgggttttttgtttttgtgtttttttgagacagagtttttctcttgttgtccaggctagagtgcaatggcgtgatcttggctcaccgcaacttaagcctcctgggttcaagcagttctcctgcctcagcctcccaagtagctgggattacaggcatgcaccactatgcctggctaattttgtatttttagtagaaacggggtttctccatgttggtcaggctggtctcaaactcctgacctcagatgatctgcccacctcggcctcccaaagtgctgggattacaggcatgagccactgcccccggcaatagcatttgctttaagatgaaatgttaagatggattccttctcagcccataggatcttctgattaaccatttcagggttttttttcccccatttttaatcctctcataaaaattttccccatttttagtcctctcataggaaatcttgagccattggaaagagctggttcacgttggtttcctgcttctcttaaatagtgtcataccaaagaaaatgcctgtttaaagtgaatttggttaccagtatagactttctcttgagaaaccaggaaggaaggatttttttcaccttagggaattaaaataaatttgtaatgttggtctcttgaagtgatagctttatagttttgttctaagtggtaggaaatattatctacagagattatggaaaaataatcttgtcctttaattgaacctcctagtggtctctatagttgaccctgcagttggtatcaggattttgaaccatgttttcattctgcatttatcttttctctgtatcattgatgcttttgacattaatatttgaattgagaagggggctggggcttttaccatctgggggtggatacaaggtctgtcataggttcacctaagacctgtcactactacttgcttctctgtatcaccctttaggtacttcctgcatagttgtttgttgcagtgttgttaaaatgagtgaaaattagtaaacttggtcttttaagactacagggccgggcgcagtggctcacgcctgtaatgccagcactttgggaggcccaggctggtgaatcacttcaggtcaggagtttgagaccagcctggtcaacatggtgaaaccctgtttctaataaaaacacaaaaaaaattagcccggcatggtggcatccgcctataatcccagctactctggaggctgaggcatgagaactgcttgaacctggggaggcggaggttgcagtgagctgagatcacgccactgcactccagcctgggcgacaagagtgtgagaccctgtctcaaaaaaaaagactggaaaaaaataactgtttccagatagtgtttttttattgtattattttggtggtgggttgtaagtttgaactaaatgaacaagataaagcattcttttattttattgtctgttgacttttaatctttccagaaggtgtctgccctgggatatagaagtaaaaatttatgtcgaatgtgataataatataagcaattgagccttgaaaatgtgctcaaaattcaagaggaatatttcttaatttctcttttgttttattttagcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagagtaagaaactttagtgcatctttactatatgtttaactgcagctaagtggttttagaatttgtttttaacctggctcttttacctgctttcctgtaggtgtctttaaatgtaaagacactttgaattttaggtgtctcatttgaggtctatttcaaaagaaccaagactttattgtacagttgaaggtgagcagactagagactagtttattaccctggggagtcaaatttataaaattatggagtgtagtttactatgtaatatattttaatgtggttagatattacactaattagaataatctgcattattttcctccacacagagggtgctaaaaacattgaagctttacaatatagactagtgggtctcatacaggattacatataatctaggctttatactaggtttattatatccttatacctaagaagtagaacctgggcatgttttaagctctctggttccttgtgttctttgatatggattgctctcattattcttgataatgttattcacaaaatgtgaataacttgaacatgcaacaattacatactttaacgcttggggtttgttgtgcttatctgctttgattcttcccccttacaccacaaagctccataggcagtgacaattaaaaatggataggtggagatcaatttcctgagcacgctggagatggagcatatgatagtcgaatgattgggcttcacctatctgttatctcctacttcccctgctcttcacatttaattcatagcagtttgggaattatgaattgaatgggagatttacgtttgcctgttttatccttcagtattcttagtttaaattaagtatgtgtcgtaagtcccttctttattaagcccatgaaacatgaaaaattatttttacccatcaaaacattaggaaatgaatgggctcctccctcttctcccaaaacttaaggccactagcatgattatagcgtacttcccatgtgcagtgtaacaggtaatgtaaaagacttttttttgttttgttttgagatggagtctcaccctgttgcccaggctggagtgcagtggcgtgatctcagctcactgcaacctctgccttccgagttgaggcgattttcctgcctcagcctcctgagtagctgggactacaggcgcctgccactatgcccggctaatttttgtattttagcagagaccgggtttcaccatgttggtcaggctgatcccaaactcctgacctcaagtgatccacctgccttggcctcccaaagtgctgggattacaggtgtgagccaccgtgccaggccaaagaagactttaatgaaaataatactacagagcagagacttttattgtcctctacccagtaatttgggtttactaatttggagtctcagggtagcaaattagaatatagggcctgggtgcagtggctcacacctgtaattccagcactttgggggtccaaggctggaggatcacttgacaccaggaattcaagaccagcctggccaacaaaatgagaccccttctctattaaaaaaaaaaaaaaagtgtgtgttttaagttagctgggcatggtggtgcatgcctgtagtcccagctacttgggctgaggtggaggatcgcttgagtcgggagttggaatcttcagtgagctatgattccactactgcactctcgtctgggcaacaaagcaagaccctgtctctggcggaggcaggctggggggtggggtaatgtagggaaggaggaaatgattagtatctgcagtacagaggactttttattcccccgggtgtctattaaaatagatctggataatggtgatgaatcatatttaattcaatcaccttttttttttttaataaactaaacacagtgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgtaagtataaaatattgcccaccagcttgtccttttgtaaaaggttgatggcttgatttcttttttgtttgtttgtttttttgagatggagtcttgctcttgtcgcccaggctggagtgcaatggcatgatcttggtcactgcaactgccgcctcctgggttcaagcgattctcctgcctgagcctcccaagtagctgggattataggtgcccaccaccacgcccagctaattttggtacttttagtagagatggggttttgccatgttggccaggctggtcttgaactcctgacctcatgatcctcccgcctcggcctcccaaagtgttgggattgtaggcatgagccaccacgcctggccttttttttttttttttttttttttttttttttttcctgggagacagagtctccctctgtcacccaggctggagtgtagtggtgcagtttcggctcactgcaacctccgcctccagagtagctgggattacaagcgtgtaccaccacacccagctggtttttgtatatttagtagagacggggtttcaccatgttggccagactgatctcaaactcctgacatcaggtgatccacccgcctcggcctcccagagtgctgggattacaggcgtgaaccaccacaccaagcccacctttgacgacttgcttttttaaaattcagatacttttataaaaggcctcttaatcgtattttaaatattttaatacttaggacaataaggatgggcgtggtttagcctactttgtgtaaatgtgcagtaagtgctcatgccacttaggttgtgctagtgcaatttttcttagtttcatggatttgatccctgatcagaccaattacctgtgatccaaggctagcaatcttaaatacaaacaatactaagattggattatcgaaagcctttgcactacagtaagaacaacgcaaatagaactttctgattatagtccatcaatggcattgaccaccgaaaagtacttgcatgtcatctttgtattgccaaacaataccttgattttgaagtctgtaatctttgataatagttaaacacttttcttggcatgaattgagacattcagttcattcactatacatgtgttttggtccagtctttgctttacttatgtctctgtggcgtcaggcaaatcaggtaacttcttacttacacccttgattgtaaaacagattatacttgtcttgcctactgacctagtgtggcaatttggggaaacatcttggtgctgaattaggttctaggctcaggcactaaacatgatttaaaacttgatcatttgaactagaagccaagtacaaccttcaagacaactctgtataaggtcataggtataatcactattttacagatgaggaaacgagattgactacaaatttggttttgaaaataaatcacatgctcaacagaagcagttttggccaggcacggtggctcgcacctataatcccagcaccttgggaaaccaaagcaggaacatcgcttgagcccaggagttggaggccagtttgggcaacatagtgagaccccatctctacaaagaaaaaaaaaagaatcagcaagacgtggtggacacctcctgtagtctcagctacttgggaggctgaggcagaaggattgcttgagcctgggagttcaaggtgcagtgagctgtgatcatgccagtgcactttggcctaggcaacggagcaagaccttgtctcaaaaaattattaaataataaatcaggcacaactttaacaacacttattgagtccttagcatgtgctatactgtgtgccaaattatttgcttttaatgtgctgtgaaatatctgtgcagtagatactaaaattctgttttattaacctaaaccacaaagaggttaattaacttgcccaaagccacacagctcgtaagtggggtaggtccatcattctcacccaggcagtgtgactccagagcttgtgacattgatgtaaaactctgacaggaataaaggatttattgatatcattggttctcaaactttttttggtctcagggcctctttatactctaaaaaaattattgaggatccccagagagcttttgtttatatgggttataattatcaatactaacagtagaaattaaaacaaatttctaaaatgacttttctaaaaaagctgagaagagtagcattttacatttttacagatattcaacatgtgtcttaaggcaattttacttaaacacatttgattgctgtggcggatcattttggtggaggtatatgaagacaatccaaagtcacaaatagatgaaaaaagggggccttacacaaccccctcccaaaaaggactctggaatccccagtgaatccgtagaccacattttgagagccactggtttatattaagtactttctagcgcagggggtccaatcttttggcagccctgggccacattaggagaattgtcgagggctacacataaaatagacttaataccaaccatagctgatgagctaaaaaaaaaaaaaaaaaaaatcgcaagaaagtttcaatgttttaagaaagtttacaaatttgtgttgggcctccaaagccatcctgggccacaggttacacaagtttgttctaacatttactatcatttagaatgattacagatagttggtatgagttttaacatttttaatatttcttaccgtttgtgttttgtttatgcttttaaaatgtgtcagtaattcagactaattcctggaagtcatttgaaatatattaactttcaagactttattattaccagaaataaagaggttagtttttctgtatgcccacacaactctgactttggtgtcattgaacgcagtaattttcttgactttttattctgaatgttttcagaaattttaagtattctacgttgagtatcaaactcaggtttttctgcttgtaaagttaatggaaatcagatgtttttaattaccaaatatgggttcttgctctagtcatttccatctcactattggaatgtttttatttaaaatacgccatgaaaacaatttaatactctgagtttgctgtatgaaaaaatgtcttctaaacaggctgacaaaccaagaggatttgccagaggtcttgatcctgaaagaataattggtgccacagacagcagtggagaattgatgtttctcatgaaatggtgagtatgcagagattgttacatttgaaagtaagagtagctttttttttttaatttgtgaaatggtttttcatcattaggtagggaaaaactatctgctgagaggatgattctggttacttttactagtagtgttttaaagcaagggtcagcaaactgtggcctgttttgaaaatgaagtttattagaacatagcaacaagtaacataactctcctggagcacttcaataccttttgtttggactattatttcttaaatgaatggctgtcggttgacatgaacaacttcgacttgtaactgaatttttctttttcttaaaacaggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattcctttatgcaa

SEQ ID NO: 35771 - DNA, 38392 bp, Homo sapiens
cgaccccggtgtggtgcgcaggcgcagtctgcgcagggactggcgggactgcgcggcggcaacagcagacatgtcgggggtccggggcctgtcgcggctgctgagcgctcggcgcctggcgctggccaaggcggtgagtccgtgccgcggaccggggcggggcaggcgggggccgaggcggcggtaggagcgggacggtccccagcgggtccgagcggagcgggcgccgggtccctgcgccctctgtcccgggatcgggaaggggctgagagagccctgggccggtgcgaggggaagccgcggggcggactcggggacccggggagctcggtccttagtagatagtccgcgtccgggtgaaggtcacaaccccgcgggcttgctgggcgtcccctccgccgccttggtccgggcctggggtcctgggaccccgcgggctgaggtagcccctcgcctcagtgcctggcaggtggactcggggaggagtcgtgtctgcccaaggtcacccgggcggatagcggccggtggccgccctggctgggctgggcctctgccgccctctgtgcgggttgtcctgaggagcagcccgcagcccgtgggtggggccggcggggcgggtgagaccgcccgggtgggtgcgaggagtggccgggctcggcccggtgggcgtccggtgggaagcgtggcgcgcccgagcttaggcttgcagttcgcctttccagaaagcgcaaatctgtccatgtccacttcgagaccttgtaagttaagggcttctactttgggtcgtgtttggtggtccttatgccaccaaaaatgtgccagtgtttaaaagcagctgtgccagtttttaaaactcaggcggagagctcagcgcactgaccgggcgaggacgccgggacctgtgcttgcctgtgcgctgagtgcctctagggccgggctcggcttagtccaggatggtggtcagggttatacttccctgagcccttgctctctgagtgtctgaatgtgccctctacgattgcatcttaagaatcggccttctagggttttatttaatcaagctaaattggataggtttagttgtttggttcttttaaatgaacttacccacccacctccttaattacaaagtaattttaaattgcagaataaaaatctcaataggaaccaaggcattcagcaatattgatttgaattatgcctgtaattgtgcaattttctcctttttgaaatacttattaaaaatctcgttgagttaaatgtgaggattagtcatacagccatcctgccaacatcagaaagcgtgtaaaccgttctagtgtgttgctgtggttggtactgactgagcagagacccctgccgcatcttgggcttttaagagctgctaggagggcgtccacaagcaggaaggaaagcccatggtcagtggggctttttaggggaaatggtagcttgtgattggagaaaagctagagctagtgcctttgtcctcaacccagatggtgcccggtgttccttctgcagactaagaccctgccagcggcggaggcacctcagacgggatggcaagatagcaaaattgaaccaaaatttagtcttgggttttgtaaaagtctttttatcttgatgaagttagcttttcctacagaaattctgcctgcaagcagcatatttatcggcatttcagataggctttttttcctgaagaattggagtttacgaaggaacagcataatcaaaaaattagcagaaaaaagaaagaaattcgtgatagccaactgagaaatgtgtttggaaaatagatgctgaggataatttcagtaaagtccagagagaattttttaacctcattttggccagttctgtggtgttttgatcattctgtatttacaactgctttcaagtgacgaacttatcagacttattttgcttttggtttctttttatggcccagtgcactgacacagcttgcaaactgttcgaaagcagtttaatcagaggaaaaagaaaaccaagaaacttcaatagttactggttaactgcttacttcaggtgaagtttttcaaatcccttaacatgaacatccaatatattgttctaggacaaattgatttcttttctttgaatggattgttctgaatatgtttaatggtgttctagaaatacattatttaggccattatagtagtaaacctttgctttgcttcttgggataattgtaacaacaatggcattccattctgcattcctcatgatgtttttcctgatttatttgaaaaattgtgacttgttttttgatatgaaacctggatattaatattagttgggagtctcagagatttttcccaagggtctttagataggggggcaagtccaggatccagagccaggccggccgacttgaatcctctctgagctccgtctttccgtggggttagtgaggattctgtgggtaatgtttgaaacctttggtgatgctcttgagaaccagggctcacagcctatgcacagtaaccatgtgtgaactgaatttttttttttttttgagacagagtctcactctgtcacccaggctggagtgcagtggcgcaatctcggctcactgcaagctctgcctcccgagttcacgccattctcctgcctcagcctcctgagtagctgggactacaggcacctgccatcatgcccggctaatttttttgtgtttttagtagagacggggtttcaccatgttagccagaatggtctccatctcctgacctcgtgatccgcccgcctcggtctcccaaagggctgggattacaggtgtgagccaccacgcccggccgaactgtattttaagtatccctgtttttaaaataataaacactaaaattctagtgagaataattacacgcagttgtaaaagaatcaatgagtataccctccctcacccagttcattttccatgaaagcaattcctgtttctgatactgactcctggcatttgtaatacctctgtttctttagcggatatgcaggtgcatttttatcagttttagacttcttgcctagagaggggatttagttcacttaaactaccctgcttccgcttcttcctgatacagtcgtgcgtttttaggttcttcgttggctgcttttgtgattgtgtaggttgtacatgcagattagtttcttgctcgtgatttataggtgcgttgtattagatgaggaccccttactttgctagatttcggatatgaatgtctctgcacttcttacttttcccctccacctcctaattcagtcatctgaaattctgtattgttaagcaaggtctaagtattccttttagttatatgttccccattttttttcttgaggaaatgtttgatagtttctcctaaaaaaattaacaattggcacaaaagactagttttgtgtcaaaactagttttgagttttatctaaagactgaaattggcttaaagttgggctttccaaattcaaaaatctgccccagattagatttagattgagagggttagtgtccttttcgccagggggatggcgtgataatttgttcaagattgtgttatagtagctgccccttttaagccagctctgtgtgtgtgtggtggggggtgggcagtgggtcttccacatcaacatcctagaaagaacgaataaacattgagtgatctcactgtttctacttacatttggtataatatactgttcttactggtgctattactatgttaatagggcactttacaacattttcaagaacatttgtattaaaattatttcaaagacttctttcttaaaatatgattttaccatgcaaaaattttactaaggtagaagaatatttgttctttctcattcattttctgaaaaaagaaaaaagctgaattagcttataccaataaaaacagagactagaaattggagaaatgaagaataattttttatcccacataataagtaatttctgaattgcaagtatttctaaatacttgaagacattcctcacatcccctcttctgattgcatttatttcctaaagcttttttttcttttcttttttttttttttggagacgttgtctctctctgttgccgaggccggagtgcagtggcacagtctaggctcactgcagcctctgccttctgggttcaagcgattctcctgcctcagcctcccaagtagctgggattacaggtgcccgccacgacgcccagctaattgttagtagagatggggttttgccatgttggccagactggtcttgaactcctgacttcaggtgatccacccaccttggcctccccaaatgctgggattacaggcatgagccaccgtgcccagcccctaaaactattcttgatgatatttctgagactattcagtggtcttctcaaatgtagccagcagaatggaaaacgtatcccctaaatggctggccaaccttagcatatggacagtgtcacctctctcacacagagccactaaaaactaaacaccaaaaccagttttcttgggtaaagttttctaagatggaaaatttaagcagcaagatgtgtcaagttgtagatgttggccaggaaaaagccagcagcagccaggcaggggagagtgtgcatccgacatcctcctgtgtgatgaagggatgacacctcgtccctctaggctgtcagcttttactgttccaggatacagatctcctgattcaatgttgagtgccttttgaactgaccacaagccctcctggacgattggaactgtaatgtggaaagggctatgatggagccagttaaaatgcttcattacttgcaaaataccacatacagtaatacaatatacacgtctttccccttctccactaagtagcatacattaagacttcacagaggaagtgtgcctttttcatttcgtatctgagtcagtgagtatcctgtttggaaacaagcttcatcctggttttctagagtgccaagtcagggtggaaacgaggacctgggggctcagtccttccttgccccttgggctgccttcagggttaagtagagggtcccagctgagctctctggatgcacaggagcacctgggtacataagaaggtgaacagtttgcaaggggaaattactatcccccacagcatttgttccttcaggacactaaccctctggatctgtgtcttctgtgtctccagtggccaacagtgttgcaaacaggaacccgaggttttcacttcactgttgatgggaacaagagggcatctgctaaagtttcagattccgtaagttcatgctttttgttccattataaatgatttttttggcttagggggtaaggatctataccagtttgttttcatatgagtcatagacataagggaaaaatttctcataggtatccaatgcatgctgaaattattttcagtgtaataatacttaattgcaagtacaaatataaacatagatgtttacatttttacttgtatctgttatgtatctataaactagatttaaatttagatcaagtaaagcaataaattaaaataaaatgaacagtgtctgctgtgatagatgataaaattcctactgaaaataggacggtggggccagtgaacagtatctgctgtgatagatgataaaatcctactgaaaataggatggtggggcccctcgggtgtgggttgctttgtatttagtgagcctatctctgttgaaaaactgaaacttgctgagaagttgttttcttataagcccacaatagcgactgaatactccttggcaccttctcaggcataagcataggcacggccctgaagtagagttgtggtcctcagtctgaccccatgggatagaccctctaccattcgtagaatctgattgtcagtcccttctccaggtgcgaatgtgcccacctctccccgaactgttcagggctcagccccaggacaggatggaggccctgtgtgcccagcagttgctccttttatctttgtcaagctctttcactgtcacaagattcttcatgtttggcatagtggaacatgtgattgacaggtgaatttttcttttccagatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacaggtaagagaaaggtgccccactgtgctcccactccgtgcaggtcccgcgcagcctcgcactttctacctgggcagccccctgcctcctccccctgctccagccacatggcctcttgctgtgccttactcagctcaccctctcaggggtctctccctggagcctcttccctggggactttgaagggcgggagacttgttgtcactcctaattcagactccagtcacacttgggttttctctgaccatcttgcctactaccttccccacctacccccgccaccccaacaccttaagaaaaggagatcacctaaagaggaggaatcagaatttaggttggggaagaaaagggcaagggtttcatttgtccctgtgcttctgtcttctgggactctctgaggggtaagacagtggtgggcacacacagccaaaggaagctggggtacaggggagtgcgactctgagtgtggagtttattacttggcaggaagcacttctagtctttaacacatgcccgtaaatgccattgggaagatttgttaataaaattatctggaaagatttgttgagtaccttttctgtgccagataggttaggttataagcatattacaggtagcctttcactcactgctccagtcagcccttcctggagttccctgtgtctccaccacgcagatgaggagactgaggctaaggatggaatcactgggcgagtcggggaggggttgtgatctggaatctgtcgggtctcgctgctcctctgctgaggtcagccctcactgggagtcactgtgtgagtagttggctttctctgaatccccccagcgggtggatttgggcctggaagacaaagttggcgctcctgtttgtggcttgtaaggagtggttggtgtttccagggaggaatcaatgctgctctggggaacatggaggaggacaactggaggtggcatttctacgacaccgtgaagggctccgactggctgggggaccaggatgccatccactacatgacggagcaggcccccgccgccgtggtcgaggtgatgggcgggaggctctgggtgttctcgtggtctgtttctagtacaaaagaatcctggaaaaaaatgtaagcaattgaggcggatgtggcagccaaaagaatggtgatgagcaaagttcacaagaagagtctttttccgttatgaactatgcattatatgtaacaagaaaacttctctttgatgaagtgttgacattttcataaaataggttactttgggtttgcagatttgtgttaaacttgtttagtgtagattagctgcgaatatcttgactcctttaaggtgttaaggtttttgtttgtttttatctttcacagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggaagggtaaggccgcccccgtccacctgagacaggacacgtagtgctggggcttatggtgacagtggggaatgggttagcgtgcccagtgagtcagccagagattacgtaaaaagcaacagagaacagcagcgtggggcgcatgcagcgactgtggatgtgacaggaccagacgtgtgccttgaggagctgtccctaaggcagtgtgtgacttcttgcatctatgtcagaaagttgaatcgataatcttacataccaggttttaacttgggatatgtgacactcaacatacaagagcagagcaagcaggccaggcacagtggctcaggtctgtaatcccagcactttaggaggccaaggcaggaggatcacttgagaccagaagtttgagaccagcctggacaacatagcaagaccctgtctctacaaaaagtttaaaaattagctgggcatggtggtacatgcttgtaatcccagttactcaggaggctgaggctcctggatcacttgagaccaggaggttgaggctacagtgagccatgttcgtaccactgcactccagcctgggcaacaggagaccctgtctcaaaaaaagagaaagaacaggctgggtgcggtggctcacgcctgtaatcccagcactttgtgaggcctaggcgggcagatcacaaggtcaggagtttgaggccatcttgcctaacactgtgaaaccccgtctctactaaaaatacaaaaaaattagccaggcatggtggcaggcacctgtagtcccagctgcttgggaggctgaggcaggagaatggcgtgaacccaggaggcggaacttgcagtgagccgagatcgcacccctgcactccagcctgggcaacagaatgagactccatctcaaaaaaaaaaaaaaaaaaagaacaagtattttaagtctcttttaccacctctgagttcctgaatggattggttttgtttgttttgttttgttttgtttttgagacggagtctcactctgtcacccaggctggagtgcagtagcacaatctcagctcactgctacttccacctcctggattcaagtgattctcctgcctcagcctcccgagtagctgggactacaggcgcacgccaccatgcctggctaattttttgtattttagtagagacagggtttcccatgttgcccaggctggtcccgaactcctgagctcaggcagtccacctgccttggcctccgaaagtgctgggattgcaggcgtgagccaccgcacccggccatggattgttttaatattaactgttaacactgaagaaagacttgaggtgacaatagttactgggtaatcagagtcaactttggcatggccaaataatattctgaacggtattgattcagagtaatcaatattctgaactttgttgttttctgatgcatggggacggatcgttaatttgcaggttgttagaacaccagtgacttctctgtggctgagtgcatcgacaagtgtgtggtgggaggagaccgcggctccatctggagcaggagctgtcatgtggggagctggcccaggcttacaagagcgacttgtgctggctgagggaacggcaggtccaggcgggcagcgctgtccggcgcctacctttctgcggtgccggaatctgctcgtctgcaaccgtccgctttggtagctgccagccacatggggctgttgctaatgtggcaggtgtagctgaagagctgaatgttttgacttattttaattaattaagtggttatgtgttgccagtagctcccatctgggctgtgactgcatggtctgcggacctcactctggcaccagactccgagtggagctgcatgcggccaccggacagtgtggagtgcctcttcgggttgtgtagaagtaggaaatgtgtcaccaaaataggagctgttgctgctgcgttctctagcacacctgccttgtctgtactgctcggcgtggaatgcctctcgggctctgacagtgtcactgacactgttgctgatctccttggatttacctggtccatttggatcaagttctttcacctattcacatgagcagataccaccttaaaaccttaaagtttggcttaacacttcttgccctttttttttcctttcttttagtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacagggtaggaatctcatttctactttattttgtttataaaaatgaataaatttcatttagagtttctttattttaatgaaaatagaggcattgtagaataacggtttagacacaggccttgatataaccatgtgagggtgatggcctttcccagccgtggttcctcacctgtaaagggtgaggacaggagcacctgcctcagggtgagaaagcatggtcctcagtagatggtagtggttgccctcaggttcacagcttacctctcccaatttagatgagggaactgtggcccaaagagtcaacatggggttttctggcaaaatctctcttgttttagtgggtactgtattgatactgattcctcgggtgggtaagtccttcttctccacatgatgaaaataagtaactttaattttatacactgtcagttactttaaccattttaaaagttaaaaagtgtcagtacagccaaacaaaaaatcagcaaaactacaggttgggaagaaatattttccaaaccatatgtgtaataatatcttactatctaaaatagcaaaaaaaaaaccctactaaaaacaacctactaaaccctactaaaaaacaaccctactaaaaatgggcaaaggacttgaatagatatttttctagagaagacatacaaatggccaattgatgtatgaaaaaatgctcaacgtcactaagcaccagagaaatgcaaattaaaaccccaatgagatatcatctcatctcgctccagttagaatgactgttaccaagaggacaaaagagcaagtgttggtgaggatgtggagaaaagggaaccctgtgtgctgttggtgggaatgtaaattagtacaactattacggaaaactctggaggttcctcaaaattcataggactactatgtgctccagcaaccccatttctgggtgtatatccaaagggcatgaaatcagaagctcaaagagacacctggaccctatgttcattgcagcattattcacaatacccgagatatggaaacaacctaaatatgtgttggtgtttaatgacaatgtggtgtgtatacacaactgaatattattcggctatgaaaatgaaggaaatcctgtcatgtgtgacaacgtggatgaacccaaagtcattatgttaagtgaaacgagccaggcacagaaagacagatactgcatgtcactcatgtggaatctaaaacagtcacaactcacagaaacagagtaggacagtggttgccaggggctgggggaatgcagactgtggcgatgctgattaaaggtgtaacttcccgttacaaggtgaagttctgaaggtctaatatacaacatggtggctatagttaacattatacagcatggtggccagagttaacattatacagcatggtggctatagttaacattatacagcatggtggttagagttaacattatacagcatggtggctagagttaacattatacagcatggtggctagagttaacattatacagcatgctggctatcgttaacattatacagcatggtggccagagttaacattatacagcatggtggccagagttaacattatacagcacggtggctagagttaatatacagcatggtggctatcgttaatattatacagcatggtggctagagttaacattatacagcatggtggctagagttaatattatacagcatggtggctatcgttaatattataacttgaaatttgcgaagatagtagacgttaggcgtctgtatctccaaaaaaaggataattgtatgaggtgatagatgtgtattaacttgattgtgtcatcatttcacaaaataaatcatcacgctgtacaccataaatatatagttttttttttaaattcatcaatcatacctcagtaaatctgggggagaaaaaaatccataaaaattttaaaattttcattataaaagtagtatatgcttattggggaaaccttttgaacagcacaaagctaaaatacaaatagggccaggtgtgcagtggctcacgcctgtaatcccggcactttgggaggccaaagtgggaggatcacttgaggtcaggagttcgagaccagcctggccaacatggtgaaaccccatctctactaaaaatacaaaaattaactgggcgtggtggtgcacactgtaatcccagctactcgggaggctgaggcggaagaatcacttgaacctgggagccggaggttgctgtgagccgagatcgcaccactctactccagcctggtcaacagagttagatcctatctcaaaataaataaataaaatacaaatggaagtcctttctttgatcccaggcttctatcctacctgtgcagggtagcagcaccagtggcgcggcccctagtgatatgtgtggggtgtgcgtgagtagggggttgtgtgtgcacagcactgagaagacggtgctgggggctgccgtgtccattctgtgatctcaccagataggaggtccagatgtgggccgctgtgtgcagtcactgctctctattgtttccagaggctacgggcgcacctacttcagctgcacgtctgcccacaccagcactggcgacggcacggccatgatcaccagggcaggccttccttgccaggacctagagtttgttcagttccaccctacaggtagggcaggacgccttgcccggcaggtgtttggcttgtgtgtgtcttgtaagcatgtgatgcctactcattgctcttccatagttttatgtaataacatggttttgaagatcagcttcctcagctctcaggtcctaacttcaacgtcatttacctaaggagacttttcccacactccccttcccctaaggcagtttgggccaccgtcttatgtatttctcaagagcgctaaaccctgccttggtgatacttaagccagcagtaaagcagggattgaggccgagcacagtggctcactcctgtagtcccagcactttaggaggccaaggcgggcggatcacctgaggtcaggagttcgagaccagcctgaccaacatggtgacacctcgtctctactaaaaatacaaaaatcagctgggcgtgatggcgtgtacctgtaatcccaggtacttgggaggctgaggtgggaggaatgcttgaacctgggaggcagaggttgcagtgagccgagatcgcgccactgcactccagcctgggcaacagagtaagactccgtctcaaaaaaaaaaaaaaaaaaagtaaagcagggattgttcagtgtccctcttcgcaacgaggtcgtcagctcctcgggcaggcaggtcttctcgttagctgtggtgctccatgcccagcacatggtagggtctccaccggggtttactgagtgaacattctgagagctgggagaatgccatggaaccgagaagcagcacaggcagacttcagctttgtaggagaacacggagcttctgtgacaatgggatgtaaagttaggacgcagccgtgacagaaccccatgtgacattgggcgctgggctcagcccacgtgaccactgagagagcttgtcgtggggaagatgagctcgtcttggggacgtctgacggttgaggttacgaatgtgcaattcggagacattaactcagaaatgacagttgaagtcttgagtttggaggaggttcttcagaatgagtcagagacagacacacacctgcctcttgtttgaggtgacttgtcctatacttttctgggttgcttttctgacctgtggacgatggagacctctgaagtggtgccaaagaaccagacctgtgtcttctctttctctgtcagtgtcagctttctgatccctggaagggatgaaaataagaaatgaatttgttgtagtgttttttttttatttgtttcgagatggggtcttgctctgttgctcaggctggagtgcagtggagcaatcttgactcactgcagcctttgtctcccaggctcaaacgatccttccacctcagcctcccaaacagctgggactacaggcatgtgttaccatgcccagctaattttcgagggttttttcgtttttggtagagacgggatgtcaccgttttgcccaggctggtctcaaactccagggcttaggccatcctcctgcctcggcccctcagggtcctgggattatagccatgagccactgcacccggcctgttgtattttttattactgtttttaatgaataaaatgtcactgagcccctgaattccctctgtaatttgcttagagctccactgctcatgctttgtcttcagtatgtgagaagtaaccacagaaaaaagagcattgaaacttagaaaatcaaaagacagacaagaatcacattcgttttttaaaagcaagattgccctttttgtatactaataaaaattgtagctttcgaaatacatttagtttagggtttttgatctcctttgttaaaattcgagagcttggcatgccctgtttctcatcgcactgaggagtcacagagccgctgtttggagcacagaccgccggactacccaggtttgggtttgagctctgtcctcagctgcatgactggatgttaccaagtgttaatttgcttgtcactgagaaagggggtcgtactacccagagttgttgtaagacttaaacgagttaatatgtggaaagcagctagaactgcccatagcaagtgcagtgtaaatattatctaaaataatcattattactgtccttgtcactgtttggataatttagatatgaatacttcaagctagtattcttaactagtcaccacagtatcatagtgcaaaagaatgttcaaaaattaaaacaaaatttgaggcatccaacgtacactgggctgtaatcagagtattggccagaggtctgtgggccggcctttctcctctctggggacaccgctctgccccagcctctgctgcagctgtcagccttgtcagtgctttttgttatccagactttctactgtatcttaactgtcttgctgtgcagttttgcacataatgccttctgcttatctttttcctctttcccccaaaaaatgtcttgaaaaaaataatgcatttgaaatagagatctagcaattgttaggtaataaatatgtgtggttttttgcaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaaggtgcgtgtgatttaccaccagcactgtctgagcgggcacacgggccggggttgcttctgtgagtttcagcaccgctcgccctcaccttcgtgtgcaggcgcatgtgcacagccacctctcttagctgctggcaggcgtctgttagtctgcgatattttcctaaagacctacattttgaaaattttagccagtttctttctcaaatctgtggaacagagtttctcttagtgtgtgtgagtatgtgacggagtatgggagagagagacacacacccaacctgaagtcggcatgtgagccttgggtgttgtgtctgatacccacagatgttttttggcagctttcaaagtgtgtgggttatttggctttcagtaaaacagtttgcagctctttcattgcctgaccctgttctttaatgtaatgacatttgctaaatatctgctggtatggcctttagaggttttacatttttatattaaaaaaacagagaagtcaggtggggcgcagtggctcacgcctgtaatcccagcactttgggaggctgaagcgggcagatcaggaggtcaggagatcgagaccatcctggctaacacggtgaaaccccgtctctactaaaaatacaaaaaattagccgggcgtgatggcaggtgcctgtagtcccagctactcgggaggctgaggcaggagaatggcgtgaacctgggaggcggagcttgcagtgagctgagatcacaccactgcactccagcctgggcgacagagcaacactctgtctcaaaaaaaaaaaaaaaaaaaaaaaaaacagagaagtcaaatggttttttggaatatggtggccctccgtacccattggttccacatgtgtggtttcagccaactatgtattgaaaataaaattgcatccttacaaatatgcagactttttttccttgtcattgttcccttaacaatacagtgtaacagctatttacgtagcatttacattgtattaggtactatgagtcatcctggagttgctgtaaaacttaaacgtaaaacttgaaatgaggatgatttaaagtatagaggaggatgtgcataggttatatgcaaatactctcccattttatattagggacttgagcatccacggattttggtatccgtgggggtcctggacccaacctgccacggatacgcagggacgactgtatttggcatagaggcctttctaatgcacttaccaaggacacctgcagcaggctgtgatccctgagacgagcgtgagtttagtgagggcagagtttttgttctggttctcagctgtgtcccagcacctgggattgtccctggcacacagtagctgcttagaaaagatttgatgagagggtgaccatacatgaggggaaattttcctcagtatcaaaacatgttgaaactcacacacttccaagatgacgtattctcaggtctcctgccgttgccgttctctgccgtatgtgatggtgttctgtcttaccagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtgatggtgctggctcctcccccacagctggaaagaaggctgggacgacggggcccacctcgcagttgtctctttagatcttacaggaaaagatagatgtttccttcaagaaagtactgtattgttttctagattgcactttaaatttctattaccggaggatggagggggcttaataatttattcctccttagtaaattgtcagagatacatcatttgcagctttttccattttgtaattactttcctatatgatcttgtgttatttctaatgatcttacacatcaagggatctttataattcattcctttgagtggtttgtggttcacacagagcttgtcagtcacttaggctccttgttgggcgaggtgggtggaagctgttgctctccctgcgtagacgaagaggtgaacggggtagaacagtctggaacatcagtctcccctgctgatgttcctccacctgccgtgctcctgggtctgagccggagcacaggtggtgagggccccgggaacatgggacacgggggacagtcgcagatgctgacattggaggtcctctgacctgcttgtaacagcaggtgctcaggggcagaggggaaactgggggataccttcggaagcttccctctgaagaagagtagctatggtccttacttccctcttagatacggtctttacttccctctctttttttttcttggagatgcagtctcactctgttgcttcggctggagagcagtggtgcgatctcagctcactgcaacctctgcctcccaggttcaagtgatttttccgcctcagcctccctagtagctgggattacaggcacccgccattatgccccgctaatttttgtatttttagtagagatggggtttcaccgtgttagccagacaggtcttgaacccctgacctcaggtgatcacccacctcagcctcccaaagtgctgagattacaggcgtgagccaccacgcctggcctacttccctctctctgacctgcagcacagacaccctgttggggaaggtgggctggtggaggcatgggcaccttgacatttcacctgaaatcttcctttccacaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggtaagtgttttcttcaggagccagactatttgagaaggcgcaggacgttagaaagtcttttttcttttttttgagaaagggtcagcccaggctggagtgcagtggcacagtcatagcagcctcaacctcccgggctcaagcagtcttcaacacctcaaccttcagagtcccaagtagctgggactacagatgtgcaccaccacacctggctaatttttaaaaaaatttattttgtagagacagggtctcacaatattgcccaggctggtcttgaactcctagactcaaacagtcctgcctcagcttcccaaagtatcgggattacaggcatgagccactgcacccagccaggttacaaagccttgatttcttactggaaatttgcttagtgatcatatagaggtagtctgggtttttcccccagaagtgattaaactgagaaatccagaaattatatggtggtaatgttgagactagatagaggctggttggggatcttaacagttaaggtgacatttttggggttacatttttttttaattattttgcagtcattatgttctgtttagaaaaagcactattagaaagttgttatttttaggggaatcattacatattacttgcctgataaaaatcacttatttgcaatgaaatattttaagtagttggcatgaatgaatatgtaacttcttggtacttagaaaagtaatttaggccattctagaaacaaagtacagctagcctctattagaggagaagggatgacttacagtgaacaggattcccaccctttacggacagattggatttcacttgctggttttcttttcatgatagcatcaaataatgtgcagtaaaggaaataccatgtgtgggagtgtgagtcttacgtgcactaagaacggggcagttagcatctctcccacctccagacatcctcacggtggttatccagcctcgtgtgctcagaacagtgtgaggtggatgaggcactggtggatgtttgcgtggcaaggatggtgggaccccaggcccatgttcttcccgttacctttctctggtgttaactgttagcatcatttctgctgtttttatacaacaggtgctttttgtatggattcaagtgaaataaaaactagcacggctgtaacttataaacgtgcccccttttgtatctgtagttagaaaggtgcagatagtattaaaagggtagcttacttcagacactctgtctctggatctgaccaccgctcgggaggccagcacacgcagagctggcgtctcatccccagccattggtgatcatcggcgaaggcggagttcaggtccatcgttcctgacgccgcaggtagtgcttgtctcactccatagccctgcactttgtcgcagtgaggactgataccacttctctcagagcaatgtagaaattttgagctgctctttctttgaaaatgcaaaaaagaacattttgtaagaataccctatactttacatctgagaaaccgcccacgcatgcagcatctcacgcagaatgctgtggagtcagactcaaaaggctgcatgcctgtggttctgttgatacgacattctggaaaaggcacatctagggaagacaagggattggtggttgccagaggctgcttcctgattgtgctgagacttacagacacaactctgtgtgtgtcaaaatttgaaaaaccctacactaaaaatgatgagtttattttactgtatctttatgctttaattttcaaaaatgaaaaggaaagaaaaaatgcttgtagcatcactattctcccccaaaaccccctgcaaaaaaaaatacatatatatacacatatatatgtattttttttttttaagagatagtctccctctgtcgcccaggctgtagtgcagtggtacgatcaggtgcacaccaccacacctggctaatttttaaaaatgttttgtagggacagggtctccctgtgttgcccaggatgggcttgaactcctggcctcaagtgttcctcctgtctcagcctcccgaagtggttacatgcgcctatacatgtgttaaaattggtagaactgaggctgggtgcagtggctcacgcctataatcccaccgctttgggaggccgaggcaggcagattgcttgagctcaggagttcgagaccagcttgggcaacgtggtgaaaccccgtctctaccaaaaatacaaaaattagctgggcatggtggctcacacctatgtagtcccagctacttgggaggctgaggttggaggattgctggagcctggaaggcagaggttgcagtgagccaagatcacaccactgtactccagcctgggcaagagagggaggagacactgtctcaaaaaaaagaaaaagtaaattgtagaactgtccacctaaagaaaaaagtcaattttactgaatgatcaatttttaaagcattattatcaaaaggaagagaaacaccagcgagcctagaagcatttgagcagaccctcaagagacccatagcctggtcctgtggagaggtggtgggcggggtggggcctgtttgactcctgcatttcatacatcctacctcctgcatgtattacctgttgaagaaaatatatataacgttataaaaaaaacttaaaaacttttttcaagacatcgtagaaacacaagagttgcaaatcttggctgtgcgcagtggctcacacgtgatcccagcactttgggaagccaaggcaggtggctcacctgaggtcaggagttctagactggccaacatggtgaaacccatttctactgaaaatacaaaaaattagccaggtatggtggcatattcctgtagtcccagctactctggaggctgaggcaggaggcttgcttgaacccggagatggaggttgcagtgagccgagatggtgccactgactgcactccaacctgggctacagaacaaaattccatctcaaaaaaaaaaaaattgctaatcttgaagtatagttgagagcacataagagtccaaatcaacaggtgactttcaagcacacagcagccaccttccccccgctgatgtgaagggtggccggccccttgggaccaccatctggaaggtgtctcttttttcccttagtggagtgacatttatatacacttaatatatataaatttgtatacatttaattttttttttttttaagacagggtctcgctctgttgcccaggctggagtgcagtggcgcgatctcggctcactgcaacctccacctttagggttcaagcagttctcatgcctcagcctcccgagtagctgggattatagacgcgtgccaccatacccagataatttttgtgtttttagtgaaacgaggttttgccatgttggccaggctgctcttgaattcctgacctcaagtgatccacctaccttggcctcgtaaagtgctgggattacaggcgtgagccaccgcacccggcctacatttaattttttaattttagagatgatttctagtttattcactctaagatcacttaatggatatctactgtgtgccaacaattttgcctttatgttctttaaaattggccccaactcaacagatggcctcagctgtagggtgggctggcagtgtgttagctcaggagacttacagagtttccaagctccttgagtggctgtgctacatgtttgtgtgtcattctaaatccatttggttttttaaaacggttttcaaaagttaaattctagcttttttttgttttaggagataaagtccctccaattaaaccaaacgctggggaagaatctgtcatgaatcttgacaaattgagatttgctgatggaagcataagaacatcggaactgcgactcagcatgcagaaggtaagagcctggactcgctctggagtgagcaggagggctgcatacctggccctgcactggttttgttttttaaaaactagatctagggggatgcaggtgcagttttgtgtggatgtactgggaggtggtggagtctgggcttttcatgtacccgtcacacaagtcgtgtgtgttgtacccagtaggtaattgttcaaccccacccctcccgctttttggagctcccagtctctgctactccactccatgtgtccatgtgtactcaccattcagcttccacttccaagtgagaatgtgtgacacttgaccttctgagtcacttcacttaggatagtgacctcctgttccatccgtgtggctgcagaagacatgattgcgttctttttttatggccgagtagtatttcatggtatatatgtaccacattttcttcatctggtcatccgttgatgggcacttaggttgattccatgactttgctgttgtgactagtgctgcgataaatacataaggctgcaccagtatctggaggtaaacagcggtaggacgtactcctcaccgtatcaagaatatgaaagagaccaggaggcctgaactatacagaagtgcacttcttttccacatagaaggtcggcagactagggcagaattagtgactgcttggcatccaggacagccttctgtggttcactcgtgtgtgcttgggtgtgacctccgtgacctgaccattgctggctgtcatggatgagtcacagcgtggaggagagggaactgcaggaccgctggagaagctcagtccccagcagggcagctttctcttagaggtttcctggagttcaacacaacactggtgcttacatctcaggcccggatatcgatcatgtcatcatgcctggcttccagcagctcggaaatgtctttaagctggacttgttgctgcctctaaatatactcggaagagagggagagtgggcggcaggtggaaactgatctgtggcctgtgctgctgggagtcggtccagtaggaccatctgtgatgatggaaatgttccgagtgtttgccatccagtatggcagccattagccatggggccgtggagaacctgatacatggtcagtctaagaaactgaattcctctaataacaaggattcttgtccatgaatgagatctcttgcctactatttgcaagaatttctgtgtattttctaaaaagtccattgctttagtcctattctgaaataggtgtctaacacctatgtggtgttagacacaggagaacaggttccctgctgacattttcagaggcctgtgcccttcagtcttcaagtgaagctgggcttcagggaggctttgtggaatggtgagaagaacagtgtgactaaggcacagaaggctgagtgatgccctgcagtactattgtagggttggaggccagctgggaaagaaagaaccattgcattagagaatgggaacatgccttcggatatagaaatggcaaatccatgagatagtttaaagtgagaatactagaagcattcccaccaaacatggtgtgtcttggtgcctgctgtatcccaggctccacgagatgctggagtcagcactgaacaaacagagtttcctctgctcgtggaaatgcgttccgttggggaagggatttttctgctgagtctggctattcatagtaagaagcaaaaaaaagaaatgaggtaaatttttgggaacaggcccccaaatgtggcccaaaactgaccataaacaaaatctctgcagcactgtgacatgctcttgatggccatgacgcccacgctagaaggctgttggtttaccagaatgagggcaagggacacctggcccacccagggtggaaaaccgcttaaggcattcttaaaccacaaacaatagcatgagcgatctgtgccttaaggacatgttcctgctgcagataactagccagagcccatacctttgtttcccgtaaggaatacttttagtaaatcttatgactggcttgctctcaataaatatgtgggtaaatctctgttcaaggctctcaactctgaaggctgtgagacccctgatttcccactccacacactatatttctgtgtgtgtgtctttaattcctctagcgccgctgggttagggtctccatgaccgagctggtctcggcaaatggcgcccatatatgggggctcgaatctaggtcgaagggtcaccggagcgatggagaacatggaactaagctggaggacacctgagtactcttacgcagtccctgtggtgagtaagacgggtagctcagaagcatcagggtaacaatgggacacgtgtgggctctggttcgttccaccttggaaccttttcatgctaataataagggggaaggagagtataacgaagtaacagaagaaattacagagcaggtttgtttgccaactaaagctaaagcggcaaaggagggagaggttcatccctacccttctgcaccccctccttattttgaagaaaaagagtggcctgaccctccagatctttcttttccagaggacagtgggcgaaaagtagttgctccagtgactgtccgagcagcaccttgagcgacccctctcagttctattcaggcaggaattcagcaagctagatgagagggtgatttagaggcttggcagttccctgttagaatacaccctgcagatcaacagggaaatattacagctacatttgagccttttccctttaaattacttaaggagtttaaacacgctatcaatcagtatggaccaggttctccttttgtaacaggactgttaaagaatgttgttgtttccagtcggatgattcctactgacttggacgctcttacttgagcttgtctaactcctgctcagttcttacaatttaaaacttggtgggcagttgtagcttccattcagcctacttgcagcgcccaggcccaacctcaaattaatataactgcagaccagcttttgggggtcggcagctgggctggtttagatgcacaagtggtcgtgcaggatgatgccgtagaacagcttagaggagtgtgcattagagcttgggaaaaaatcacttcaggtagagaacaatacccttcctttagtgcagtaaaacagggaccaaaagaaccgtacgctgattttatagctcggttacaggagtctcttaaaaaggtgatcgcagattcggctgctcaggatatagtgctgcagttatcagctttcgacaatgctaatcccgattgccaggctgctctgtgacctatcagagggaaagcacacttagttgattatatcaaggcctgtgatggtatcagaggtactctgcataaagcgactttgttggcacaagctatggcaggactgaaagtgagtaaaggaaatactccgtttcctggaggttgttttaactgtgggaagcatggtcatactaaaaaagaatgtagaaaaaaatcagtgagtgagggtgccagatgggggaagaaagaaaactgctaagcctgaaatatgtccaaaatgtaaaaaaggaaaactttgggctaatcagtgtcactctaagtttgataaagatgggaaccccattttgggaaatgccatgaggggcccgtcctgggtcccgttccaaaccggggcatttccggctcaggccactccctcacccctgtacaatgtctgttccccgccacagccggtagtgccacagtagatttatgctgcacagtagctgtgagtcttctgcttggggaacccccaccaaaggtcccagcaggagtctgtggacccttgcaagcagggacgataggattactcctaggcaggtctagtttaagtttaaaagggtacaaatacatagaggagtcattgattcagattacaatgaggaaattcaaattgttacatctacttctgttccctggaaagcagagccaggagagtgcatagcacagctcctgattgtgccatatgtggaaatggggaaaagtgaaattaaatgaacaaaaggatatggaagcacagataaacaaggcaaagcagcctattgggtgaatcaaattactgataaacgtcctacctgtgaaataactattcagggaaagaaatttaaaggtttggtagatgcaggagcggacatttcaatcatttctctacagcactggccgtctgtgtggccaattcaacctgctcaatttaacatagttggagttggtaaagcccctgaagtatatcaaagtagttatatttccattgtgaagggcccaatggacaacctgggactattcaatgataacttctgtacctataaatttatggggaagagatttattacaacgatggggagcacaagttctaattccagagcaattatatagccctcaaagtcaacatatgcatgaaatggggtatgtccctggtatgggactaggaaaaaatttgcagggtttgaaagaagtgcttcaagtggaaagacaaaagttcctgccaaggtttaggatattatttttgatggcggccattgttaagcttccagaacctatacctttaaaatggttaacatataagccaatttggatagaacaatggccactgagtaaagagaaactggaggctttagaggacttagttaatgaacaattagaaaagggacacatagctccaacattttccccttgtaattctttggttttcttaattaagaaaaaatcaggtaaatggagaatgttaactgacttaagagccattaattcagttatacaacctacggggacattacagccaggattgccttctcctgctatgattccaaaaaattggcctttaatagtcatagatttaaaagactgtttctttactatccccttagctgagcaagactgtgaacggtttgcatttacaattcgtgcagtaaacaacctgcagcctgctaagcgttttcattggaaagtgttgcgacaaggcatgttaaacagtccaacgatttgccagacttgtgtagggcaagcaattgaacctactcataaaacattttcacagtgttacattattcattatatggatgatatactttgtgctgcccctactcgagaaatattactccaatgttatgatcatttgcaaaattcaatttctggtgctggtttaattatagctcctaacaaaatccagattactactctttactcctacttgggaaccttagtaaatgacattaccattgtgctacagaaagtagccatacgtagggatcaattgaaaacattaaatgagactttcaaaaattactggggacattaactggatacaccctgctctaggcattcctacctatgccatgagtaatctattttctatccttagaggagatcctagtctcactagccctcggcttcctacctatgccatgagtaatctattttctatccttagaggagatcctagtctcactagccctcggctatgccatgagtaatctattttctatccttagaggagatcctggtctcactagccctcagcaattaacaaaagaaactaagggagtgcctcagctgatcgaaaagcaagtccataaagcccaaataaatagaacagatccagagaagactcgagctgcagctgatcgaaaagcaaggccataaagcccaaataaatggaacagatccagaaaagactcaagctgcagccgatcgaaaagcaaggccataaagcccaaataaatagaatcaatgcagagaagactcaagctgcagctgatcgaaaagcaaggccataaagcccaagtaaatagaatcgatccagagaagactcgagctgcagctgatcgaaaagcaaggccataaagcccaagtaaatagaatcgatccagagaagacttgagctgcagctgatcgaaacgcaaggccgtaaagcccaaatcaatagaatcgatccagagaagactcgagctgcggctgatcaaaaagcaaggccgtaaagctcaaatcaatagaatagatccagagaagacttgagctgcagctgatcgaaaagcaaggccataaagcccaagtaaatagaatagttccagagaaggctctagatttgctaatttttccaactccacattcacctactggtgttattgttcaagagcaagattttgtagaatggctttttcttccacatactaattcatggactctagagaaggctctagatttgctaatttttccaactccacattcagctactggtgttattgttcaagagcaagatcttgtagaatggctttttcttccacatactaattcatggactctaactccttatttggatcaaattgctactatgataggaaatgggagaacttggattgttaaattacatggatatgatcctgaaaaaattgtccctctcacgaaggcacaaatacagcaagattttttaaatagtcttacttggcaaacccatttagctgactttgtgggtattcttgatattttcctaaaatgaaactgtttcaatttttgaaattaactaattggattctccctaaaataactaaatttaaaccaaatgaagatgcagagaatgtttttacagatgggtctagtaatggtaaagcttcttactctggctcgaaaggtaaagttttctagacaccctatgcttcagctcaaaaagtggagcttgtagctgtaattgaggtattgactgcttttaatatgcttattaatgtgatttctggttcttcatacatggttcattccacacaattaattgaaaatgctgagttacgatttcatacagatgaacaactgatgactttatttatgcaattgcaaacagcagttaggagtagaatgcaccctttttacatcactcacattagggctcatacacctcttccaggacctttgactgcagggaatcaaatggctgatcgcctagttgctactgcaatatctaatgctagacactttcacaatttaacccgtgttaatgcctctggtctcaaacgcagatacagcagtacccggaaagaagctaaagctattatccagcgatgcccaacttgccaaatggtacattcctcatcttttacaggaggagttaatcctcgaagattggaacctaattctctttgggaaatggatgtcacacatgttccctcgtttgggagactagcttatgtacatgcatgtgtggacaccttttcactttgggctgcatgccaatcaggagagtcttctgcctacgttaaacgtcaccttttgcagtgttttgtggtaattggcattctagcttctattaaaacagataacgccccaggctatactagccaagctctagctacatttttctctatacggaatattaaacacattactggtatcccttataattctcaaggacaagccatagtggaaagaatgaatctttccctgaaacagcagctgcaaaagtaaaagggggaaaacagggactacgggacaccccatatgcaattgaatcgcattatttaaattttttgagcctgcctaaaggccagatcttatcagcagctgaacagcatctacagaaaccagctgcaaagacagaagcagaacaactggtttggtggagagacctgataataaaaagttgggaaataggtaaaataataacttggggtagaggttatgcttatgtttctccaggacggaaccatcaagacacctgaaaccttatgagctgacactgaggaagagattctgggaggatcccgaggacccctcggttgcagccatgtcaagactgatgctgaggaggaccccaactgtcatgagcaacacccgtcgaacacagccacccacctgaggtcagatcaagaagctgtcacagatggcagaagaaaacctgaggaaagcgggacaaccagtcacaatgagtaatttaatggtagctgtgatagcagtgatcaccattgccatgagtattccttcaacaagggctgacacagagaacaattatacttattgggcatatttatcaatcttggctggcaagaatgcctggatgtaatcactctatgatgcagttacacatgctttctgatctcagtatttaccatgataaatctgcttctataattgaggcataccgccctcaaaaacctatctgtaaacaggattggacccagtcagagaaaatgaacgtacatgtttgggaagattgcattgcagaacaggcaggggtgctggcaacgattcctatggaatcattattgattgatctcctaaggggatgtttagcttgaattgcacctctctgtctgcgtgccacggccacactatgttcagctggtctgaacaaaattgtcagatggtagaaatgataagaaatacggcaagggttcctattatctggaaccatggcggtgtagtggcacctcaacctcaaatggtatggccctttgtaggagctaaacataaggatttgtggaaactgttaatagctcttaataagatcaaaatttgggaaagaataaaaaagcatctagaaggacaccgtacaaacttgtctttggatattgcaaaattgaaagaacagatatttgaagcatcccagcacacctgaccttaatgccaggaactggagtgcttgaaggagctgcagacagattagcagctggtaatccattaaaatggataaaaacacttggaagctctgtgatttcaatgaagattgtgcttttaatctgtgttatttgtatagtctgcagatgtggatcctgactctgcaagaagtagctcaccgtaacaaagctgcctttgcttttatcactttgcaaaacaaataaaggggacacgttgggaacaggccccccaatgtggccataaactgtccccaaaactggccataaacaaaatctctgcagcactctgacatgctcttgatggccatgatgcccacgctggaaggttgtcggtttactggaatgagggcaagggacacctggcccacccagggtggaaaaccgtttaaggcattcttaaaccacaaacaatagcatgagcgatctgtgccttaaggacattttcctgctgcagataactagccagagcccatccttttgtttcccgtaaggaatacttttagtaaatcttatcactggcttgctgtcaataaatatgtgggtaaatctctgttcaaggctctcagctctgaaggctgtaagacccctgatttcccacttcacatgctgtatttctgtgtgtgtgtctttaattcctccagcaccgctgggttagggtctccacaaccgagctggtctcagcagtaaatattgaaaaggaatagatacaattgtcattatttacagatagaatttccaaacaattcccagggaataaactgaaaaactaacagaaacaaaacaagaatgtagtaaggtgtctggataagagatttgtatctaaaaatcagtagctttacaatgtgccagcagtagtctgctcagacatcagtaaatatctcattcacatttcaaaaaaaattgaaaatgccctgaaataatgtaaccagaaatacgaaaaaaaggatatgaaaacatgtggctgctaatggacatgaaagaatgtaatactagattctgagatgcaatgtttttcatttgttcttcctgaaaaaccattaggttgatgtgcattacagtgttacgattatgtatgagtctaaggaaaatcagatgaaatgtccaaattaaaccatgaaggtgcattggtagaggaagagaaaattagggtcagtggagcaaagcacagttagagggagaagcaaggaggaggagggatcactgaggtggtgcctgtcccacaggaagcaaaagctgacgcctagttcccagcatacctacagtaaacttcaggtccactgcatagcacgtctctcatcacagtaaaactatgaaggaactcagtgtacaaggagcttctacaagataggcagaagacagtagccagatgggccaagggccccagccacccacgcccctccctctccttgaagacgtgcagctccaacaccaccatcaccagggctctgctcagctcctcctagtgtgtatcaccacagggctgctggcttgtgtcacgttcaccaccagaccccgcgtcaggagtcccgccaggggtgtggagaggcagcgctgcctggttggccgtggagctgtatggaacatggtgcctcacaggcagtctgcttggagtcctggaccctggctgtatcctgctggaaaggatgtgtgtgggtctaagatgtgtatgtaatagaaacatttatttattcagaagctttagtcaaaacttcatttttaagtttggagtaataaactcatagtctgaatttcctaatttttctgtttaatttatgtaacttttaagtgaaatgcaaaacaacaggtctaaaagttaagcagttcttggtatggctgcttctatggattaaaagtttacaaataatattttgtgccacagtcaatgcaaaatcatgctgccgtgttccgtgtgggaagcgtgttgcaagaaggttgtgggaaaatcagcaagctctatggagacctaaagcacctgaagacgttcgaccggggtgagcagacagtgggctctgtgcacactgttgggcccttccttctgcagggtgggctggtgtctgtcccgtcagtgctgacttagttccgtgcttgctgtctggatgggtcctggcccacagctataaagccacaaccagtgactccatggactagcaggcccaggctgacagctcggagggcccatgtgactgggtcccgcctgcccctgatggaactttttgtgtccccaggaatggtctggaacacggacctggtggagaccctggagctgcagaacctgatgctgtgtgcgctgcagaccatctacggagcagaggcacggaaggagtcacggggcgcgcatgccagggaagactacaaggtgggccttctcaccacgcccacctgcacctgccttttcctgccacctggtgggactcagccccacccctgcattttctctgcattttctttcgttgccccaaaagtaaatccaaaaaatgcctttttcccccctggtaactttgatccctgggttctcgccatcttctggatcactgtgaccttttccttgctttgggtcggcatccactgatgccagcagtggcatctccaagccaatgtgctttgctgttagaaggccaaggttagaagtgcagctagagtggcaagaccaggaaataaatgccagtttattaaataacgagtaagccatcatttcaagcctgccctgtggaggaaatgccagtttattaaataacgagtaagccaccgtttcaaacctgccctgtggaggaaatgccagtttattaaataacgagtaagccaccgtttcaaacctgccctgtggaggaaatgccagtttattaaataacgagtaagccaccgtttcaagcctgccctgtggaggaaatgccagtttattaaataacgagtaagccaccgtttcagacctgccctgtggtggaaatgccagtttattaaataacgagtaagccactgtttcaaacctgccctgtggaggaaatgccagtttattaacgagtaagtcactgtttcaaacctgtcctgtggaggaaatgccagtttattaacgaataagccaccgtttcaaacctgccctgtgaaggaaatgccagtttattaaataaggagtaagccaccgtttcaagcctgccctgtggaggaaatgcccgtttattaaataacgagtaagccaccgtttcaagcctgccctgtggaggaaatgcccgtttattaaataaggagtaagccaccatttcaagcctgccctgtggaggaaatgccagtttattaaataacgagtaagccaccgtttcaagcctgccctgtggaggaaatgccagtttattaaataacgagtaagccaccatttcaaacctgccctgtggaggaaatgccagtttattaacgagtaagtcaccgtttcaaacctgccctgtggaggaaatgccagtttagtaacgagtaagtcaccgttttaagcctgtcctgtggaggaaatgccagtttattaacgagtaagccaccgtttcaaacctgccctgtggaggaagtgccagtttattaaataatgagtaagtcaccgtttcaagcctgccctgtggaggaaatgccagtttattaaataacgagtaagtcaccgtttcatacctgccctgtggaggaaatgccagtttattaacgagtaagccaccgtttcagacctgccctgtggaggaaaatgccagtttattaacaagtaagtcactgtttcagacctgccctgtggatgaaatgccagtttattaatgagtaagtcaccatttcagacctgcgctgtggaggaaatgccagtttattaaataaggagtaagccaccatttcagacctgtcctgtggtttggaaaaggtattatagagcctgccctgtggtcacttgttcttcagatgaactgatttttgtgcagagcgcacgtgttggattctgcctggtaagagtttttcccatatgatagcaaaaaacgacggaaagggaagcttgggatgcaaatgcaagttcaggataaaccacatcagcaaaaggacaaaggctccacaaggcaggcgcacaggctggttcaggaccgtgtgtaggcggctggtggcagcctttccagtcagctgaacatggtgaatgggaaaatcatttttattcaccatgaaattttactgatttaccctccactagaatatgctgatggctgtgatcactgctcagaacttgctcttgtctccttgtatgtattaagagtttcctgcaaagtatatgaatccgtgtttgccagaatacagaataatagtaaatttattatttttatttttatttttttgagaaggaatctcactgtcccccaggctggagtgcagtggcgtgatctcagctcactgcaacctctgcctcccgggttcaagtgattctcctgcctcagcctcccaagcagctgggattacagacacactgccaccatgcctaattttgtattttcagtagagatggggtttcaccatattggccgggctggtctcgaactcctgacctcaagtgaaccacccacctcggcctcccaaagtgctagggttacaggcatgagccactgtgcctggccagtgcataaatttagttggtcacagtcagttttaattagaatagaagccaggtgcagtgcctcacacctgtaatcccagcatttgggaggctgaggcaggccaatgacttgagccccagagttgtagaccagcctgggcaacatggcgaaacgtgtctctacaaaaacataaaaaatgagccaggtgtggtggtagcacaggaggctgaggcaggaggattgattgagcctgggaagtcaaggctccggcaagctgtgatcacaccactgcactccagcccaggtgacatagccagaccctgtctcaaaaaaaaaatttttttttaataaaaacaggctgaaagaaaagattgaggtagtctcccagcacatggagcaaaaagacaaagtatttgataaactcttaggtacataaaggatgcttaagggaacatgcggacatggattactgtggactcactgctggctgcacaccccctggccagccatgcggcctccgtgggttctgaacatgttgatggtgccaacctcctgggctgaagtggaaatggaatgagttctagggcatctgtctcttagatcatgttaatgtctgctgtgttttttctgtattgctctgttagagtaataagaaacgtgatggtgtttctggcctcaggtgcggattgatgagtacgattactccaagcccatccaggggcaacagaagaagccctttgaggagcactggaggaagcacaccctgtcctatgtggacgttggcactgggaaggtcagtgtggagctcgttctcaccacagcccagcacccacacggccccgcccaggcctgcgggctggccttgctgatggtgaacggggaagagcaggccagatttaaatcaactcccgacagattcgaggcaccgctgaaaaaggcactccgacagcagtcgggcttcgggctggaaacagaatccagttcctgcaggtggttcagaggagccttaaggaagggttgctccgtggtgtgcgccagatggacgtcactgggcaggagcaagtgtccaaggcctggtggtaggggaggagatgatgattgtggacctagcgagaaagcatctgtggggtggggacacacagccattaccagaaaccagtcccacgttaagggagcccagaagagacacctcccctctcctcccacgggctgggccaactggaagcgtctgcaggggagctgaggggatgtggtgcagcctttagcatcccctgggcactgagcaagcagagaagggcagaaatggaggtggggttggggtgagcagtgtcctgggaacagccagccgagggtgtggtagggggtcgcagcctttttccacacacggtgagcagcgtcctgggaacagccagccgagggtgtggtaggggggtcgcagccttgttccacacaagcacagttcacctgtgtggcatttccgctgggcattaagattcagaaataatgaagatagaaagcttttacccttaaacttttcatagcttgtaagagtcgtataatcacttagctgtgtctgtggaagttacctttggactctcactatcatctagtgtgtctgtgattcaggcagtaggtcattttcaggacttctcatgaaggccatttcttgatagtgtatagaaatcacacttcactcgcttagcacaagtctatttttaatgtttccgggttcgggttttttggtttttttttgtttttctgagatagagtctcatctctgttgcccaggctgatatgtgttggcttgatctcgtctcactgcagcctcaacctcccccaggctcaggtgatcctcccacctcagcttcctgggcacatggcaccatgcctggctaatttttatatgttttgtagagatggggtttctccacgttgcccaggctagtcttgaactcctgcgctcaagtgatccacctgtcttggcctcccaacaggcatgaaccaacacccccagccagttttagtgatttttcaagaaatacatactcattttagaaagtacaaagagattgaaataagagctcactaaccagagacgacccattatggtttaaatttctttgtatatgtgcctaccttttcctgtgtgtgcatatttaatacacagcttgagtattccttctctgaaatccttgggaccagaagcgttgtggatttcaggcttgttcagactttggaatatttgcattatacttactgtctgagcatccctaatcggaagatctgactccatagcacatttcttttgaatgtcatgctggtgctcagaaagtttcagattttagagaatttcagatttttggattagggatgttcaacctatataaatatttactttgaagtagaaaaactggaagtagatggtttaaacataaagtgtcttggtatagacaagggttctcccactttacatgatgggagcatttttgtaaagcactgagaatcttaaagttcacatgccataaatctacttttatagttaaaatttttcaaaaggaacacaagagatggctttttgtacatttttgtgcttaacttaccactgactcttcttttcaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatga

SEQ ID NO: 35772 - DNA, 82002 bp, Homo sapiens
cggcagtggcactcacccggctcgcgcggccccggcgccccacgcgcgcgcgtcgttctcccgcccgctcgctccccggcgctcacacctgagctcactcgcgcacgcccgcccggcccgagaaccgcgccgccgcctcggccccgcggaagccccgccgcgtcatgtcttcgcctcccgaagggaaactagagactaaagctggacacccgcccgccggtactgactcttttcctctctctccacgcgcgggtgccgggggcgggctcgaacccgggggcgccgggcgggggctccgcggggagggccccggcgagcgctgagacgggttccgggccttgatgcccgcccgaggggcgcgggccgcggagaggtcgggcgcccaggcccgggaggagcccgccggagcttcggccccgcttgccggcggcggcgaagcgtttcttcctgaggaccgcgggcggccgcgtacctgtgcgattgcgcgcaggctccggtgccttgggcgaacccagttgcacaacttataacaaagttttggcggataatatttacttagaggatacagatgtctagaaagaaagtagcagaagcaatgaaaagtcagtggtgttaatatcatggtgatgattaattagaggctgccagcgtttcataccgactcaagaaccaaggagcggaaataatttttatcattaatcactcaatatgactttcaccgccagtttcttccacatccagattttttttttcccccaaagttgctttttctgattttgagcaaatcctaaacttctgagccaaggaagttaaagccaggaaagagcggtctttcttagaacatagggatctaagcagccttcatgcttctgccacctcctcctctctctgggcacagttcctgtttgcactttggattctgtccagacgggtctgtttccgtttctactctcctttccagtggcagtcggcccatatggagggacactggtgagaagatcaaaggccttgggtctcagaagccaagtcacttcaatgtatggatgcgtgaggttcttttaggtcttaatagcacgccttagtgtcataaactcagtcttgtaggaacagaagtctttgagaaacatggcttcttttggtggcacatttgcgccattttcttgacaataaagattcctggccaggcgcggtggctcatgcctgtaaccccagcagtttgggaggccaaggagggtggatcacttgaggtcaggagttcaagactagcctggataacatggtgaaaccccatctctactaaaagtagaaaaattagctgggcatggtggcgggcgcctgtaatcccagctattcaggaggccgaggcaggagaatggcttgaacccgggaggcagaagttgtagtgagccaagattgagccaaagcactccagccttggcgacaaagcgagcgagactccatctcaaaaaaaaaaaaaaaaaaaaaaaagattcccattatccttctctgctgtcctccgctatagggcgggaattctctgcaccagcacaatgaataggagccgttctttaaatatgttgcagtccagagtaggcaatatttttcagtggtgacggaggctctctacaacaaaactaactggcactgggaaagaaaaatgtctaactgatgccagagaacttaagaggcatggggttttagaaaatcattccactgtgatggaaaatggttttgggggaatttgtgttgcattggttttaagaaaaaaagtacttcaaagggagttttttttttgatgggatttcttttaaggataactgacttccattccaccacagcgggtccctgtccactgtggggaggagcgccttgatttccaccccgggcagggctgcctccaggaactgcagcagccacctgctctggccctccactccccaggacatgggttacattaaagcgtatctgttggaatgatacagaaccaaagtacagtaattaaattgcatacagagacacacccataaagaagttttttgttttgttttttgaaacagagtctcactctgtcacctgggagtgcagtggcacgatcttggctcactgcaacctccgccttctaggttcaagagattctcctgcctcagcctcccgagtagctgggtttacaggtgcctgccaccacacctggctgatttttgtatttttagtagagaccggattttgccatgttggccaggctggtcttgaactcctgacttcaggtgatccacccacctcagccttccaaagtgcccatatggagatttttaaggtcagaggtataaactgtacatactcactccctgggagaaattccttgctggactctggttttctttgaattgcagagtaaacagctaggctttgtgaattacagagtaagtagtttatttacccctgaggagggaagaggcagcttatttgtgctagtgtagcagtgagcttgggttctaagtttgaagacatcacttcacgcttcactggggctcagtttttctcctttatgaaattcgaggtttgggcctcggggcaagtcacagggtggggctgtgtttgctgcagtgagtctcacgtcccgcttcagcatcagggtaccagcactgttcatcccccaggtaaactcctctagtaacttcagggcaacccctttagacttacggggtgagctcttgcgggtggctgtcaccatctgtcatctgtctccaagaccatagttagaggaggggcccaatagcagcacccctcaaatgccagcagcatccctcaaatgccaacagcacccctcaaatgccaacagcacccctcaaatgccaacagcacccctcagatgccaacagcacccctcaaatgcgctttcctagatgttacagaggaccatgtgtgaaccttttctggcaggaagctctggtgttcttgtttagtctggcattgccagagagtaggcagctctgaagggtagatagtttttaaaaaaaaaaaaaaaaggcggcccactacactaaaggataatcatcaaggatagccaagagcacagttcataaatcaaaatcactgccttaaaaatgttgagaatgctttcattaagtgcttaaattggataacagacttgtgcctcaatgctcaatcagaaataataaaattctcttacagtgactatcttaatgttcttttgtgtcttctctttgttgctgtctggcccatatctcctgtacattccccgcaatccccttgttttccttcgtgcactaaccttcgcctctctgcctgtcttcttgcttccagggctgggtcttcttgatctctttattcccggggtggcacaaaatactcaataagcactccagagtttccccagggcctcttctcacccctcactgcccccatagcaaaccgggcccacaccttcctcaactctgagctctctgtactgtgcgcagggatgcaggtggtcctcttggccggttcaggcagcagactggtggaaacactaatgaagtttgttgagtgtcacaatgtgctgacacacttctaagcgcttggcacgtttaactcatgaaatcaccagtcatcttaacattgagataccgaggacagtgccgtttaaaaacctgacccagagccgggtgtcgtggctcacgcctataatcccagcactttgggagacccaggtggggagagcacctgagctcaggagttcaagactagcctggccaacatggtgaaaccccgtctctaccaaaaatacaaaattagtcgggtgtgctggtgggtgcctgtaatctcagctactctgtaggctgaggcaggaaaatcgcttgaacctgggaggcagaggttgtggtgagccaggatcacaccactggactccagcctgggcaagaagagcgaatatttcgtctaaaaaaaaaaaacctgacccaattgtttggagtgtctgttgccaactcccctgagctagtgacctagtgggagcggccggaaaggctgttgccttttggaacttcagcagcccgacagacgactccatcactggccaggtgcctcctcccaaggtgggagacgaatgaggcagtttgtaaaggcttctgaagagtgttagagaaaggtgctgtgcaaatacaggtattgttatttacaagtgatggatggcactgcatcatgtcctggcaaatgtgctgtcgtctgcagtcctctgtagaagtaatccagccttaatgatttgagaccttaccactgctcttgactacaaaatatttgcagagaaatggggtgagtgcttgtttgatgagttattgcaaatgcagattagcagagttagaattagcgagattctttctgtttcatctaacagcagtcatagcattccacagcagaaaagaggacctaattataagcctcgctattactcatttctgccagtctttgtgagtctgtggcagtgagatgtgtaaaatctctttgttaaatacattttgctggccctgttcccctccatttcccagtggagccaaaaccatgtgtcagtagagttctcataaatctgctacatgatagctttgaatgttactaatcttacatgtggttttctttgaaaagcagactctacatcccctctcaaagtgaattaaatggaaatataagcacgattatatttatttcaagccatgttactttttttagtaacttcagagtaacttagttctctcttacactaattgatacgtcagacatgagttaaggatgcctttcaaaagtctagtgtaattctccctgaattatctccctgcagaaagactttcagattatccattgctagaaacagaagactaatttgtcttctattaaccctgtggtcacagatttgctaagcatagtcccagtgtcaaccagtcaggaccagaaattgaatggtccaggtaagaggtctgcccttgttcccaacatgccaaggaaaacaagaccctttagttactatcttttttcagaagccttctgtcaaggtggcccatggcatttcacctcttccctagcctttttttgttgttcttgtctagacagggtctctctcaggcttgagtgcagtggcgtgatcttggctcactgcaaccttggcctcctgggctcaagagatcttctcgcctcagtgtgctgagtagctgggactacaggtgtgcaccaccacaaccagctaatttgtgtattttgtgtagacacaaggttttactatgttgtccagtcaggtctcaaactcctgggctcaagcgacctgcccaccttggcctcccaaagtgttgggactccaggcatgagccaccgcacccagccttccctagccatttttggttatctgtgacttctaacgtctttgtgagtgtccttttcatttcggccagtgccctgtgcattcttacttggttttgtgactgcttttcccttcccagcttcagaagttttttttgtttctatagagaatgttcacttttgtataaagtactatattaggtatagagaatggtacttcctgttgtaacaaacaacctaaattctcagtggccaaactaatccaggtttatttctctcctgggtggggtcttcttaacaaagagcaattcagaggcccagacaccccttgctgtataacactagcttttcattgtgtggctgctgctgaggggacaagtgtaggtcgccgtgctggggtccgtatggtgtggcccacaagtggtatgcatcatcacatcagtttcctatggctgctgtaccaaatcacaataaacttagtggttctaaacaacacagttttattatgttacagttctagaggtgagaagtccaagatgggtctcactgggctaaaatcaaagtatccacagggcaactggttccttctggaggatcggggagaatcccattttcttgccttttccagcttctagaggctgcccactttccttggctcgtggcgccttcctccacaagccaaggaaagcttcttcaaaggcagcaatgaccagtcacatcctcacatcacacactcagagccctgactcttccgcctccctctttcacattcagagacccttgagattacatgggcccacctgggtaatccagaataatctcctcaccttcagtctatgattctaagcacagaatagcagtttcccttcttcttcctcagcttacagtcagctgatgagcaaccttaattccatctacaaccctcatttcccctggccgtgtagcccagcacactcacaggttccagagtggggggacgtgatgacatgatgctgcccaccaaagtcacttttccccatactattgggcaggacccagtttgatgcccccaatccaactacggggaagctgggagtgagactggcaaacacctgactagtcctagcctcaaccaattcccaatgacagcttttccaaagcacttccaggcagccgatcctactttcccctaaactttttgaatcagcctccctgcactcaaggatatacatgtagctgctccatgtacctcccagcttgaaaggggcccagtcagatgtccggcaaggtgcccatcctggcccagtcagtactcattttgtcctttgggtcagaaactatgtcaaggatggaacacacactgctgtggaagatggagtgtttggcccaggggggtcccactatgtctctgaacttcattctttaacagggttgctccgtgtaatttaagagccttctcaccttcacagtctatgattctgagcacagaatagcagtatgaagccaacgagagtgcaaattcaggaaagtatctggggctccagctcattttttagcacaaaccattacttctaccttatctatgcacacctgaaagctcctgtaagggctccacttggtctgggggcaaggttctcattggggtcttctataacttatgtctgttattgggccagactgtcagtacccactctctgcatacgttcttaccgcctctcacccctttatcctctccactttttagggttcccaccttcaggtgcatgggcttccatagatgtgagtctccacttgccagtgattctcctctctcctggtggagtcatttttcttaactaagataggccatagtcccttgccctgttcgcattgggaagttctacccacctaatctcaccagcccctttgcttacctgccactacattgctctacctgagatcctttggtttaatcataacctgcagcactggttgttttctgttttgttttgttccttccactggaacagtcctcagaacctttcgtcacttcttttaggtagaagagcttccctttgaataacatttccatagctcttctcaggcaagaacaaaggtagcatatacttgtgagtcatactccagtacctgcagtggatgcttttgggacatttgtgtgagttaacagcccttcctagctccctgctggaaattgctccctggttcatggaactcttccagtatttcccctttcttcttcccgcagtagcattttctagtttgctatttggcactagcagatagcaagccaccagtgactgcatcttacagccaggcatcctgacacctgaggacggatgcttggcccagggtcccacatagtcatttgcctccttggtgtttgcttacctcccagatgtgaccgtaggtaaagcttcctccactccccttcccacttgggcaggcagctgctctgtggagagcttttcatttcaaactcaccttcccttatctaggtagtgtaataacctggccctgtctgtaggccgttcctttgagttactctcagaagccatggtgctctgcttcctggaaggaatctgatcaaggaaaggcttacctacgattaagggtggaacccagtttgccgcttgccagctgtgcgatttggggccgctggcttccccttctccctgcctcaggatctactccgtggggctgctgtgcagtgaaagatgcgtggactccaagtggttagagcggtgcctgccacagagtggtgatgaggagcagaagttggatctgtgattctcccaaagcttcctcaggtggtgatgtaatgacggaggtcctggtggtggtcagcaccacgatgggcaggtgctttacagggcatggccttcattccccagcaacccgtagggcagcgctctttaaggaactgctgtgaagagagggtgaagagctggaaaagcaccaacgatttgaggactccagaggcctctcttgagtactaaatgctaacttaaaaacccatttaataagactagctaacagttgagcacatcctgtgtgccaggtcctgttggaggcatttcatgtgtcctaactcatgtaatcctcagctggccctgggagaggggaacattttcactctttcttcataggtggcagaccctgaggcacagagagcttcagcaacttgcccacacacagccacacacacaagcacatacgtatgcacacatgtgcacacacttatgcacaggcacatgcacacacacacacacacaggcagaactgggatttgatcccaaggttctggctccagcatctgtgttcttatcctctgcacagcacttctgctaagaggaagcttattttttacatttgaagctctcatttgaataacaaccaccacgacaaaaatctaaggtttttctgtttctcctaaaaatactgatttgcaaataattctgcaaagatttctgcaaaagtaattcttcttttgtagttttacaaatgaagagttctagagacagtgatacaacaatcacaataaatatgtgctgtcatattttttggcagtattgtaagttaaaatgaatctgtctcagctttgagttattattgttattattgccactttttattgctacattaatcaccaaacataactgagagggattaatgaagttaattgtttttagaaactaaattaaatgcaagtgctaatgctgggtgactgagccttgacactgtgtgcttatttcagcagaggagcggacaggctgccctgcaggagcttcagaagacttgatcatttcaaatgtcaccttaacattcatcattagttttctttatagttagttgcacagctctttttatttttactttatgaacacatctgtgagttacagtttaaaagttttatgtgtgccaagttggaaagattcagagatcatttttaaatgggcatctgtattgttggtttggcctgccttaacaaaataccacagactgggtggcttaaaccatagacatttatttctcccagcttgggaggctgaagtccaagatcaaggtgttggcagctctgctttctcctgagacctctctcctgggcttgcagatggcactttcttgctgtttccttgcaggccatttctttgtgtgtgcacgacccggtgtctctttctcttatagagacaccatttctattatattagagccctacctcaattcctcattttaacttaattgtcttttaagaccctctctccaaatacaattacaatttaagggtatgtcagttaggacttcaacctatgaattttggggggacactattcagcccgtaatagcatctttcatcaatttctgatgagcatgggaaagaggtgggatagagcagggagggaaatgaatttttaaaaaatatttagtgggacagttcttctaagctcttccttgagcccgaaacattcataactctgagatcctgtgtttcaagagagtggaaaatgaccctaaggtgtaggtagataattgtattttcagtctccatttctgattgggaggccaactacgtaggctgggaaatctttttaatcttagattaaaaagctgcctgcaaatggtaggtcttttctgttttgtctttggctttttgcttttttaaaagaatttgaccttgaagtgaaaggaattcctggaaacccaaaacgaagaaggaactgaaattcagacctttagcatgagaggtgggcccacaggaggcagggagtagccaaggttggatgctcagaggccacacccctggggaaaggtggaagagggaaacctgcccagtggccctaggagggccaggaagccggactgtgtcaggctgggctccacatggggacagaggtctccttgagaatttgtaaacaaaggcttgcttttacatgagttcagttcgtatttgtactgtttggcaatttgtcttctgagaaatctgccttgaaaaggattttcagacacctatactcctggcctgacaaaaacacgtgtagcatctccccagagggttgctgtctgcatcacaggccccatgagatccttactggtaaagcccagtgaagacagattcctcctccaagtctcccaggacaagagcaagaatccacaggcaaaaacagacagcaggattagactccagaggacttcagaaaatcaaataattggatatacaactaaaatgattaaatatataaaggaattgaacgcacaagaaaagaataagaccccatcaaatacctggtgaatttgagacaaaagctgtaggaatgaaaaatagagtgattaaaaatcaattgatgggatatagagcagatttttgagaggattactgaacaggattctgtttccttctgccccaagtagaatgtcctctccgttgagaagaggtgcgggcagcagggagattttagttctaaacccaagccagaggaaatagtcgtcattttccttgctctcttttgcccttttctaacagccagctgctggggcagtgctggtcctgggagcaaacgtcaccatctccctccagtcgggctggccaagtctcccagggaaattgaagaccagtacacctgaagcatgtaagccccaggctgcctctcccattctccttcccgttcatcagcagcataaagaaagttggcctgggttttcgtgactcggcagggtccactcagtttaaaatgccagaggacatggtgtggcaagttgactgtatcgtgatgttagccgtcttgtggcagagactcagagacttgaagggtaaagctcagtaaggcccacatccagagcctggggggccaatgactacaaggaaaatgaccctgctttctagccagcaccccactctcccgaacgcctctctcttcttaatagtctgaggaggtttatctcctttctgcagatgaagcagggaatctttgagaatctgagacactagtctgagaccacatagctgagggcgtggaggaacgtgccgaccccaaacacatgctggtggctaccatgcgaggctggctttttggatttagggccagccagcatttccaaattctgttcatggaacactgtagccctgatggaggataactggtattatagccaaaaaaaaaaaaaaaaaaaaagttgtgtggtcagataggctggggagagctggcaagctgtatgcctcctgtaagtcttcctcatgcaggtagcacactaagggccaagaaggtctctcttggggaaacctatttaattttgttcaacctggcatttcccactcttaatagatgctagattacccgaccccttacaacacagtattaacatattagccataaaggaattgcacatcaaaccacaataagagaccacttcacacccactaggatggctataattaaaaagacacacaatagtaagtgtcgggaacatgtggagaattggaacccacacactggtgggaatgtgaaatagtgtggaggctttggaagacagcttggtggttttcagaaggataaattcagaggcaccatgtggcctggcagttccatttctcggtatatactcaaggaaatgaaaacatatgtccatacaaaaacttacgtgtaagttcttcacagctgcattgttcataatagccaaaaaagtagaaacaacgcaaatgtctaattgatgagtggagagatacaatgtgatacatccatgcaatagaatatttgacaagaagaggaatgagatacttacacgtgctgtaacatggatgaaccttgaaaacacgctaagtgcaaggagccagtcaccaaaggccacatagtttataattccacttatatcacatgtccgaaataagcaagtccaggtgactggcttccaggagctgggaggggtggaatggagggtaactgttcatggctgtggggtttctgtttggggtgatgaaaatctcctaaaattgattatggcaatggttgtacaattctgaatgcactcaaaaccatcgaattatacagtttaaatgaatgaattgtattctacatgaattacatatctataaagctgttttttaaaactaagttaacatctgccagcggtagggtttcacagcacagtttgggcaaagctgcagtagaagttttgttgccacttgcctgggctctgtgaaggcacagtagctgtcccatgtcacccatcaccatatcaccccatcaaaaacatcttcgatatttgagaaagtaaatttcacaggggagggttgaggtgagctcttgtgttgagactgtggagaactgaaagcagcagccactctctttgtgtagtttgtgccctcgttacactgctgctctgacaaaatacttgaaaggtgaccagatagaaaaacaagagccttggaaagtttctgagtggatctgtagtaagagattatgttgagtgctgtatcattttgaatttaccccgacaaccctgaccttccctagttaatcattttcattgccagattctccagactgacttgtggccactgagcaaccagaacctttccagctggtccccctgatccacaggcagccccatttccacattaatcccacactctctgttttcatttcagtgaaagctggtggaatgcgaattgtgcagaaacacccacatacaggagacaccaaagaagagaaagacaaggatgaccaggaatgggaaagccccaggtgggatgatgctagcgactcttgagcatgttttccaaaaaccctattcggttaagcattaacatttgttctctgttctatgattctgataactcctgggctatgtggggccctgttctgtgtatttttcccttcctaatcagggaggagggggctttgttttcagtcaggggagaaaatagagcccctagaggtcctctttcctgagcagttgccacgcgcccaccctgttccccaccccacacccaggggctggtgccccgtctgtctgcacagttagagacctacctccacctgcccaggtgcctgggtttagccagtgtgcctcccttcctggaagccagggcaagccaagccaagcaggagcagcttcctgtggctcattggttttctgatggtggacacagctgccagccaccctcttcccaaggctggaccaccagagtggacgaagtaggcaaattcttgcacctgtgagtcttttgtactccaggtttctgttgtcattccagagaaacaaatactaacaatttctgggcagtagtttgcaacttaggcttccatactgaaatcacatggagacccttgagaattgccgcactagttgaacctcaggggtggacctggctgtctgtgtagctggggcaagaacttctgatttcagaatggttgaagcatttcctccctcggatcatcagccagatctagaattacaaggccatgcccttatgagtgactgggtgtccttatatgatacctctgctgccaaccctcctggggcctgcacaggggtctccttgcagacccctcctcccctgctcaacacctattttccttaaaggttcagatttccagttgggttcagggaccttgaaaggaatccatttctctcgactttgcaatacgcaaacaggcaccactaacacacctctgcgggagctcgtccacgtagaagaaagcactaagctctctacttatacagcctgtctccagatgatgtctcagtcagaagaggagagggtgtggaaggggaaagaggctgtggaaagaagctaaccttgattcctgtggattaggcccatgcttttatttcatttcattccagcagtcctgaatagtaggtggtattctccccagtttatgtacaaggaaacagaaccccaaagaggatatcagcttgcccatatcatgcaccgtgctaggtaacgtagcaggaagttcaacccagttctcatggagtgctcagcgggctaggcttccaaatggatagttgccaagagtaggcacccacatgaggaagtggtgcatgttcttggtaaccctgcctgtctgcttctaagtggccttccccattgagtattgtctataaaacctgatacagtatgagttacggagcggccacgtgagggaagaacagcattttgggtgacatttctgagtgattattagtgattattgtccattttaaatcatgagattagcagtgtaaagattcagtcccagttctggtttaaaagaaggcagtttaaagaaaatgctagaattgtccgggcacggtgtctcacgccagtaatcccagcactttgggaggccgaggtgggtggatcacttgaggtcaggggtgcgagaccagcctggccaacatggggaaaccccgtctctactaaaaacacaaaaatcagtcaggtgtggtggcatgtgcctgtaatcccagctactcaggaggctgaggcaggagaaccccctgaactcaggaggcggaggttgcattgagccaagatcatgccactgcactccagcctgggcaacagaacaaaactcttgtctcaaaaaaaaaaaaacaaaaaaaaaacgctagaattatttttctcacttactgtattcacaaagctatgtttggaacgtaacagcatcagcaactctcctgtaagttcacaattgtatatctgtaggacttgcggcccgacgtattttagaatggagaaatttgggagtctaggaggatattactgcttttaggagaataaaaccttgcatataccacatagtaccccctaggagaataaaaccttgcatataccacatagtacccccagtggggtctcaggcagtatattgtaatctatatgtgatgttcaaaccgaattagataatttttttaaatttagggactagtgtcacttcaggttaagttttgcctccgtacaagttatgaggaagccttccattttctgagcattcttgagttgggaatcgaggctaagagtgtgtaagcctgtagtaatttccctctaggaaacctggggtgtcattgcccttcttcataaccatctgtttccccaaggaagaaagagggcaagagatatcgccttgcctggaaaaaaagttcctggaaagttaatgaaacactgcttttcttggtgagtttaagtggaataaggtacagatagctagttccctacctaacacagtgtcaatacaatgagagatagtaatttattagcaagtttagaaataaggacagaacagcccactagttttctttctgttgatttttttcatgagttgacatgcagcttttctagaagatgatcaatttaaataaatatgccagaggatgaacagttgaagaggaaagatcgagcaccccagcgctgtagattgtagcatcttatttaccttaaagatttgttctctatctctagagaaccagatattttgaagcaggccgactgcagggtatggtttgcaaagcacatgagcaaggcttttgttgttgttgttccctgcagccaaattgctaggatacattcctgatgagtgtgttagcacttgtcctcttgactttggcttggctgtttactgctgtgggttaaacaactcgacacagcatttacagaacggggtaagcctgtgtacactctttagctattgatgtaagttgccaaaacagctttttctaacacactccacgaggcctggtactctgtgtaatagtttacttttaccaccatgcactcccactccccatttctctggtggactgattgaataatcataatcaatcatcatcatcactcattcttacagagtgcaatgagctcggctctgttctaactgctctgttcatattaattcatttgatctgtgctactgctcagtttgttatcatccctatctcagagctgtttattattggctattactcccattctgaattactactccctcttcaagagctctgagagtgaagtgacttttccgagggcacacggtgggtaagtggcagtgccagcattccagtgctggtggcagcttctggattccttacgctgctccacgaggctttgcttagccattgggctcttgttttgtgctgggcacctgctaagtgcttcacgttgaatttagtgctcaccgcacctataagttggtattactgtgtccattatagagacgaagaaagcaaagcttagggaggtttccaacccaatgatatgtagtcggtcattggcctggccaggattcagccttgagtctgtcttggtttggaagcccttgcccctgatatgtcacgtaagtccctggatccacatagattgcaatcctgatctctctgtaaatgaaacttactgattctggggttgcccataaccttgtctgcgctcctcaaacccataatcctacccttttgcagcctcaccgtcagtaggtggtctaattatcactttacaataaggtttcaggggactaggctggttttacttcaggtatggaaaagcctacttacttgcagaatgtataaaacacttaattatcctcttggaaatgtcttatagcatgtgactttcctatccacattaccctgatcctaaagttttatattctttaattttgatcccagtgttgttcagatatgaaaatgagtacctaacaccaaatgccagtttccttcttagctatagatgtacatttgcaaaactttcttttccttgccagacattcaagactagttttaaatttactgactcatctctggtggcttccttccccattaattggaaaatcaagtactgattacagagaaaagggacaagtggaagattaaagatgttactgtgttgacaggaaaaaaaaagccctgcaacttttactagttatttttcttgcaattgtttatgcaactcttattccctttaatcttgtagctttccacagacttaaacgtaatttcttatgctaccaagttgttttgagatgctgtgttaaaaaaaatatagccaaaatgtgaaaatgctgccaaagaatttccgtcaacctgagttctagttactggtggttcttcatgtccaggaagagtaatagtcttcattattattagctaatactttcctgcgtggctgcttgattccatctcgagccgacccaattaaggaaactggtggtttccaagccttttgtcgagtgtcataagataaagtagccagtttcattatgtaaaggagagactgcagacatagaatggactttaggagtcagggttcactagagaaaacagtttaatgtcaaacatttgctgacattctgccatgatctgggcttggtacaagatattaaaaaggaatggataacaggaggggtaaaccagaaaagaacgggtttggtcactgacaagtggtggatggaaaaggggtggaaagaaggaagaaacagaaatggggaataaggaacaattcttccctgagcttgactttttgcatggttctgacctagaaccatggcactgtttcacacacctgacaagtaagccaacaattcacatcaaccaagaggtgggagggacccagaatggcgtacaagcactgacggattgaagggagtgggaaatgcaattgcttgatataaccatatttaagggagtagggagttacctaattaactttggaaaacaacatttttaagtggatactataaggctaaagacaataaaaaactatgcataaatggtgtacttcagttagtaaacaggcttcttaaggggcatggtttagcaattctgaaattgccttatgtgaatactaggattcaacaaacaaagagccgagttcctcactgtcagagaaagaggttacaaataggaaagggagaagactgaaatgaacttggtgctgttggatgggaactagaagtatctgtatgaacatatggttctgaatggatagatggatggatggatggatggatggatggtagatacaaacatacctatacagatatacagaaatgaatatggatgagagggttagtgtcatacctgtatttcctagctttgttcactgagagggcctaaagaactgacgcccatgcagccataagcatccctagggcccagactgtggtgtctaaacaccattccccagtcagaggaaccacggttccttggagaagtagttgattccaggccaggacaggaaaaatactagatgagcctggaatatactgtagtgccagaacataaggaagttctccagaaaggtttggggcagggcagaatgttatagaagcccacctgaagaatctccttatggccttagctggaataatttgcaacaaagtgatagtattagatttttttgtttttgtttttgagatggagtttcactcttgttgcccatgctggagtgcagtggtatgatctcagctcactgcaacctctgtcttccggtttcaagtgattctcctgcctcagcctcccgagtagctgggattacaggcacctgccaccacgtctggctaatttttttagtagagacggggtttcaccatgttggctaggctggtcttgaactcctgaccttgtgattggcccgtcttagcctgccaaagtgctgggattacaggcatgagccaccgcacccggccgatagtgttagattttaacccatacggtaaaataaatatccatgagtccatactgacataaataattgaattaacaagccaggagaacggatagctcttttttgtagaagaactccagttacttaatgtataagaaaggaggtaactagaatatcaccaggaggcaaacagcacagtaattgttatagacaagatccactgatggatgtcagaattaatgggtaaaagtttgaggaaaaacacgatatttacgtagtcaacaggatatttgcgtagtctcaaagtatcttccccaatatatctattaattacaaaacaaaatgaaaagagtgtctttaccgtggaagccatgagaagcacattgtgtacagtatgaaaacgggaagaaggcagagcaccaccttcagcctcagctgggaaaatgcaggttgattgtcacaaaaaatactacaaaaagccttcgctgctctgcctgtgtctgtgaatgaccacgaaggtgctacgtgtgtttgattttggggttacaaataaattttagcaagtaggcacgtttacaaaaatggaataaataaatagtaatgatggactgaacttattatctcgccctttatagaaaagctttgccaaccctcattttaacttagtctgccttcagaaactagtctactacttcataaacaacttaagaaacttacaacagtatacttctaattaccactctacccactttgtgttttgtcatatactttacttctaccaatactataaaaaataatgtgctggtgattacttatctcctggccctccaagaaaaaattttaaaagcccgatttgtagcatttgctaattttatggtgtgaatactcctaccacagccccccaccgcacctgcttttttttgagacagggtctcactctgccacccaggctggattgcagtagcataatcctggcttactgcagcctcagcctcctgggctcaagcagtcctcccacctctgcctcgcaagtagctaggactagaggtgtacaccaccacgctcagcaaatttttaaattttttttgtagagaccaggtctcaccacattgcccaggctggtctcaaactcttgagctcaagcaatcctcctacctcagcctcccatagtgctgggattacaggcgtgaaccaccacacccagctacagccaattttaaactaacaacatgacatcactaaacatagacttgtgaagacatgtgaacagtcagctctacatgccagtgtaagtcagctccaacacaccactggctacaacttccacttacattgttattgtttttaatagtagccttttaaagatgtttaaagaaagatagatatgaaatatcttttaaagattcattatgcacatctaatgttcattctgtctggtgtcctttatttcttcccactgggtttctgtctgttttattctctttctgaaaatatttgtgatagtaaatgtctgctggagatgaattcttccaggttttgtctttctgaaaatgtctttgttttgcttttacttttgaaagatgttttcactatatattgaattcctagttaaaaattttttctttcaatgtgttaaacacggcattccatttttttctggcttccattgtgtacagcgagaagtcagccataattcttgtcatttttctctgtatgtaatgtttctgtttacctatggttactttcaagattttctctttatttctgtttttcaacagtgtgtttgtgatgcaccaagtttggttgtctttgtatgtatcttacttgggattcactgagcattttttatctatggtttggtgtcatcagcttggaaaaattgttggccattgtcttttcaaaaatatccttgcttcatttttctcttctttttttgagactctagttgtacccatagtgaacatttgatatgttcacaggcctcggatgctctgtttttctcctctctgccgccgactcttttttcctctcctatttcagtgtagatggtttcttttgaacctgactcctttctcttgtgcccagtgtggcaataagtccagtgaaagaattcatctttgatatcctgtttttcatttccacttccatttggcttttaaaaatgtatagcttccatttctctgctgaaatttcctgtcttttcacagatatttatcacagttattttaaatcttcatctgatgagtccaacatccaggcttggtccctcattctgttaactgtttgtttctttacagtgggtcacatcacttcttcgagggtcttttaatttttaagtaaagtaaaacctggtgtgtaaaagaatgacagagacagaaataacactagaagctgaagtaaataatatttacatcagtccagaaaacagcatgccttttctgttcaaacccattcgtgtgtgtgtgtgtgtgtgtgtgtgtgtgtgtgagttaatttagtatttatagttgaaccgggcctgggctgtattgctgcttaagttagattcaagacctcacaaatatcaaattaattgaaggtaggattataaccttcccacttgtagtggcttaggatatgaatgcctggaaggtgtgtctattttcctgccctgccattggacttcagcaggctctgtgtgtgtgctgagccttgtgggcgagagcctttcagttccctcatccctttccaaccaagatggacctcttcttggtcctgggtgaggcctagagtgccagtgggaatcataatatttgcctcatgtgattataattcactggtcaattagacaacatataaaaacacctcaaccatctcagtcacgtattaagtgatagctgttattacatctgtggtgattttttaaaactttttgttttgaaataatttcagacatacagaaaaattgccaaaaaaaaaaagtactaaaaaaatcccatctacccctcaccatattcctcatatggtaaaatttcaccacacttgctgctcctcccatttctttctttctttttttttttttttttttttttttgattcagagtcttgctctgtcacccaggctggaatgcagtagtgcgatctcggctctctgcaagctccacctcccaggttcacgccattctcctgcctcagcctccccagcagctgggactacaggcacatgccaccacgttcggctaattttttgtatttttagtagtgacagagtttcagcgtgttagccaggatggtctcgatctcctgaccttgtgatccaccctcctcagcctcccaaagtgctgggattacaggcatgagccactgcacccagccctgctcctcccatttcttaacgctcacatatatctaaatctacatctgtctgtttatacgaactttcttctgaagagctcttttactctggaatgctttagtgtgtgtttactaaaagcaagtactgtataattatcaaaatcaggaaactaacattgaaacagtagtgttatctaatctacagactcttcagacttggcccattttcccactactgccacaaatttcagtccaggattataccttcatttagtgatatatctttagtcgcctttaatctagaacagttatccagctttttaaaatctttcatgaccttgacatgtttgaagagtataggtcatttattttgtaggattttcctcagttcaatttttctgatgtgccttcatgattggattcaggtcctgctttcagggcaggggctgcacagaagcgaggtcttgtccttcttgatgcattggatcaggaggtacacgacactccccatctcatggccggtgatgccagctttgattgttcagttaagatggcatctgccaagtttctccactatcaatttactattttaccctttgtaattcatacatatctcatgggggaatactttgcaactctatgagtattgtgtttctcatcaaacttttgcctgctactttcagcattcactgatgatgcttgcctgaaacagtaactactgcagatatactgtatttgtttcccagggctgccttaacaaaatgccacaacctgggtggctttaaataacacatttgtcatctcagttctggaggccagaatgctgaaagcaaggtgttggcaggttggttgcttctgagagctgtgggaagcatgtgttccatgctgctcccctagcttctggtggtttctgcaatctctggcatcccctggcttgtagatgcatcactccagtcctgtgcctttacatggtttctccctgtgtctctacatcatctttcctctttgtgtgtctttgtgtccaaatttccccttttcataaggacactggtcatattggattaggacccatcctgatgacttcattttaactggattaataaagatcccacttccaaataagctcacattctgaagtactgggagttaggatttcagcatgccttttttggaggacacaagtcaacccgtagcagatgccaaatggtgatctatagcaatttttaatggttctctcagtcaagttcattgttaagataataaatagaaaatttaaaacttcagttaaaagatggcccagcaatgtgccagcttaaatctcaggcatgtatgcctgggaatttttatctttagccatgatctgcatgtttgaactttaagccgtttggtgaaccaatttcaacattacccttaagttctaatgtcaccttttatatccaggctagttgccagctgccttttaagaggggcgtgtccctgttctctaccatgtgtgtggagatttcagtagaccagggatgctgagcaccggccagctctcagctccagttttttttgttgttgttgttgttttgtttttgtttttgttttttttttgagacagagtcttgctctgtcgcccaggctggagtgcagtggcgtgatctcagctcactgcaagctctacctcccaggttcaagtgattctcctgcctcagcctcccgagtagctgggattacaggctacatgccaccatgcccagctaattattgtatttttagtagagacaggatatcactatgttggccaggctgctctcaaactcctgacctcaggtgatcgcctgcctcagcctcccaaagtgttgggattacaggcgtgagccaccgtacctggctcagctccaatattgtgagtgccctgtgctggcagacagggcccaccacttgccagcagcagctgacccaggtgctggagtgccacgggccacagagccctgcactggccaaaggcagagccgcaacatggcccaggcactgagtgacatgtagtgtctgtttgagggggtaactggttgtcactgcttatggactgagaggcctcttccagggagaagctgtaaggaaggtacagcaagaccctcagaataaaaagcaggcctgatttcatggcagcataaaatagtaacaaatagcccatctgccctgggaaggagaatcaggaagattcccgttgctgttgggcagttcttcctgtcaggtttgtcagactgagactcagagaccaagtttgtaggcaaaatggggcattgctgaagtgtcaccgtttatgtgccagcaagggagtggtaaaaggaagcgttttgcctgtggcaacttgggcggcagaaagttgacagaacaagcacaagccctcaaaccccctgacggcagccgagtctgctggcagcatccgctgcgtgtgaagccccatgcaggatgacatctgtgcaagcgaggctgcccagggagggttggcgtctggcagcctctccagaggctgcaggctgtcctaatggcagcttcgagatctgccattaggacaaagccattctcatctccacccaggttagagtgggcagaacttccaggcaggctggctgcctctccaccaagaagcagcacattagttttcctagtgctcccataacacagttgcacaaactgggtggtttaaaaacagaaatgtttcgtctcacagttgtggaggccagaagcttgagatcaaggtgttggcaggaccacactccctctgcaggcgctggggaaggtctgtcgcaggcctgtctcgcagcttctgatagtgcttggctggtggcagcctcactctgctgcctttgcctgacgttctccctgtgtgcctgtctgtgaccaaacttcccctttttataaagacacctgtcctattgcattaggggcctacccttctccagtatgacctcttcttaactaattacatctgcaacaaccctgtttgtagataaggtcatgcccttaagtactggagcctaggatctcaacctctgtttctgggggaaacgtaaattcaacccacaacaagcaagcagcaccttgtgctactaggcgtcagctggcagtacctggctctgttggcattccaacagcaatgacagcacgataatttattaactatgatgcttacatggcaaatgattctctcttcccctatgccagtgtttactgttgctcaggctgagcactgcagcagcccattttcctgaccaagggcatgctgtgtacagtggtgtggccccaaatttgatcacacactccatcaattaagaaaaatgttttctgcatgcatccccagcatatgagtattcattttaaaagtatacatgtgcactgcattaccactatataagttatgaaacatatacaaaatgaatggtaagatatttgataaagatgaaatcagcagtattttaaatgtcttgctatttctagtgacttggtactatcattagctcatctcaaggtccagatacccttgagatgggatttctcgttaatgattcaggatgtaaatctaaatttctaatgggcttccaggcaatttcaggttttgttggggagagctgcttcttgtcacatgtgactaggttgttggtatttgtaacatggagaccaatgacgacaggcaggagcgcttccctttgcttatgttcacttgtgcttgtattgagattaacttcggcctccagaggttattttttcaggaattttttttaagctacttgtccattttgtaaaagttagcttaaattcactctaaattcatcatctgagcacagtttgaggcacttgggatatattgaggatgatactagagaattgaactcattaccccgttaaccagatggagtcatgggtatgttgcaagacactgaaagcagatgaagggcatggaggcctttgggtggcggccccacggcttccctgggagctctcaggaccaggaggccggtgagggacagtctgcctgggggccacatagtaaatagtggcaaagcttaattcattttgtttctttagataaaaaataaatgtaaatagaatatatcttcatgtttagctcattttcccagctaaataattgccttcttaagcacatgggactgccttaatcatggattaattcatcatggcccaataccacttttgttgttgtatataatagaaattaaacatttctcccaacacctgtggatatgtgtattttagcatgatcagtagaaatgacgctgtgagtattttaaggagttttgctcagagtcgccctaggaacacagggtaatagcactgtcaggattcccagtgaatctagcctgattcctcctgtcctggaggtggatgccagagaaaggcttgaggctggcaggcagtgaatcaaagcctcgccacagagcggcacagcatatgggtacccatatgtccgagatcctggctgaactccttagatttggggataagaaagaaagtgcgggcggccaggctttcctctagggccagtggcttctggtaataggctttgagacagtatttgtacaactctggctacataacggatgtggaaaccaggtgtgatttatgagcttccgaatggccccttcctgctctctctccctccacaggtcccagcctccttctaagattgccacactcctatctacaccggcaggactgttttgatctgatggaaggagggaagaaaggaaatggggctatcagttctcccttccaggctctgctctgtgtgtctgcactgcagtcatcctcttggaacggaggctcctttgtttttatggtgtgacttgaaaggttgcactatttatcaggagtgttttcttactacataaacatatgaactgaatttaaatcaactctccagtgcttggattttatagaatgaaatatgtaataataaccacatgaaagtaagagcccttattgagtttattacattaaaatgactaggcctgaagtttttaagtactttttatctagataagccctgttgacttcaattgtctcagaaggcatagcactcagaaaacacttgctgaatcagtaataattatcttggactttgattctctaaagataaaatagtcaattaacttgattacttcttattttccagttggtgaaaaaaggtgaatgcagtagtagccatgttggggaagaaaattctttatcctcacatgttctgttgggccttcccttctctctcggcaggtgtttactttgattttttatagtgcatatcccctaaggcaggactgtagtcattactgtggaattaatacgggctggagtatcaagggtggtgttctacccaagggattctcatagaatcagcagatttagagttggacacaacctgaggatcacttaatccaggtgctcctaaatggaggccttgagaggtgagatgtcagattttgctaaagatccagaaggatctagataccaaaagtgaaacatatattgggtagcaatccacaaagttttttgtgttaaaaattagccctcgtcctcttctgggcatatacccaaaagaattgaaagcagcagggtcaccaagagatatctgtactcctgtgttcatagcagcactgttcacagtagccaggaggtggaagcaactcacgtgcccatcaacagatgaatggagaaacaaaatgtagggtatacacacacacacacacacacacacacacacacacacacacacacacacacacgcaggaatattattcaaccttaaaaaggggaaatcctgtcatatgccacgtcatgggggaacctggaggtcattatgcctagtgaaagaaaccagctaccaaaggaaaagtactgcatgattctatgtatatgcagtatctaaagtagtcagactcatagaaagttagaatggtgcttaccagggactgggggaaagggaaatgtggattagtgtttaatgtgtacagagtatcagatttgcaagatgacaaagatctggagatctgtttctcaacaatgtaaatatacttaacactactaagctgtacacttaaaatggttaagatggtaagttttgtgataagtgttttaaccataataaaaatatttttaaaacaaaaaacaaggcccttgctgctgtggtaagcagtttgatggaccctcaaaaagctaaacagcatttccatgtgacctggcaattcccttcctaggtatacactcaagagaactgaaaacaagtgctcaagcagaaacttgtacatgaatgttcatcccatcattattcacaatagccaaaaaattgaaacagcccaaatgctcatcagccaatgagtggagaaacaaaacatggtaagtcatacaaagaatgaagtgctgattaatgatacagtcatggaggaactttaaaaacattgtgctacataaaagaaaccagacaccaggccacatattcaacaaggccatttatatgaaatatccagaataagcaaatgcatagacacaggcagcagatgactgattgccaggggctgaggagaaaaaggggaatggtgagtgacagcttaatgggtatcgattgcttttgaggatgatgaaagttctggaattagatggtggtggtgggttgcataacatagtgaatgtattaaaagccactaaattgtataatttaaggtggttaaaatggattttatgttctatgaatgttacctcaataaaaaggaagtccttaggcatgaaaattgggaaccatggctaggttcagcctgcacattgtcatcactgagaaagcggaagctcactgtggtgacaggactttctggaggtccatggctgaactcctcagggacatcaggactcttcagggttggggagagaggcatctcatgcagccaggctgcaggcccaggcagcaaggacacattgactccttgaagaagtctcaggatggggttgaccacaggagaggtgggtgcctggggcttttccagggccacctctctgccctcctcctagagcagctgcctccacaggctggcagagggttggccatagtagatccatgcttcacacccagacaagtggcattgagaggaagaaacaggcatcttctctttcatctctttttaggagcaagtaaagcttcgccagaagccccctagcaaactcattggccagaatcaggtgacctgcctatccctaagtcagacattgctaagattgccttagatatgtggtttacagtggcatggaggttgggaagtcaggcacaaagaccagcaccacaggcagtgtggccgggcagaagccaggctagggaggtctcctggagtagtggggatgagcaggtggcccaggtctttacagaaaaggaatgaagtgcagggagcactgctgagccagatgttaggacctggagcctgggcagtgaggttcaggaaccctcacacagggctcgggatccaaagccaatgcagctggtagcaagagatcagaatccaggtccagggtctgaggtaaaactggcaccagccaaagccatggagagattcctccctttcctccacccgcagggctctcagtagagaaagattctccccaccagggctctcaatagagaaagattccccccaccagggctctcagtacagaaagattcccccccactagggctctcaatagagaaagattccccccaccagggctctcagtacagaaagattccccctcactagggctctcagtagagaaagattccccctcactagggctctcagtagagaaagattccccccaccagggctctcagtccagaaagattcccccccactagggctctcaatagagaaagattccctccaccagggctctcagtacagaaagattcccccccaccagggctctcaatagagaaagattccccccaccatggctctcagtacagaaagattccccctcactagggctctcagtagagaaagattccccctcactagggctctcagtagagaaagattccccccaccagggctctcagtagagaaagatttcccccccaccagggctctcaatagagaaggattccccccaccagggctctcaatagagaaggattccccctaccagggctctcagtagagaaagattccccccaccagggctctcagtacagaaagattccccctcactagggctctcaatagagaaagattcccccccaccagggctctcagtagagaaagattcccccctaccagggctctcaatagagaaagattccccccgacccgggctctcagtacagaaagattccccctgacccgggctctcagtacagaaagattccccctaccagggctctcaatagagaaagattccccccgacccggtctctcagtacagaaagattgccccaaccagggttctcagtagagaaaaattcttctcgaccagggctctcagtagagaaagattcccccccaccggggctctcagtcccccactcttgtagtagatttgtataggacagggtttcgtgtcctcataattttttcagcagcagcccttagctgttttccctggcacgcacatctgagcatccactcgctgcacgtgggcatttgcttattcccctgatgtctgtaagtgcctcgtctgtgccaggtactctacacagtggggacacattagtgagcaaaacaaaatccctcttctcacagggcagccatgccactgggaacaacagatgataagcacatggacagctgaagatgagctgtggcaagtagacttagcaatgctgcaaagaaagcacagaaggcaaggggcagtgaagggtctttatctcctgagaaaaccgcctgtgaggacagcctgattgaattttcgtaaccaccattaatggtagccaaggccttctgcagaatgcatgtggaaagaggaaatgaagacagatgctagggtagctgtcccaggacacagctgtgcaggcagggtcctcgtgggcccacaagtgcatgctggagctcgccaggcaggctctggcagttcctggatgtctgagcacttctgcttcactgttaacttggggtcgccgtaaggatgaattttctgttaaggggaactggagtagcatctctgtggacatggcttcaggatgtatgggcaagcctgaggctaaggatcctgcaaactaggcacgatcaagagtgtttggtgtgctagtcagaatgtggttggctgtagttgctctggcattctaggtagggacaaccgaagaaagaacactggaaaataggggacatctttggtattccaagaatttgacaaaacctctaactagatcactttgaatttatctaagtcaggaataaagaagattataaatgacatctgttgagcattcctttgtagcagtttcagagtgataatgaaatttagggcaatcttggccaatctaaattaagagaagtaattgctgtttactttttgggggagcatcgtgggaggtaggaaatgaaggggagggaagctaagatgatggagtagaaatacacatgttctgatatgggtgcctattttcaaagatggtggtggggtataaagtttgtttgattataagagcatgaattcattgcatttatctaacattcctacctacagaacagcagagcatgacctctgtagctaaggttaactttcagctatacctggcttcagtggaaagtgggcatgagggaattgttttgacatttttgaaacctacactctttgtgggaaaagggttgttgataccctgcaatattaaataagttccgtgggttgagaaaaaaactaggacaattaacaacatggatgttgtcaattaacatgctgtttaattaacatgagaaagttgatactctttgaacctaaaagagcacatagaatttcgataggtggaaatatggtgaatctgtactggttgggggaacagcatcaatgttcattttgaaaaaagcagaataaatgatgtcattgattctggggatggggctgactggccctctccccctgcctcttcctctccgcatctctccccccaattcattcacactttgacacaagggtgccacgtaggggtatctctccagaccttcttcgtgggttagcccctcagccccctgtccagtgctgtggtcgtgatcgaaagttgtatctaaggcaagacatgtttttcctagtgtgtgattaatttgaacccaggagtttggtgattgtatctgtttacttggacttactggaaggtcaagttttctcaagaacattaacaaatcagtaaaattatcaattagtagcactgctttaatttcttaaactcagaattgacttgtccatacatccgtttatatttaatttccctgaagctctgaaaatagggcaaaagaacatagtcttggtccatcagaggtcttcttttttgtctttttggcctatcctttgggctcagtctaaatctttcccccaggattttaagtaactccacacttaaggtttctaaaaagtagcagtgatagctgaaaacctaatacagactgaaaatgaatgggaagttcatataaatcagtcataaacacatcaaattcccagtgaattcaaaagaagatgaacaaataattctcaaaagaataaatatttgtaaacaaatattagtaaataaatacaaaaaaatagcatttcactttctgatatccaggaaaaaaaagtaagttacaaccgccttcatgttcttttctttgcctgttaatcatagacagtcagccttctgtatctgtgggttctgcatccaagggttcaacccacggcagagtcacccaactgtgaactgaaaatattcaggaaaaaaatggatgattgcatctgtactgaacaggtacagacttttttttcttgtcactgttccccaaacaatacaggataacagctatttacatagcatttacatcgtatcaggaattgtaagtaactggagatgatttaaagtatatgggaggatgtgtgaaggttatatgcacatactacactattttatatcagggatgtgagcatctgtgggattgtggtatccacaggggtgctggaaccactctcccatggatgccaagggatgactgcatagattggatatctcaatttatactcccagaaacatagcagattgcctacatacagcacaccattttcgtccctcaaactctgctcccctttccatcttgttactaggctctcataacttggatattgagttgtccaagccagaaccagggaatcaacatgtatttctccctctccccagtcccccccatctaaaccctcagaatgaagtcgggcccttgagcatcaggagcaaggcagcaggccccatccccaccaccctctcacggccgactgtcagggcttcctgcctggcactcagaaccagccaatccaaacgtcaagtctcagcttggaagccagccccaggaaccctttcctgacagccctgccttcatcagggtgtgctgacccctgtgcgttcccacaggcacctgggacttcccctctcatgacactgtggttccattgtgggtggttctcagactacaagctcccccggggcagtggccaggtactgttgcctgctgtgtgccagccacccattctcctgacacatgggcacattgagagacagttcctatggacatgtcatgtttctgcacagtccaggtcctctgagcaaagacatttacagccaagttaataatgttcgtataaggagacattttaggacaatacagcttacagaagtttcccttccacttccctaaaacagttgcttacattccaggatcaagctaagtctctgtctctccctctcgacagtggagagggaaggtcaccagcagccctgtacaaggtcagcgttccctaattctggggcttctcttctgtgatgattccactacatgcataagtgacacttggccctcaccatgtcacatcactgtggggactggcacttagcaaactagtgctaagatgtcgttctttctgctctctctgactcagaggtcttgcaccttctgttgtgaacactcatactcacacacacacacacttttccacacacatgcacacacagtggcaggctgacgtattagctgacaagtgacataaaacctcaggcccttcacaattttggatgtaacgagggtaagcttggagggtgatatgactcgcctgttgtccctcagctaagctgaagtggcaggggctgaagagcagtcagaaccccgcctcctgggccggggccggcaccttcaccgtcacacctctgcctcctctgtgtgaccaaggagcctcccaaacttgaatgcacttgcagatcacctgagaatctggtcagaatgcagattctgcctcagcagggctggggtgggcctgagactatttctcatgagctcccagagttagtggtgctgcttgttccccaccacgctgtgagcagcacttatctgagacacacacaccatcccagtctctgcaatgcaagtgaagcctacacatttcagaaatgtatgaacactgtgttaaagggagaaaatggttcatgaacagtttattctttcactgtgggtgagtaatgataacttcctaattggccaccatatttataaggactccagaggggaggcggaagagagtataaatgacaactgtccaacaggcagaattgaacatttttttccatgggacttgaatctattttgaaagcatctgtcatgtgtcctgttgactttatgattatgtctcaacttaatcggtccttggggaatgagaagtttagaagattgtccccagtatgacttaagcaattcagcagtattcaggaagtctaatagccaaataacagcaaatacagctacctttagaccaggtgctttacatacttagtcttattagtcttcacatcctacaaggtaagtggtgggactctcttttgtggtcaggtatatctactgagaaagactaatggcatgcctaaggtcattaccaaagtaactgacaaataagatgtgaatccaaatgtgtgactccaaagacttccagtctcctgcccaccgtttctgctctgttaactagtcaccttttcccaaagagttgtggggaaattattgagaagaaagcctaaaatcctacttcaaatgtttaagttgagagacatcttttcagcactaggattgtattattagggactgctttccatcaagctcatttaagacagaggagtttcagtgattttccttctaccccaattgtcaactcaagctttgtggctttataagacaccacggcagtgttggagcagctctgcagcggcaccggcttctgcagaggctccctgcctccacctgaaggtcagcagctgccctggtgagtcttcggatcttgtgggcaggagcctcagaaccaggaacacaacaaccactcagaaacccctggcccagcgtgcaggagcccacacgcctcaggactggagacagcccgagctcaggacccggcataaccatgtcagaggctagcgattggagactttcaaggcgctgcaaataaaggaaattagactggaaaagtacaaacgagaggaagctggagccagggttaaaaccaatgactcacctctaccaaattcatgatgacgataagtggaaaaaaaataagcctgaaatgggaagggtggtgccaaatgggcccaaaacaaacacggctgaagaatggaaggtttgttttcactttgccagggattccaaatgtgatcagagatagaaacaaatgcagccctttcccagccttagcgaggccaagcccatggggtgttgggtcagaggggagcctgaaggggagaggggggaggaagaagctcaagtcagcacacagctgcagaacccccaccttctcctcctggggggagtagagagctacaccccctggcggctgttgggtttgtcagagcttgactctgtccagatggctgcgcacccgggttgagaggccctggggagcaccagcactcttccctccaagtcactggagccctcatccattagggacacagaaccagaaaggaggaatgtttcctctgcagctttagtttgaccccacctaggctgagtctttggtctgttagttcatgtgctggttatgactttttgaaaatcttggaccacatttatgactcttaagcaatttaggtacacatagtccacaagagccagcctcccctggtctacctgaaatgtgtgtaaagcatttaatctaggaaagccctaagctgatgggccctggggtgctggcctattgctcctgggtggcccctggtaaatcatgaacctttggtgcctgtttcctcatctgtagtgcaagatttgtgcatgtgtctctttctcttatgggacttttatagagaaaagaaaatgagggaaaaatatgaatatctgtaagctttgaaaagaactaaaagcacagcgtgaattaacagcagtcccatattcatggggtttctgttatagaggtggaaccttgctagactctggagaaaataagaaaggataagttagtcctcaagaaccttccagagatggattaatcctcactgaggccatctgcattcctttggtggcagagtagttcctgggtaggtatttataaatcatttcaggcttaaacaggattagaggtgctgtgcttttaaattgttttaatttagagtttttaccagaaattattgtataacattttgagggtagcacaaggaaatggattgcctttgctgtatggtgccttgaacacatcccacaggtttacttttttgctatatgtttttttctgcacccaaacaatgcaccgtttgtattttggcatttacttcaataatcttccaaatagacacccgcaagtacacttggatagcagacagtcccctaagatacagagcaagatgtgcgactctccttctgtatccttaggagctctgtcaacatagaaggtgtcacaactcagcattgtaatgaagatgaagataatggcatataataacatgtagggccaactcagaccagagatctttaatgaggtaggagtttggtttcacacattcttttgctttagtatctggcctggagcctgtgatagaatctctcctcagaaagggctatgtgttaattagtgactgtaacatgctgcctttttctttacttaaaatgctcaagaattgttttgtttcttgcctgggtcttcttaatgattgtttcttatgtgcctccatcccttctctgctatttctttccccaatatcccaatgaaatgagcttcacgagagtagttttgcttggatgacccaaaggagttaagtactatttccaaggttttgtagccactgaattgttcttacaaggcatcgtgctgcaaagcaaggactggcctagaagacctgagctgatcgctgtactaatagccagctgaggagctctgtgcaaatcaaattatatttacaggatagactatatatagggcgttgaattaattgccatggtttttatcattcttatgttctaattttttgacctgatgtgctattaatacagtatcttcccttttctatcagtgtgagtttgttattgtaaatggtgttttacagggactgaacatttagcttttcttttttagttgcttactcttttagaggagactgtgatggcaagagggaggagacatggcaaaatacataaggcatatctgtctatatttctttggcattgacatttcatcaagggacatgactctgaaagatggctgtcccttctaatggctggactttgcggctgtagtggccagaagcataaagacgtgtaaagaggatttttcggtacatcgaacactgaatgtctggctatgcagcttctgtgattgatattcggttctgtgggctccttccttcttaagtgcagtctgtaaaggatggtggggaatagtaatttcaagaaagatttggcatgagtatcagtcgttgggtggtgggtgtgagaagggcgttgctattggtgggtgaagtgttgtcacttagatgttgtcattttcccccatatagttttcattaaggtgacattgctgtggcatctgggtccaggcagggtatagcagccagcatctgaccacttgcagtcgtgaacatatatatatatgtatatatatgtgtgtatatatgtgtatatatgtatatatatgtatatatgtatatatatgtatgtatgtatatatatgcatgtatatgtatatatgtatatatatgcatgtatatgtatatgtatgcatatgtatgtgtatatatatagagagagagtttattaagtattaacttacacaattacaaggtcccacagtaggctgtctgcaagcttgaggagcaagaagagctaggtccgagcctcaaaactgaagaacttggagtccgatgttcgagggcaggaagcgtccagcatgggagaaagatgtaggctgggaggtgaggccagtctctcgcttcatgtttttctgcctgctttatatttgttgatggctgattagatggtgcccaccagattaagggtggatctgccttctccagcccactgactcaaatgttaatctcctttgacaacaccctcacagatgcacccaggatcaatattgcatccttcaatccaatcaagtcgacactcattattaaccaccacaagtccatcccttgtcaacttgaacccatacacatttcctgagatcatacataatcttcaaatacaataagatcataattacacctaacataatacaactatcctttgtactaccagaaacgcactgatccccaacccaaatactattacataagattagcaatacttaaatgctgatatgaagtcagtaaatcttatgtcacacaataaaggaaaaggaaatacaataaagatattttcttagtacaagtgtatacatgcacaaacatgtttttagcaaaagaaagaggaaatactcatgacaattacagtccccatttctggagccggaactggtcacatggtcgtagctggtattgatgactaccttcttctacccaatctgtattccctttgccttcagcaagcacctcagcaggttgtggttttttccctgcttcattcttgaggggtctgagccatttgtagtcctgcctgggttgggctgttgtagtttcccgtcgaccttaatcacaggcaatggtaagactaagagacaccctaatggatctcctgtattccatgcatactcttccttatctctgttgtggagttgtagactgatttcatctagagagtctgggtcaatcaccccagccaacactgtaactcccttcttaccctgttgacttaaggtaataagagcccaaagtgtccaggcaatcttaacttcaagtttaatggaatcattgttgtgtctcctggtagccgcgttcctccctttggaactaagacctctaggccagcagaacataatgttgtgggaacaggaagcaaaaattttgccagtggatcattaggggtgatggtgagtagtgccacttccacttccacctcttagttcctggacccgtgaatcctggctgtgggagaaacagtaacatatattggaggctgactgagagcatacacagccttttggagaactttgccccagccctacaaagtattgtcacctagttagtgttgtaattgtgacttcaaaaggccactccactgttctatcaatccagctgcttcaggatgatggagaacatggtaagaccagtgaattccatgagcatgagcccagtgtcagacttctttagtcataaagtgcgtgccttggtcagaggcaatactgtttggaataccatgacagtggataaggcattccgcgagtccacggctggtagtcttggcagaagcattgcatgcaggataggcaaacctatatccagagtaagtgtctattccagtgaggataaatttctgccatgatgccatcttccatgatggaaaaggtccattataatcaactagtcactaggtagctggctgatcaccccgaggaatggtgccgtattgagggctcagtgttggtctctgctgctggcaaattgggcactcagcagtggctgtagccaagtcagccttggtgaatggaagtccatgttgctgagcccatgcgtaacctccatccctgccaccatggccactttgttcatgggcccattgggcgatgacatgtggctggggaaagaggctgagtggtgtccacagaacgggtcatcgcatccacttgattattaaaatcctcctctgctgaggtcacccattggtgagcactcacaggggatacaaatatcttcacagtttttgaccactgagagaagtccatccacatacctcttccccaaatttctttgtcaccaattttccaatcatgcttctttgaagtccctagccatccagggtgctttctgacccatcaagccataaagtgggtcatgcacagcagcattccatcatcaaatggaagtgatgtaagtatgactgggcttgaggaagtcctgaaggcacaagtaagttacatgaggaagtggctcaaatgcccatggtctccttggtcagaccatatggtcaaaggtattatgtataaagtcaataaacttgcttctcacaaacggtgaatcagaccgcttggaatgacctccctgaccatccagccaaaccattggctgcagcccatgaatcagtatgtaatcacacatttgattatttctccttccatgcaaagtacacaaccaggtgcactgctggaagttctgcccactgggaagatttcccttcactgcatccttcagggatgtcctagaaaggggctgtagtgctgcagctgtctacttttgggtggtgcctgcatattgtgcagaaccatctgtgaaccaggctctagtcttctcttcctctgccaactgatcatagggaactcctcatgaggccatcagtgcaggctgtgggagagaaggcagggtggcaggagtggagaccatgggcatttgagccacttcctcatgtaacttacttatgccttcaggacgtgctcaagcccaatcacatttatatcacttccattcgatgatggaatgctgctgtgcatgacccactttatggatagatgggtcagaaagcacccagttcatggtaggcagttcaggtcacatggtgacttcatgacccatagtcaaatgttcagtttccaccaaagcccagtaacaggccaagagctgtctctcaaaaggagagtagttatctgcagaagatggcagggccttgctccaaaatcctagtggcctctgctgtgattagcctatggggccctgctgtaggctccaaacagcacccctatctgccactgacaactccagcaccgttggatctgctgggtcatatggcccaagtgacagagcagcttgcatagcagcctggacctgttgcagagccctctcctgttctggaccccactcaaagctgacagcctttcgggtcacttgataaatggaccagagtaacacatcaaaatgaggaatgtgttgcctccaaaatccaaataggccccctaggcattgtgcctctttcttggttgcaggaggggccaaatgcagcaacttgtcctttaccttagaaggaatatcttgacaggctgtacaccactggacccttagaaattttactgaggtagaaggtatctgaattttagtcggattgatttttcattctctggcgtgcaaatgttttcaccagtaagtccaatatgtttgctacttcctgctcactggatccaatcagcataaggtcatcaatgtaatggaccagtgtgatatcttgcagaagcaaaaagcaatcaaggtctctccgaataagattatgacacaaagccagagagttgatatacccctgaggtaggacagtaaatgtgtattgctggtcttgccagatgaaggcaaattgcttctggtgggccttatggacagaaatggagaaaaaggcatttgccaagtcaatggctgcataccaggtaccaggagatgtgttaatttgctcaagcaatgaaactacatctggcacagcagctgcacttagagtcaccactaggttaagcttatgataatccactgttattccccaagatccacctgtcttctgcacaggccaaatgggagagttgaacagggatgtcatgggagtcaccacccctgcgtctttcaagtccttgatggtggcactgactccgcagtccctccaggaatgcaatattgtttttgatttactattttcctagatagagacaactctaatggcttccatttggcctttcccaccataatagccctcacctcattagtcagggagtcaatgttggggttctgccacctgctaagtatgtttatgccaattatgcagcctggcactgggggattgaccacaggatgagtccagggacccgctggacccactgtaagtcagatctgagctaaagctccgttaatgacatgaccttcataagcccctactttaactgaggaccacaatgatgttttgagtcccctggaatcaacgtcagctcagagccagtgtccagtagtccctgaaatgtctgatcatttccctttccccaatccacagttactctggtaaaaagccagaggtcaccttggggaaagatgggagaaagatttgttgcataaattgttggtaatgtagtagggtccttcctcaaggggacccagcctccccttcattcaaggggttctgggtgtgtaaactgactcaagtctggaaattgattgaggagccgtgattctgtttttctaattcaaattagtcttttatccatttcacctagaagctttccgcttgtataaattaagtaggaatgcagtaagcttcctatcaatttcacttctaggaacactgtgattaattagccaatgccatagctctacactagtcagactattctgattgcctcattgcctctgccgttcattgtcgtagctgcacccaccttgcctttgatggtcgagtgctgccacttggcccctgccaccttggtatctaattagcaaacagaggtattggggtggattctgaggagaatcaacattatcttgcctggcaactgcctcagaagaggtcatcactgttccctcaggcagcgcagggtttatctcctcagacagaggtgcaaaggctggtggcagcatgggtcgggaaggggatgttgccactactgggaatagggaaattccttctggcaaaaatggttcatcagagtttacaaactcagtgtgcccagcttcatcagggtcctcccaaatgtccccattccaagttgcagggtcccattcttttccaatcaatgccctcactttaacagtagacacctggcgaggctgtgcacgaaccttttgtttcaggtcagccactcacatcataagggcttgtgtctgtttttccacaatttcagctctttctctacaggaggtaagactctcactcagggcaatcttagcagatttgaggttcagtatctgcttctgaagcccggagacagaatccctgagttcatcattttctttcatcagtttgtccactgaacttgggagcaaccaacaagctgcattatgttccttggttctccacatatggtcaaaggtattatgtatagagtgagtgaactccttgcttctcacaagcggtgaatcaggagtgccaaatgcatttattttgcataagtctaaacagtttccgcctaggacttatcagtattctccatactattagaagcagagtccttagcattttggggtctaatcatattaagcaaccaactccagaaaccccaaaaccaatgaaagaactccatccttaatattctgttcctctacaaccactcctggtaccaaaatctgtattcctcagagttccctagagggacagaactaataggtagatacatacatataaaggggagtttattaagtattaacttacacgatcacaagttcccagaataggctgtctgcaagcttgaggagccaggagagccaggtccgagtctcaaaactgaagaacttggagtcctggagtccaatgtttgagggcaggaagcgtccagcatgggagaaagatgtaggctgggaggctaggctagtctcttgcttcatgtttttctgcctgctttatatttgctgatggctgattagatggtgcccacccaattaagggtgagtctgccttctccagcccactgactcaaatgttaatctcctttggcaacaccctcacagacagacacaccaggatcaatattgcatccttcaatccaatcaagttgacactcagtactaaccatcacagttagtataggggtggagggagagaaaaaatattattttttcttactacccacagatatctagacttcgaaggagtttactctgcacgatagatgtgttcctgaaaagttcattgaaagcacaatttctcttagtcgcattttatcttcttaccagcagtttcagggcttatccagcttcattctgcccgctgtttcttcaccgatggagctcaatgtctgtgtcccctgtcacgttctcatcactttgaaaatgggaaatgattggcaggcaaccctaggacaccacacttctaaaactggccacagctatcagctaaagggagcaatgccaatatgaggtgggcccacattgtgtgagatggaaattaatgaaagcagccctgggttgatactcacatcctctgctggagaaattaacagcagtgtttatctctgctaaatctaggcatggtgtattatcgagaggtttcctgtcaggtccaatttgggatcatcaaattaattgttacgtgtgacaagctgacatgcaaagaaagcaataaatacctcagtgccagctccttgttggaattccatggtgagttcccagggccagggggcatgaatgataaatgaggctaacagcctccctgcctacagcagcctgccctttctctccgtggcatcggaagactcacccctgttttccttgagaccttagttaactcactcacttcctaacaactgcgttaattcttcttagcatttttcttttgcttctgagaggtgctatgtacctagaaatgacccagcagcttcttcaaaagtacctttgctgggtcttcaggaactgcctggtaattgacccacaagacattgccagtttgcctgcgtttctcaagctcagaagattttgctgtaggaagcccccggcagctcaggcttctactccatgtccccaagggtggagtggtgcaaggtgtggccaggcactgtttagaactggagtgagtggcacctggaggtgggtggggcatcagcctgatgggttggaagttgctcctgttgctgtcctgggccctgtaatctggctgccattcctattacttcacaaatactccctagtgcaagtacagcagcatccttccaaggaccaaacccaagggacatcaggctactgtgtctttaacctctccaacattttacatttggggcctcctcctctcctccaaaaacaggaactcagcaactgtccatataactccctgcactttggacacaagcaaatttaagtcacatttgtggcacaactctggaagacacagagacccttatggcgtgcatatctgtatattcgtatgtgttagtccatttttgccctatagcagtgcaaatacctgggaatacctgagactgggtaatttataagaaaagaggttgaactggctcatggttctgcaggccgaacaggaaacatggcaacttgtgcttctggggaggcctcagggagcttccaatcaggcagaaggcaaagggggagcaggcgtctcacatggtgggagcaggagcaagagagcaagaggggaagtattacacacttttaaacaaccaggtctcacgagagctcactcacaactgtgaggacagtaccaggggggtggtactaaaccgttcatgagaaatccacccccatgatgcagtcgcctcccaccaggcccagcctccaacattagggattatgattccaccatgagaattggtgggacacagatccccatatcaccatgtatctgcatatctatgcttcctcacttttcaaatccttttgaatttttttctgtatatttttcctgactttgtttttatttgtattacctgttttcttgccgtaagaagtatgaggtacagttatcaaaatattactttaaattgtaattttttttaagatttaataacaaggtctcctgataggtctgatcactgccatcactttagagtagtgatgaatgtcaacggtaattctaggtatgtgcaacaacaggaatgtgatataaaactattaatatctgtgatttctattgatgaaaaaattacaggcactgctgatgctgctgagttcaccctgagaaggccggctaaatatcagtcagatgtcagtggagataaagatgtggggttggctggtttgttggttggttttcccccagcctagttcatgggtgtcctgaattttatttctgggcccattagattaagaatctttaccttatacctcctagatctgtgttacgtcaaaacatatatgtctactctcattttttattacatcagacaactttccaaaggtgtggatctcagcgtgactctcacggttctacaccccatatgccctttccatgtggaaagaacccacggcctagtttaagtgattccattgcaaggctgctttgctgcgagtcctaattacccttttcattgtcaaatattaagaggaaatacatgggcagcctgatgggatcttgactgctccctgacgttcagttctcagacctctgctttcttctgtttaccgtccattagagaacttgcatgttcccgcctttgtcatcacccgaatgaggaataaacacagcagcacttgcccagccccgcttccccgccagagcacaccaggcgtgcctgctggctggagggacggctccttgctggtccagctttacctcagcctctagtggacggagtgcacagggcttggggcaggagacttgggtttgagtaccagctttgggacctgttgcctgtgtgattgtggaaaacacttcagctctcaggggggcttcttagctggaaagtgggggtaaaacagtaacccctgtcagatgagaagatgccagccttgagcaagataaagcacgttatgaatggctgttggtggtggttctctgtttcactcttctgcctccctcattccctgctcctcctgggcttgaaaatcagtcattgtgatctcctcctctgctgcccagcccagtcctgctgtcgtgcctggaacgtaactcccacaaggaactgctctgactgccacagatcctagacttggttagccacagaacctcttactggtcaccttgtctcagtcttgccctagtcagttgaccttcgattccaatgttaggttgtcttgctgagattccagtttccccaccctgtaacctttgcttcctaggaatcgattatggagcctttggcttgggaaggttgcctgtggagttcatcctgagagggcatgttaaatatcagtcagatgtcaacagagataaagatgtaaggcagattggttggctggttggttggctggttggtcggctggttggttggttttccctcagcctagttcatgggtacatgtgtcgtatggaggcctgcactaatgagtagatgccttggggtccacctcaggcttctccctcccccacttcaataggagccccacctagatccatttgatatcttgaggttccattcagatttgatgttttaaaacaggatctactgctacagacagagaagttgataaccactgaaagagttcaatgtagtcattctgcaactgaataacagaagccctgagaagctaagggcattcccgccagcttcaaggctaatgtgtagacccacagggcttcccttgccctagtctagaactctctcccctgtgccatgttggtcctgtgggttcctgccctttgtaaccggtcatttaaggccctgcccagtctcccccaccccatccagccctcctcacagacatcaatgtctaccttttccatgaatcaggacctgagaggccagaatctactcggcagaatacaccgtgctcagtcctcctctgcacctctcctgcccttcctatgtggaggggtctcccagtccctccataccctgaattgtgccggtccttccaggccccactgaagcggctttttcaaagccttaccttatgaccccagcccacaggagcttcccccatccgaattctttctgcacatgctgtgtgtgttgctgtgttagtttgctagggttgccttaacaaagtgccacagactgggtggatgaaacagcataagtttgctgtctcacagttctggaggttgaaagaccaaggtgtcagcagggttggttccttctgaggcctttctcattggcttgtagatggccgtcttctccctgtgtcctcaaacagtcttctctctctgcctgtctgtgtcctgctctccccttatagggacaccaatcatattgggtgagggtccaccctaatgatgttgttttaacttaatcacctctttaaaggccctgtccccaagtagagtcacactcagagattctgggagttaggacttcaacataggaatgtgttgctgggaaggacgggggtgaaattcagccagaacagcctctcacttggcacacagtggttgcctgcctcaagtccttcctgccctgcctggtcctgcgtttgaggaaggattatgtagtatattactttgtacccacgcagtgcttgcaaatgctagacacatgtcatttttcaatgaaaaactaacttgctcttgagtcccaaacttgggtttaatgaagccagtgaatcagcagttcttgaggctctattcagagcactgtgtgagaaagagtaaacagacgtcccacccagagtaaggtggctgaggtctcatcaggaagatggggatagacagttggagggcagggtggtgagaagcaccgactccaggaaacacaggaagcgctgtcagagttcagaggatttttaatgccgatagagtaagagagcgtagaagttatggctctcacagagcataaacgctggaggtaggtgcacgtgtgtcctcagaggaccagtgtgggggcagtcattaggagaatcctgtaaacactgctccttcctcaaaccagggcagttacgccccggtgagaccacctttgtctccagtcccaccctgtctgaggctggccttcatagagggtggatgcagacatggatcgcctggcatcagggcaaagttcaaatgaaattctgatgaaggtaaaagccccaggccaccccgggtgagcggacttcagccaccaactgggagccatgcgctgctcttggccctgctgatcccgaggtctgctcacacctaccttccccttgctgtgtacagcagagcaaaacccttttctctcccctcatttcaaaacatgggagtgtggaccccatggccatatttatttcacgttgacaacttcagatgtttcaagagttcaagtcttagattcactgatgtttaattaaagacctcagttgttatttattagctgcactgccttttctctttgtctcttctgtcctcacacaacacactccagggtaaattcatttcagccacagtttctcacaccgtgcctctgcggacaacccctcagccctcaccacttcccctggctcagcttggtattgctaactgggcagcttgatgcagatgcctgagataccttcagttgtcccagacaattccatttgcccctccctttcatacctgcttctcactgactccacagtgtcccttaacacccggtgattgggactcaggcacaggtgcagggctgaaggacactcccagcctgcttgccctgtcacccgcagaagtcaaggcacgtcctgccttcagggcaccttctccagccaccctcccaggctctgtgcttcccaccagcccgtccattggtgtggaccctcgtgccttcctctgcaccctccagagcacacccatcatcccaccacacttccaggcccgatgccagaggcctcctgacctcactcagagcgctctgtggcctctaagccccatgaaaggcttctgtggccccctcatggttctgtccgtattggggctgtggacacgtttcccaggaggcctctcagtgcagtggggtgaacacagagaacaggagctaaacctgcctctgccagggccattctgtggcttgggtcagataactgcaactccctgagcctcagcttctcatcttggagatgggcctgtgatatccgtttacaggacttttcaggggatttggtgtgattgaggctgtgaaggcttccttatggcccctggccaaaagcaggccctcagaagggccctagccacctctccctgaggcttcggggctggattgttttgtagccgagggaaggggaggggtcgtttgctgaggaagtgatttttccctgttttgtttctgaaggtggaggtgacggaaactcccaggcagcccctttatgtgggcacttctccctcatcacagagcctggcaatcagcctcgagcagcgccagcatcacctggggctggttacacacagatcgctgggcctctgtgtttgaggaaggcttatgtagtatatagaaatgtgcattctgaccagtcccaggtgaatccataccgatgccctgggtcccaggacatcattgccctaaagaatacaagaagggctgcagtgcccagcactcttccctttgggggtattccctgggacatgttccaggtgggtaactgtcagcctctggtccattgcccgcattttcaatgcccttgtggagggtgggagccctgctgtgcagcagagttccaagcctgctccttggcttcctgtcatgtggtcagaggcaagcagcctctaggattctctcctggaaattcattatgcaccttagcttgtgacctggcctggagaccatgcctcggagaaagccacacagccctgtttaaccatttgccaaacccatctgaccacgaggcaaccctctgggcagtgcagtgggatgttttgaacacacccaagcaatgaggttggaattgaaaatcctttccaagctctccccagtggtgggattgatgtactgggctcccttacctacctcgttactctgggagtgtcctgcgtttgggtctggcacaccacaccatgcagtagtcacactgtgtgagctccacggctgcagcatcgcatagtcggacttttattcatcttctttccccagtaactcacctgggtttttataggaatgcatgtacacgtcctgaatagcaaacctaaaaacatttataatgcatacctcatacagtagaacttcagctatttgtgttaattatagtgaatggtagtcagatgtgctttttaaaaatccagattattaaatacaaagaaatatggtggtactttcatgatcaagccatggcacatgcttgtctattccagaggtgccaggtgaattcctcgtagaggagatgtgactgaaagcacaaaggaggattacttgtaatgaacgtatcaattatttgtagattgagggtcttttgattttaatattctttctactatcttgtttatgttgcctataacctttgacccaatgaacatgaacttcaaattagtgaaatccaacgaaataaggttttactctgtcagaaaaatcactcacccaacaacaggcacagctgtgctcctgtgctcctgcaccctagttagaggtgctgagaacatttcacagcatccagagccttatctgttgaccccaaacgcattcctatatgggcctgcagtgtaggagtccacctgcacaaccgcacaaggactttcccccattgcttacgatgacaaagaaaagtggaagtgtggaaactgttatcattaataacatggtttcagagtcgctgtgcttttcacactgtacgctatagcccgttggtgggtcatgaagtcagttgagtggatggagatcagcagggatgggaccatacagatcccatattacatgggattagtgcatcccaggatacaaggggcagaattgtttgtttagggagatatgtgcgtgtgtgtgtgtgtgtgtgtgtctgatatgtgtatatgtgtatgcctgtgtgcgtgtatgtgtctgcatgtgtgtgtgtatgtatgtctgtgcatgtgtgtatgtgcgtctgtgtgtatctgtgtgtgtatatgtgtgtgtctgtgtctgtgtgtctctatgtgtgtgtgtgcacttgtgcccactgcatcacaatgtaaaatgatccaggtttttattgtgggtcatactgaaaatgtaggaaagccatttgatagaaaatcttttaagcaattccagagtagagaagaattaataatttggtttaaaaattttcctcctcaaagtggtcatttcagtttatattctcccaagttatttctctgctctgacagcatatgccctttataatctgcctgttggtatatctgcctggagttgtaacaatgctcaagtttgtattgcccgtgaaattcctttgtacttaatattaaaggatgattcagctcttcagtgtagcatccaactcttaagaatttcaagcctaaataagaattagagccacttggaggtagcgacagcatggggtgaggcaccaaattaatgtgattcatggagaatttaatctaaaagagaactggatgatgagcagagccagtactcatccagtgccacccatccatcacaccatctttgcaccatagcacctgtgcatcacatgattcctatgccacgccacctgtgtgccataccacccacacaccacaccacccatgcatcacaccacctgtacatcacgccgcctgtgcaccacactgatcgcaaatcacaccacccgtgcatcacaccacctgtacatcacgccgcctgtgcaccacactgctcacaaatcacatcacactgcctgtgcaccacactgatcgcaaatcacaccacccctgcatcacagcacccatgcatcacaccacctatgcatcacactgcctgtgcaccacatagtttatgcaccacatcacccgtgcatcacaccaccagctctcctgccctcagctcagtgctggggccacattgttacggggttttgaatatgaatctttaaattactcaagtttgtgctgctgttgagaaaaggcagaatgcacccttgggcagttctcccattcccgaacccacccacatgtctgcctctcaacacttgctcagctgactaagctacacctttcagatatcagctgaaatctcactggccctccaaaccagtttaaacccctgctgtgtgctcctttagcaccttggccttccccttcatagcacttggcttaaatgtaaatgcccagttgagttttcattattcatttgacattgagccccagccacctcagacgttgcaaactggccgactgacttggggacagacccatggctttttttaaggccagtcccctctgacttctccatgtgggttttgaacttagcctgccatccttccctcttatagttgtgggaattcagatcaagaaaggaggaagcgcgtgaccaggttacctaattaggggaggacacaggatgttcgtgttgttcatgaagatggacctgaagcatgccgtgtgcatcgggtttttctgggcttttctggaatgctgagcccttttctcgagggcagtgctcccacctacagcataggatcaggtgcacacatctgttggcctcttcattaggtacaatttaatgtattaaatttggatactgtttctaggttagtaaaagtgtgtctttatcaaatccgatcatcatttttgtctcataaacaagagacaagaaattcttccaggtaaaatgtttctcaactgcctcgtcactgattagtaaagtgagtttgtcttaacaagtccatctctgtccgattttctgacaaaccaggtaacatttgaataaattctcaagattgtgcccaagccatataaggcattaatgcatttgaggtttggatttgaaagcatcagctgcagttaggagcccaggcttcggtgtcacacttgtgagtttggttcctagcttctcctcttactcactgtgtagccttaggcaggttattcaacctctctgtgcatgtgtccttatctgtaaactgtgattattaataatattacctaagctgactgttgtgaagattacatgagttaatgtgtctccagtacatagaatagttctgggcccagagtcagaaagaaatactagctattattagtagtatgttcattagtagttgatgtatcgccatcattttatagtcaagcacctagaactaaaagttatcctaacaccctgtaagtggatggctgtggttaatacagaatatttaggcaaaatgtgtttatgaagacacttctgcctgttcttgttgtgtactgctttccatgttgtgctgttggatgcaaatgccgatgtgagctaagctctctgcagtccagagggcggaggtgactgtggcttctttctcatctacctaaaatgatgcatatttgagaaatgctttgtttctggggctctcacatgattcaggggcagtaaatccccaaaggaatgtcactttttttatggctcatggaactaatgtctcaccaagcacacctggtccagcatacccacctaaccaaggatttcataatttgtggaatttttcaacacataggtatatcaaatcataacaaaagaaaatcagcactcaaaggtatgactgcaccttacatttaaatctgcttctctccccatgaaagatgatactgagtaggaaaggaaaactgcaggagggcagagagcatcttagaccaaagttgagttctcctttctctatgaaaaatgcccgttgtctgacaggtttcgcccagatagtacacaccatgagggcatgtggccctgcatggaactgcttctgtttcatcacaaatgacaaggcagctgaaaggctggggccaaatgcacagccttgttctcacacagcagtggagagagcccaggcttctgccacacagacttgtccttccagtgaccaaacagcacgtgacccagtggtggagaaaaggaggatggagaaatggattccctagcctgggcctcccactagatcactgtgacccctatttagcctccgaggtaaaactctttccaaaatgtgtaaaccaccttcacctctacataaaatatggaacacaattgcaactcagcctttaatacatgtgtcacgaccgtgtgtagtgtgggccgcggtgggctgatgctaatggaagttctgcccaaaaggcttcctgattcaaacgcatcaggaaatgggtgaaaggaagttaatctggtttccttaagatgactcagagccccattacactaaggggcatttcagtctctcagaggaggatacaggaagtagtgtttccagaatttagttgaccacaggctactcaaattgcattgcaggatgagagccaggcagaatgtattttgggccacaattctgaggttgtgcatccgacaggtgtaggaagaccagagctagccagaaagtttgaggacccacgtgcttgtcctggctccacttcctcccattccctcgaccacagggactgtctacctctaagctgctttctcacctgtatgaaaaggaggtcagtgatgcttgtgggctcctggccctgtacactgcgcaggaaagactgagggatcacaggcaacgggctctagaatcagtgaaaggccacacaaacagaagacaggtgttggtgctcagttctattaacccagaaaagaccaagatacaatttggggaaaattccctgattacatttgttctattctgctttgccaagggtttcacttaattgaatgaatccaattttactctatacagataagtgtatagagctgaccatggcatctccatgtaatccaggagtaatctttttacctcctgacagttttaccgtcttacctgtttctaatccatttccctttcttggcagcagactgggcgacagcacagagacacataggaagtggtgagcggaaagtgcccatgtctccaaggcaaatacacattccagagcactcagaaaactgcagagggctttatgttttcacactgaaactcatggtggcaaaaattgagctgatgtgaggatatttatggtccctaaatcctacttagtgtaatatccatacattttgctgtagaaaaattaatgggtttgaatatggggtgctgcccaagcccctccagaactgttcactatatatgatttttataacatattgcctttataaaacttgaaaaatcctgaattctgaaacctatgtagccccaagggctccaggtaaaagagatcagggactataaaggaaactctggggtacaaaggcacctgtggagatgaaggtcaccaggctggctggtatttgacaggcaggacgccctgttcccaggttcaggcaagaggttgcccagccctcgggatgctgctttctgccacagcatggtgctgtgaattctccccctcttcaccgctgctgtattttttgtgaagccatagagacaagccagtgcctggcccccagcaaggctggagaggcagtgaaggcacatccccacagccacgccctgcgctgtcctctacctggagtccttgggcagccagccaggggaaggctccctgtgccccccacacccaggctgctgtgtaaagaagcaattggcatgagccccaggacactagctactgccaaagccagcagtattttatgagccttaaaaaatcttgttgtaccagtccgttatgaattattgaattaacactgcatatttatagcaacttcttaatagtttaataatttattcatcccttatggatcctttggcatatttcttttaattgttagagtaaagagtttttttagagctaacttcactggactacttcctcaatgatgcttccagaatactaaaatagaatcctgcacagttgttccgaagcttaaagcacctgatgcgcagcaaagacctgcccacatgcgagtcggtgacaccccccctgcctgtgcacagggctgcaactactctgtagaagcccacagccagccaggcccagctctcagccccaactcagcacactagcatttcacagcctacacttggattacgtgtcttctgagacagtttaggaacctaagcatcattcatattgtttctaaagggaaaaacatcttactgtgtcccaacaagtaagctccctattttgggagcacccctgctttgtaagatgtgtcctactgcccagagtgagtcattcctcacagagccctgctcctaggtgcttggtgataaggggaatcaacagaaacaggctgtttcccagcattcacttgcagatgactaaacccagaaattgtggagtagccttaggtaaggagacgaaagttgaaaacttaagacccagattcttcaggcatttgagactctggctgaggaggcaaggcatgccagatcgtttatgctcagggtaagggtgcacatctgtctgcatgttactgtcccttttgcaagggtttttttggtcatgagtgacatcgcactttattaaaaagacatgctttcttaacaagatgagctacctttgatgcttagtctttctctggtttaggcaagagtcctgcaaagccatccagctgttgttggcagctgccaggagttgccataaagaaggtagatggagtttttcctgttgaattcgttaattcaggctcgtgaatgtggtcattgataacaccccatccctcttttccttaccgcctctagctaattgtgcttatcatttaagcttcagctcatggctctatcaccattctcaagtttgccttgaaaagatctgaagaagtacctgttagcctgagctccctctaaagagggagaaaagccaatcttccaggtcagtctggcaaaagctggaggaagggcccatttgcttggggactccagatatcaacccatggccagcagatccagctcagccagattgtcgggtcacaaaaataaatccactatctctaatcgctcttttgcctcttttgcaagcctttgaggcgggcagggcatgagagttactcattcctaagaaatgagcaacaaacagttccagctaagcaccctggttcattcactgcctggccacgaccacaaacttgtgctaagctgagggtcgctgaccggtgatgtcatttggtgctcaaagcatttgttgagtatgtgtgcgcaccagaccatgtgccaggcgctgggcacacaacaaattccaccatggtccttgaccttgaaggggagccatgcgtgcagaagcctaaagctgtgttgtgataagcctaaagccatgttgggaagttcttatggcaacacagctgggaaagtataagtcctgcccttggaggggaaggaaagtgatggaaagagaacatgagccagccttgaagttgctgtttatcagctggctcaagtatcaaggtggaaccaagcacaggcaatccgagcatttcttccatgaaaaatgaaacttaagtgtcccggaaaagttgaggatcataccagaattctgtgtctcagcttggagtgaccatgcagcatatttagtctgacatgctttgagagtgaaagaaagcactgctagtaataacaccaggaccaatgcctgaacccagaccgtcccagggaatcagggacataaccatcatcctagggataacttgaggcctaatttgctgccctgaatgaagttcattctccctctactggtcagagacgagatggcaggggattggttgcaccacccactgcccccccgccccccgtccccctcaacctttttatttatttatttattttaagaaactgatagaagacaaatacaatgtcatctgacattgcaatcattattggaaactacaatgcacagtatgtttgtacttacatccttgaaaaccattttagggctctcagccccgttactgaaccataaagatgctgggtttaaaaatattcaaattggttccttattgaggcaaatgctgaggaaaagcagcagattgcatcttgagcttgaaaagaactcctctttgacttgcgttctccatgatacagctgacttcttttaaatcggtgttgtgagttagtgctcctgttccatcttcacctgcctttattaaacaagcaacacagaggcagatgacttctctgggtgctttatgcatgtatctcactttaaacactgcgttttttgtttccttgggaaataagccctcatagccaatggttgcttcaggtcttgaccaagtacccggatgccccagccagatgccatggtttgcctcctgggtgttcacctctctgtgggcttcttccctctggtttctaaggtgacagcttgttcatcagatgcatggaacagcacagacacaggcatttcacacccgtctattcagagcaggggccccatggcccagattttctgggaaagttctgttttcacacattctgccttgtgctggtcagccaatgtattctggtttgagataacagaatgtaaaacagtagggccatcttacctatagcacgtgacccagagaaacaagggccctgggttagtttgcaaagcaggtcaagtcagccttgagtcctataatgctgcagagagcccagcaccctcttgccgcagcaaggccggccccatctgggtggtggctcctgggtctccagcacccagcactgggcaggcactgggtggttgctcagtgaatatttacctgatggaagcgcccaggcacagtggtggtgagcacagatccatgcacgctgactaccatgccccacacatccacgctgcccctggggcgcaacagtgccagtgagaactccccaccagaacctgtgcctcagctgaaaatttccttcccttctcccatccctaacgactccccttcctacaggtcccagcagatgtgaaaaggagaataaagagcctccagttcctcctttggccccaaccttagtttgcattctaattcattaacatttgcagggtggcttgcagctgtccttagagatggtggtggcagttctcctgaaatgcacctgtgttgttcttgcactttctgtcacttctcagtgggcctcagaagtcaggtgggtggacttatctgcccagccatgtggaagaaggaaggctctcatgtagatgtctacgtgtacatagcgcctcaaagtgaggattatacactacacatcaattcccctctgacgtcttagtggaaagtttccattgagccctaatgctccctagaagtatgtcacatcctgcccgcggaggggcccacccagggccccattctggttaccctcttcatgctcgaggttgtgccctccaggtgcatctcagctcggagaggggccctcagggtcgcagcttgctctgtccatcatccagcatctgcctcctcactttgtgaataacagggcacatagatatcttcactggtgagatttgctggtggtaaagcatattatctggctgtcctcatggaaagcaaaggaagctccctcaaggcaggggacaccccagggaacctttgggagaagcaggaaggagtgagagccgtgggcctggggcctagtgcagcacactctggaattccccttgcttcctgcccctgccctttcattcctctctggaaaggctcattcaccaagttcacagagattctgtggttccctgcatgtcctcaggaatagctctgggggaattctcatccctgatggaggatcagtcttgtggaagtccttcctgtcaataaggacattcttagttttcatggggttgccacagagaccggccacatcaaaatagagacagcccacttttccagaaacccatggtgacctgctttcgcattagcttctggtaaacctcacaggtgtggcctgttggcctcttgctatttagggagccctctgggaccagtcttcacctcagtccctaacccagcgtcctatacagtgtgtgaacaccaaatgcctgttagtggagaggaggaagaagatgacagtgataagaagcggagacaagctcctatgtccctccagcaactggacaggcaggaaaaagtaggagatgctccagagattgtgcaaatgcttccttattttcaggcatgcttgatacttataaacaccgtagacagacagacagataggtaagtaggtaggtaggtaggtaggtagatgtgaacaaatgtgaacctggaagggccagtcttccaatatagatccttagtggctcactgggtccagatttgaaatagagccaagtggccatttgccgactaggggtcatacaggtatgctgagatcccccccaaacctgcacctttttatctttgggacttttagagctcacctgaaccaaccaaccagtactcagccgtatcagccaatcagaactaagcaaatttcattttttttaatttgaataaacagacctgattgggaacctgggtgggaacttttgctctaaaacccaagtcttcctttgttctttggaacataccttcattttatattggaggctgtgtctccctggtttgcaaactgttcactggaataaagtctctttcctccaaattcctttttcagagaacttttgttgacagatagatggatgattgatagatagaatgacactctacatatatatgtatagtatgtgtgtgaataaatgaatgaaaccaactaataaataaaccacaataaaccttagggccctgaatattaatttacccaggagagacccagtcactagagatcagggcatcatgaatagtcaatatcagggagtgagtgaagactttaattagtggctcacagtgcatttctcgaaacccaaactttaggggcctttgatgctggtctataccacagcctgccctgctgcgctcccattgtattctaatactcggcggtgtttgctataaacgtgggtgaaggtagggttgttgggttgaacgtaagttatcccaactcactagctggttttggaaagtaagcagaattggttgtgagtttagttttctgtctacttgaccttgctctctttttttttttttttttttttttttgctaagtctggaaaaggcccaagtgcttggtatgatctgaggaagggccttaggagggtccccagagctagcatttccagtcaggtagcagttgaatttgcagatccagagaccactgaggacacttactgcatcagcctggctggctggtgagtagctgtgctctcagctcaccaactccctcccttgctgtgtgtgggaaaggtggactaaggacataattcctggtgaattcaggaattcagaaagcccttgtccatcatgcagtgtccctgacctgagtccacactgtgcgtggttctcacaggccaggctttgattcttgctagatgcgtagctctgtgactttccagccagacacctggctggaaagtatcctcagtgcaagttaactctggcatctctctaattctgttgctgggttcgacacaaaaacatcctagtgacagctggtcccatttaaggtcagccacctgtgcttccggagatggaagtagactcagaccagatgagttttttggtgtctgtattggattaatgtgtacttctttctaataggaattccaatgacagttgtcttgttggatttttttctacctacatgatcattttcctttttagagccaccatagttttatcctatttaaaatactttgtactttgaaccatggacacccacctcccaaaaattaaaccatttataacatgacccttgagcctgaagattgcatttcaaaatatagacaataaatagagtgatttttaaagcacctgtctaatcagcattaagcagtcaccagcacctccccataattgaaattccaaagagtgactctaaagcgtggacgtgttcagaatcaaagatggaacggtttttagggtaaatgttacatactgaaatcaagcaacatgtaaagtttttaatacatagatgatcgttatacagactaataatcataccaattgtcctcaggccctgctggacagccgcgcatctgtcttgtaacgagctaaccatgtaataaagcacggtgagcaggcacttcctagggcagtgccaggagcctttctgaatactgcaaaggactatgtccaatgcctgatctagcgtctttagagatggcccacctacagccaaggtctcccaacaatgtagctttagagctaagcctaggcgggcttccccccagtatgttccacattgccatgtagttaaacatgcacccttttttttaagtttgccccttgcccttaatgataacctacattcttcctaaaagttaccttctctggaacatttcattaaggaaaggaagcagtcatttttgctgctttatactgtttgaattgttcaggctgctggcagtggaggtggacagggattcccactctttggtgctgggggaaccttttctcatagtaatgccctgaaaccctgcgccatggcacagcgcaatgcttagaacaaaggagtgaggaaactcaaggtgggcccgctggcattcttcaaagaagccctgagaaactctgaaattccccagtcttgaaagaaatgagagagagagaaaggaagtgttatgctttagaagacaaaaagcaatttctagactgtctttacataggaaactaattcattacttattgccactaaacatgagcttgtcagtggaggcctattccaagcacagtgaatacattattttctttaaactccctattctacaaagtaggaatcattcccatcttacagatggacactgaggctttgagaggctgctcatctgaactgagattcaaccccagaaccatctatttcctaagcccaagccctcaaacgtgccatgacactgcttttgtctgtggttctgaatcgcctatgactcctgtggagatggcagcagaatgtctgggatttctacaccaggctgaagcctcccccccgccacaccccctattccctggctcactttcaggaagtggtgcctgggctgtgcccctcagatgtggtcgcttctgtatatgtgatgaattttgagactctcagtggcccaggaccatcactacgtattaaatccataagatgtgagaagggtaattaacacttcctgttgttatttccccttctttgcatccagggaaaggggtacaatagggaagagcaggaggagggggagggaagatccacacgccagaaactgaagtggtctggaatgggaagagtgctgggcacacaggagctttctggagctgtgtctagagggaaaatgaaggttccctcctgtttaaaccagactcccagtctgtggctttcacactacatgcagagtgtggaacacgtcatctactgatgagccctattcacccaacacactcagaacttgggggtttagcctttcctaactaaaaaaaaaaaaaaatctctgtgaagttttgacatctggatcaacaattagccaaatatctgtgggtggaatgctacctggagagaaatatttcagaacccccaaatgagagcatccttcccacacagacccagacctggcccagacccagaagaacaggttgagatgaagttttgtcctgaaatcacagtgtcctggaagcagtagttctgaggaaggggcagattgccgtcccagcctcttcactgaaggatttgaaggctgattccagttgtatgaaaacagcatctcactgcaaagaaggtgctgttagaccaatgtgaacatgagctcaagcattctcacctagaaaagcacctctggttgtgcccttttgaaaaatgttataaatttcttatgccaaatttagaaggaattaggttccagattattttctctcgggtttagaattgtgtttacgacactgaagttgagttttatatgcctttggtcagactcgtgacaattagccactcctggggagaaggggcaccctcgtgcccaggtgccagcagccctcgcccgcagtgcctggccggcttccatttctccttgaggtggctgagctggccggagcgttcgcgggctgagaggaccagcagtgccatcttgtggaaatgttgtcagtgctgaagccaggctgaaggagggagacagcctcgactgtcacactctgaagaatgatgttatccagaaatgtctgggtgcaatcgagtgagacgtttccctctgctcaccagccatgctaattattattttgctgtccagaaaattaatagcccaaataaattaagaccaagccaagaaggtatttcaagaactaaaaatggcaggaacggatttgttttccatcgacttactgggaaatgtttaaaaagtcaccccagctgggaatatattttctgtaaactctggaagcacaaagctatggattctgagcagagtcaaaacaagagttttggaatttgcttctaggctgccctgcaggctctgtgctttcctgaggagactgcttttcccggtcaatgagcgcatgtgctgggccacaacctatgtcacccccttcatcagtgcatgagaagagcccccagccccattcactttgtatgggcagaagctgatcgagggtaccctgtcctcccactgcagtgctctagtgtcgtgtcctctctgttacacaagtgctaagcacacactgtgactacctttcatcagcacacagtgggtgaggcccaagggcctcttcttctgcactgacagagggtttgatttgaggtgcggcccagttctcaaggtcattaccctggaaaagcagtctctttgcccaccctcctcaggaaagcacagagcccgccaggcagcctagaagcaaatttggaaactgtgtttcgaccctgtttagaatctgttgctttctgctgtgtgtatgtgcgtgtgtgtgtgtgtgtgtgtgtatgcacatatatagagtcacctaagaaggtagggtctgttgctgtccagttttatagacaaggaaactaagcctcagaaaagtcaaccaccagctcaccagcttgtccctggcagagtcaggatttgaacccggatcatccaacactctagcccacactcatggtgtccatttgccacggtccctcctttgcgtggttctgaatcgtctctggccctgtcggctgcctcgaatctgttaaatggtttgaagcctcccctgcattttgttcccgagactgaggaacagagtcgtctgagatggtggagatctcagacgacccgactgaagagcacagcccttgcgcttcctcccgggctccacccccaggaccccaagcaaggttccagcctctctgaggcaccatttcttcctccgtaaaatagaacatcacctgccgaaggaactcagatgagctaatgatttatgtggaagtgctttgtatgctagttaaatgctagagacataagtgatcatttttcaggaaaaaaaatccactatcaagtcagaaagtaaatctttaggtagatttgaatatattgtactgtctggttgaataaaggaccctcaggttacatttagattgcttaccttaaaactctgcatctctaaatcatatacagaagacaagctaaaactctgctttaaaatgaggggactgggcttggagccaagattacatgcactatacagccctcgttccaagtctggttcccagcacttattactgtgcaacccttgggcaaatgactggtcctttctgatttaccattccaatctgtgaaatggacagttcctgcctcacaggaccaagagagttagatacagcacttctaaggggagcgcctaactcagcacctggtccatagtacatagtggtgattgataaacagtagcttttatcaacctgagatcatttctatcctttagggaaaatagagcaccagtggcttattaaaggccatgtgtccctgccttctgtgtacatgcttcctgctgatagagtacatttacatgaaaaggagacagcatttgcagaggataacttgagtagacttccatgaacccaggtcaaaactaacatgaaaatgattctgttacgtacaactctccagtaatgcctttgctgccattttgattactttcagtgggatcagagatttgaccagattcccagtttcactactactacgcacgtgtgtgtgtgtgtgtgtgtgtgtgtgtgcgtgtgcatgtttctccccatcccagaattcaccttcgtggtaactaagctgaccctaatccctaccaggatgcttgggaaggaagaggctgaccagtcagatgcacatcggaccctccctgttgcacagaatcctattttggggtgaagaagggcactgcatttttctaagagtgcagaagctctccagggttaagggaagaagggtaaggaccccacaaaactagctgtggtgagccaggctggagcagggcagcagatacaaattactttgttcacaagttgcctgtcagtagcagtcctatttgaagattactagcaatcggtccttttggggagcccggattcatttcctggctgacctgctctctgtagcccaggggaaagtattattgcaatatcggtgtcctgtggggactgagtaggtacatgtggggtgtcgcgtacagttctaggcaaaactctagaaaccgcactggaatgcagttgggagaatagctgagagagtgaaggaatttgaaatcatgcctttgagtctgggaaagggatgttctgggggcttgtggtagccttcttcaaataccaaaggactgtcctgtggaagagcgttagacttgggatgggcgctggactaagtgcagggagacagaatccggcccacctgggagacatccaggcggcccccactgaaggcccttaagctctcaactgcgaaaggatgaaggtatagattgcagcagccgtctgcctggtagggaacctcctgtccagctctaactcacaagagtgcatcgctttacacctctcagaactggggcagaaaccaggctgtcagagcaccacgatgatgagggagggtgtaaagccttagaacacaaaagaatgttaaaagtcttctcaatttttatatgagttacatgttggggtagcagtaacttgaatatattgagttaaatagttgctgtttgggagtttagggaagttttaaaactatgaatttgggtttctcagccctttccacattcctttaaagatgagaccatcaaactcagtcttgatgatatctgcattccacagggttactcagtcactgagcgtttctggcattttatcctgtctgtctgcagtttccacagaatgccaataaggtataaatcttcattaagaaaatttagaaaataagtaatagcaaacttttgttaaggacaaagggtccttttaagagtttgatgtggtccttgccagatggacaatagagacccacgtgcacggacatcaggtggctgcttagtctgggtgtgaaaaagctgcagtttctgctagtgtataggaagtgttatctggattctaatcctggctaattctgcctggcttgcagttcttttcaatttaaataagtgtagtttttaaagtctggaaaggcctgaggatatggggcgggcagggttgatagttttcactctctgtttcctgagagaaaataatgttgcatcttcaaaacagcatctgtcagaatgattttcatcagattaaataaatcctcaaagcagctatcatacttcttagacttgagaaatgtaggttatactttgcatggaagcctaatggcatttaaaataggtgtgttttgcatgtacagccttacacccagacctttgactggggtttctcgcttgtgagattttgttcaagctaccacatctcaaagagtttagtaactgtttttactttataaacgtcataaataattatttgccaatttaagttgctgttaattatagttggaaaaaaggattgggctctgaagcctttgggccaaacttgatgaaaaccttcaacacaacatacgctctgtcacgggacaagttacatgaaaatacatatcgctgttagacattttggaagaggcctgccttttgccatcttttcatgggcagctgccatatgtccttacagccaattatggccttttcagttttagagaagaattttgggggcgacttttggttcataaagacctttaatgaatgatcaatacagattgatatttattattctgtggcagggaagcttattcttaaaattagttgctaaatctaaaccacagtacgatacttcctcacacccattagaatagagcctttatccaaaaaaacagaataaaacaaaacagaaaacaacgagcgttggcagggatatggggaaataggaacccatgtgcgttgctggtgggaatctaaaatggaacagccgctgtggaaaacaggttggtgattcctcagaaagttaaacacagaattaccatataacccagcaattccacttctgagttacacacaaaataattgaaagtagaaactcgagcacatatttatacacccacgtccatagctgcaccattcgcagcagtccaggtgtccatcagcagatgaatggataagcagaatgtggtctgtctgtacagtggaatgttattcagcctcaaaaaagaattcccacacattctgcaacataaatgaaccttgacaatattatgctagatggaataagccagacacaaaaagacaagtactgtatgattccacttacatgagatccctagggcagttaaactcacggtgatggccaggggctgggaggaggagagaatggggagctagtgtttaatggggacagactttctgttgggaatgatgaaaaagttctggaaatagataaaggtgatgatagcataataatatgaatatacttaatgccactgaactgtatacttaaaaatggctaaaatggtacataatttttttgtaattagttgctgagctggctggggtttcaaagcgaagttagaagggagggagagcttggactgtctttaggaagaacgtttgccttgagcagaccagagctaaaggagaccctcagtctggtgtcctgtcacttcccgccgagtcgcctcttgcggctcgataagactttctcatgcaacacaattcttgaatattgtgtaaaaagtgcagtcttaaagcaaggacctcgcctgcggaagtgctggacacatggggttcttttctttcagtgccttatttcttaccagtgccaaacagatgggggcgctggagcacagcagtgcaggatgaagtctcaggccttcatgttgttcttccccaggttaattaggtggaatgcacactgttttggttgtgccccaagagactgctctgacctaagcttgccactgagtgacattccctgtccctgctcctcagctcggagtcagccctcagggtgtgcacaagggcaagttcacggcctttccatcctgagtgagtccctttgactgcggcatcagaccctcagtcttgccatcactcagccaagtcgccagcaccacatccagcagaatgactagccactttgtataggatgcagcacaaaggacaccagtccctggctcatcgccacacccggtgggcctcacctcacccctcgccacccagtggttggcagaggcacatttcttatgctgagcctagcatgattttcattgacatcctctgtctttatgagcagaatccaccaagccactaaagctcagcagattcagtcatgactcagcacaaaggagctatctccgtgaatttggggtttcacaaggacagcgccatctgtgaatgactcctgtggactcttagacgctgcaacctgcaaccatggccctggacactcctggaatgagctgggcctgtggggggagggtcattcttactgctgggggtctcctttagcccccagggtctccatggccattcagcagttgcgatgggacagtgtcttgagcagctcacatgggagtgaggtgctaaatgtgggtttaggaaaggaaagagcgtgccctgggagtcagaggctggtttctaggcctcagcttccgtgtgtgttttccagcactcaggctagagcagagctgtcatgatctcatatcatcactgttcacacacatttctccgggtacatactcgaggcatagaaccccacccttgtcgtgatcaatgcaggagacgcccagaggacagcacctctgaggagcaccgagggcagggaggaagggcgggactgtggcaggcccctgggctccagactcccgtcctcagtgcacacaggggaccagtgctggagacagattcctgatagccaggtcccccgagagcctcacgtggcagctactacacagtggggctgggctcaaccaaggagcctgtcaggaacacccaacatggaggcctctccaggctggcgccctactgctggatggcgcctctgcgtcctggagttccactccacctctgcaaagggtggcgtactcacagggtagaccaccctcattgctggggatctcctttagcctccagagtctccatggccattcagcagttgtgatgggacagtagttgtgtgtgtgtgtcaatctttataaatacacacgtacagtaatacagaagtacaagtgattttaacttgttttgcttgtctgcgtttcaataatgaatatgtacaggcagacctcagagatattgcagggtctgctccaggccaccataataaagcaaatattgtgataaagtgagtcccacaactttttggtttcacagtgcatataaaagttatgtttaccctccactgtagcctattaagtgtacagtagcattacgtctaaaaaacaatgcataacttaatttaaaattttaaaaatttaaaaattctgtatgctaatgatcatctgagccttcagtgaggctcagtctttttgttggtagagggtcttgcctcagtgttgatggctgctgactgattggggtggtggttgctgaaggttggagtggctgtggcagtttcttaaaataagacaacaggccaggtgtgatggctcatgcctgcaatcctagcactttcggaggtcaaggtgggtagatcacttgaggccaggagttcgagaccagcctggcaaacgtgacaaaaccctgtctctactaaaaatacaaaaattagccaggcatggtggtgtgtgcctgtaatcccagctactctggaggctgaggcatgagaatcacttgaacctgggaggtagaggttgcagtgagcagagatcacaccactgtactccagcctgggcaacagagtgagaccctctccctctgtaaaaaaaaaaaaaaaaaaaaaaagacaacaatgaagtttgtgacatagaacatagatcaactcttcctttcaggaaagaaagatttctctgcagcatacaatgttgtttgatagcattttacccatggtagaacttctttcaaaaatggagtcagtcatctcaaaccctgccactgctttatcaattaagtttatataatattctatatcctttgttgttattttcagtgtttacagcatcttcaccaggtgtagattccagctcaagaaatcactttctttgctcatccatgagaagcaactcctcatccctgaggattttaatcacaagattgcagccattcagttccatcttcaggctccacttctaatcctagttctcttgctgttttcaccacatctgcagttagttcctccagtgaagtcttgaaccccctcaaagttacccatgagggttggaatcagcttcttccaaactcctgttaatattgatattttgacctcctcccatgaatcatgagtattcttagtggcatctatagtagtaaattctttccagaaggttttcaatttactttgcccaaatctaccagtggaattacttatttcttaaataataagacttgaaagtcaaaattacttcttgatccatgggttgcagaatgaatgttgttttagcagacatgaaaacaacattaatctccttgtatacttggtcttgggtggccaggagcattataaatcagcagtaatactttgaaaggaatctttttttctgagcagtaggtctcaacagtgggcttaaaataagcagtaaaccttgatgtaaaccaatgtgccgtcatccaggctctgtcatcccatgtatagagcacagacagagtagattttatgtaattcgtaagggccctaggatgtttggaatggtaaatgagcattggcttcaaattaaagtcatcagctgcattagtccctactaagagtcagcctgcccttggaagctttgaaaccagtcattgacttccctctctagctgtgtaagtcctagatgacatctttttccaataaaaggctgttttgtcaacattgaaaatctgttgtttagtgtggccactttcatcaatgatcttagctagatcttctggagaacttgctgcagcttcttcctcagcagttgctgcttcaccttgcacttttatcttctggagatggcttctttccttaaacctcatgaaccaacctctgctagtttccatcttttcttctgcagcttcctcacctctcttagccttcatagaactgaagggagttagggcctttctctagattagactttggcttaagggaatgttgtggcttgtcttttatccagaccactcgaactttctccatatcaacaataatgctcttttacttccttgtcactcactccagtgctcactggagtagcatttttaattttctcccataactcttcctttgcattcacaacttggctatttggtgcaagagaccagcctgtctgagcttccgacatgtcttcctcgctaagctgggtcatttctagcttttgattgaaagtgagagacatgcaactcttcctttcacttgaatacttccaggccattatagaccattgtagagttgttaattgccctaatttcaatattgctatgtctcagggaatagggaggcctgaagagaaggagagagacagggaatggctggtcagtagaactgtcagaacacatatgacaagtattgattaagtttaccatcttatatgggcacggttcgtggtgccccaaaacaattacagtagtaacatcaaagatcaatgaccacagatcactgtaacagacataataataatgaagatggacacccatagacttgcttatgcagagttgccacaaaccttcaattcctaaagaaacacattacctgtgaagtgcgataagcagatgccataaaacaaggtgtttgtttgtgtgtgtgtgtgtctgtagaggggagggtgtttatatatgtatataattactcaagcttcctcagccaccttttagggctcagtttggtgaggaagctaattccctttattatgcatgtattcttactagattgactctctatggatgacattttatatcaagtttctggagtggggtgatgtcctgcatttccgcctttcagagcctcagcaggttaaaaaacaaataggacatggagacagtggaagccactgtgcactcctgctacggaaagacggctgtgccttgttgaagatgatactatatgattcgctaccagagtggggccatccctgcttcaggctgttcctagatgtttaaaagaacattccaaacgacgttaagaaactttgtgctgccatttgtgtattcctttccaaatcttttctaaaatgttagaattcagaccacagttcctgagctttggatgcaaactccttggccctgaatccctggaagccctcccctgtggatggtatcagccatcacagcaggatgtgctttaagaatccaaatgaattcagttataccacgtggcgggacttttaaacttgagctgagcttactcatttctggccgactattaatcctatagctaaatcatgtacgtaaaggaaggggaaaaaaatccaacctgggtaaccacacaacaaacactaaataaaaccaaggtaatgtatggggcatctctgtgctgcttagtaaaacttgaagtttcttaatgtcgcgaagtaacagaaattacttgggggaatttcaggtgtttttggtaaactctttggggaagtaaacagtcagtgaactttcggaatgctgggacttttgactgcagcaaaacaaagctaagacaagtggattccttaaaaaagaccactggcagcagaggagaagcagagctgggaagagacaggctggtgagctcaggggataaattctaccccctctacccagcaggactggccttaagcaaaactgaactaagagggagatgcttcccctccacccacctccgtgagtgtccccgatcgatcgcgctgtcccagctgggctgaccttgtattcacctccaggtcttgggtgtctgtacctcttggtggaggcatttggaagtgcacacaccttgtccactacctcaaactgtgtcctgatgtttttaaattatggcacacgtagccataaaaaataagtgtacagaagagtatataattacatggagagatgcttgccatagccttagttcagaaggcagattacaaaacagtataactatttttgtaagaaaaaagttaataagaagacaagcacgtacatctgtccatagaaggaaagcctgggaggatagccccacgttaacagtgtgtgtttccaggtggtagacctgctggcgatttgagcctgtttgggcttgtctgttttttcacactgagctgtactgctttggtactgcatccattccctcaatactcggcagtttaggtgagctcagtgtgagttaacatgtcaagaggtgacatgtttcccaaggaccttatatttgtaatgctcagggattgatggggacgggaggtttgtgttggctctagaatctcccctgtgaggacgctggaaggggaagcctagggttgaggaggcagtgagaaagtctccaagtccacaccatgtaaagctacttctcccctgctttagggaagcgcctgtttcacgatctcattaaatccaaataaatgggcttgcccatagttaaaatgtgttgatttaaccaaaaaacaaaaataggctgggcacagtggctcatccctgtaatcccagcactttgggaggccaaggtggaaggatggcttgaggccaggagtttgagactagcctgggcaacatagcaagaccctgtctctacaaaaataaaagaaaatagccaggtatgatgctgcacacctgttgtcccagctactcgggagactgaagcaggatcacttgagtctaggaggtggaggctgctgtgagctatgatcgtgcctctgcattccagcctgggtgacagagaccctgtccctaaaaaaaacacaaatagaaagtggttgaaggcaattcactcgcagttggctgcagtctgtttctctctcgtacttggggctgaactagcctcaggagaaggaggctcccgagccccgtagtgtgatcattacaacaaataacgcagaggagaggtttgcttcccattctgcctccacgccctccagcctggctcatccacatacacatcgtctgccaccgtgttccctgttgtggactgttttgttaaatctgccttttcccttctttttttccagtccacctaaacccactgtgttcatctctggggtcatcgcccgggtaagtctgggagtgtctgcggtgggtttgaggcttttgcatggcagcatggagtctcctggttgcttctggttttgttaaactctacctggaataacccagcaccactgctcatctcctctgtggccatggctctcttcattgccgcgtttccccagaggctgcttctgcagaccgcaggccagactcgcatcctttacctttccagagccgccgtctggtgagacccaacattgtgacttaagcgcagacctcccaccagtgaactcccatcagcaaacccccgcagtgaaccccacagtattgccgtccatagggctgctgttctcagaacattcactttcttatcagaggatgcctgaagaaagtgccagtgttggggacagcccactgttggtggagctgtgaccgcagccagccaacctgccagccagagaagtgtggctccagcctgcccatgtggaccccaccctggccacacccacagttggcacagaagcccattgatccctctggaaaatagggagtccctcctgagactggacaggccgaacctggctctgtctcgtaggcgccctgtgcatttccttcccagccagcgtcccaggcctggctcacagctgtggtggcacatctgaacttaagatcctggatttggttctgtcctgcccccaatttaaatagtcacaaatacagatgtagcagaagaaaccccgcagcatccaagtcagttctgtgggagtcgcatgttcctgtgtctcacggcatggggcagagccagtgagcattcttgctgtcctgccagtgtgtgggcctcagtgccacctgccattccctggttttgattgcccaggccccctaacacccacaagggacagacttccaccttcctttatccattcacagtccacgcctgccctgcagggacgctggtgggtgctggcctgggcttcctcacatacaactgccatgcttcctgcagggacgctggtgggcgctggcctggagcttcctcacccacaaaccccatgcttcctgcagggaagctggtgggtgctggcctggggcttcctcacatacaactgccatgcttcctgcagggacgctggtatggggcttcctcacccacaaaccccatgcttcctccagcgacactggtgggcgctggcctggagcttcctcatatacaaccgccatgcttcctacagggaccctggtggacgctggcctggggcttcctcacatacaaaccccatgcttcctgcagggaggctggttgctgctggccttcggcttactcacatacaaaccccatgcttcctgcagggacgctggtgggcactggtctggggcttcctcacccacaaacaccatgcttcctgcagggacgctgatgggtgctggcctgggacttcctcacatacaaaccccacgcttcttgcagggacgctggtgggcgttggcctggggcttcctcacccacaaacaccatgcttcctacagggatgctggtggctgctggcctgtagtttccacacatacaaaccccatgcttcctacagcgacgctggtgggctctggcctggagcttcctcatatacaaccgccatgcttcctgcagggatgctggtgggcgctggtctggggcttcctcacccacaaacaccatgcttcctgtaggaacgctggtgggtgctggcctggagcttcctcttatacaaccgccatccttcctgcagggactctgttgggcgctgtcctggggcttcctcacatacaactgccatgcttcctgtagggacgctggtgggctctggcctggagcttcctcacatacataccccatgcttcctgcagggacgctggtgggcgctggcctggggcttcctcacccacaaacaccatgcttcctgcagggacactggtgggtgctggcctgggggttcctcacccacaaacaccatgcttcctgcagggacactggtgggtgctggcctgggggttcctcacccacaaacaccatgcttcctgcagggacgttgatgggcgctggcctggacgttcctcacatacaaccgccatgcttcctgcagggacgctggtgggcgctggcctggggcttcctcacatacaaaccccatgcttcctgcaggggcgctggtgggccctggcctggggcttcctcacatacaaaccccatgcttcctacagggacgctggtggatgctggcctgaggcttcctcacacacaattgctatccttccgcagggacgctggtgggcactggcctggggcttcctcacccacaaaccccatgcttcctattgattaacctgagctttccgtgtttcctgacagggtgacaaagatttccccccggcggctgcgcaggtggctcaccagaagccgcatgcctccatggacaagcatccttccccaagaacccagcacatccagcagccacgcaagtgagcctggagtccaccagcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagctccagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcggcccctcataaaggaccttagaggcagggaacagcaatgccaaatttccctctctcgtgagatgggggatcctgtgcaggctgatgaggcacccatgagaaaagccgaaaaagcatgcatcttagaaatagcccctcaattccaggagtcaacatgccaaagaatgaggctggagacaggtagctccgagggaggacttctggcatgagatctcggcacggcaagcccagcatcgcctcagcccagacaggctccaccaggagatcaagcaagggctgcctttcaggagtcacctcctgagccacttcagagttctggaagtgaccacggaccagggtggaggaatagacttctagttcattctgggacacttgagccagagagttgaaagcttggaaagaccagataagaaacctgccctttgtctccctagggacatgagacaccacattccatttgtgctagaaaaacctatccactgatgagtctaactgttccaaacgcctcccacctggtgtgcacagctgcctgggtccattgtcacttgggtgcatcaggttgtcctccgatttttagatgagtttcctgtctagagatgtcctagtctgctcactggctggtggcagtagggtaccctgcgtcctcgaaaagccagagggttcacctagtcagacgaaactccagaacagtgcttgtggagggcctgactgtcctgctcacccacagccgatctgctgcaggtcagcaactgtgtcgtgagcagctgccaaccaccagcctttctggtgctgttctccagttcacgtctgccagctggtgagggcagaggcagacctggtcagacccagcgcccctcctccctgagggagcatggcacagcctcacacttgaaagacggtgtttggtttcccatctaatcaacttaagggaagccggcatgtacccttcaaggccctgtcaccacctatttcctgatcagttggtataaactgagggtggcttttagagacccagacttggttggcagcgctgccatggaacaccccagcaagcacctcccagcctgcctttcggagcagcacccaggaggggatgccgcgctccagcaacaccaggtcaggcctgtgcagacccctgccctgccgctgcagaaatccagaagcatccttaatgcttctcagtcttcagccagagggagggctgttatttccagaggtgcgctttttatgtacttttagctagatgtggcatgcatctgtgagctttagatcattaaatccaaaatgtttgcctaaatgagtttatcagttgttaacttcaagaatattaaatgatttataataaagctcctgcatttctctcc

SEQ ID NO: 35773 - DNA, 26025 bp, Homo sapiens
ggcacagccagagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatgggtgagtgaggggctgcgagtcaggcgggacctgggaaaggcagggtctccacaattggggtggcctctgggcctgtttttttcctccgcccgctgtggtgggggaggggcgccgggtcgggggtcggaaggaattcttaagggggaacaatggagcggagggtgagcgatcccccccgcccccgatctgtcgccagacgagacagggacagggcttcgggcaagatttctttctggactcggctttttctccttgatcttattgaaagctggacaacattgggcagagatgtggggaaagccaactctgggaagcaaacacttggcgaggccctttctgggggtgcgatctgcataccttcttgcccgggtgtggacagcggtcaggagggaggcagagcaactccagccttttccctccccttctgcgtttcgtgtacagtccctgcatactccattggtatgtaagccagcggccacccggagcctggagccgcccggggcaggaagttgcggtggccagggagcacccaaggtttccgaagagtctggagtccttcagcgctcactttgctaaacttggccttgcgctggattccgtttcaagtttttcgctccttgttaatctcattctccgaaaactgagcttatcttctatttctttgactattttcaaaaactttaaatgtgtttggtttattctcctaggtttttaagcttatttttaggcggtctaaggtctaatgcaaaaaaattttagaaacgaatttttaaaaaatacctgataaattttcaagtaactgaacatcatgacgctgaattttatggtagtcttgttaaatagtaactacaatttttttaaaatttctttttagaaagttgactttttaaaaactactttttagggggcgtgtttttgctcagctgagggagaagggctgtcagttggctgaagtaagcaaccgctcccggttactgtaagcagtctacatcacagctgagctccatggactagaataacgctgaaagaagcccctctaactttgaacgttgaaacttgttggttcattagcttgttttctaccggaggaggttttatttttctcttccttttttttttttgcagacggagttttgctcttgtcacccaggctggagtgcagtggcgcaatctcggctcactgcaacctccacctcccgggttcaagagattctcctgcctcagcctcccgagtagctgggattacaggcatgcaacaccacgcctggctaattttttgtattattagtagagacgggggtttcaccacgttggccagtctggtctcgaactcctcacctcaggtgatccacccacccaggcttcccagagtgctgggattacaggcgtgagccaccgcgcccggccggaggttttattttagagctgtactaccatcaaaacttgcaaacacaagcttctgtaatatttcaaggtatataaagagtaacagtatatacattggctcatgtttattttcctcttagcgtacttacactttgtgaatcaattgtttatgagtcattcataaagtattttttctttcaaagtttcttagatttcctttgtcaagaggacagaattattttaggagggcaagcatatttaagttttcagtggctgaaagttggcagtctgaaaaaggatcggaagttaatgggaggacttcggactgtgataaatgaatttccagtctgttcgttaaagagatttaacaatatatggttatgttccagaacacatagtatattggtctttttacttaagatttattgtaaatgaattgctatttttcaattccttagtcttttgtgattgatgaaagtatcagaggggcaaggaatatagaagtatgctaccagcattttcatatatttactatattgggaggcatttccctccaccccaaaaaatgattcgaagaaaatgggagagaaaaaatatttaagtttctgcatttgtgtggaggatttaggagttacttgtttttaatgttttattactcaggcatgctatcgttttgcactttaattttgggataatcagttttccttgactaaaaaacacttcagtcacaagatcgacatttatggtaactcatcaaaggaagtatcaacgtacgagggagatatgtgcatgaacagggaaaaaggtggtttggaagtttgataattcttacatttttctgtctggctttatgagtgactgacagcaaaaataatagatcacttttaaagtgtctgccccattcaactgttggaattattaatgttttacattagtgtgcttcgtttttctttataaagcttagataagattcatgccctcctgagtcagtgttttattcagactttaccattttaaagtataaaggagatagcagttagctgatgtgtcaggtttgccaaactactatggagaagttttaaatttaattcgtacacctgctgttcttcaaaagttcaagtaactttaaaagatattggaagttagcttgtagttaactgtaattaaaaaaccaacacagtgtatcaaatttaacatcatctgaactattgattgacagaaattatgtactagttataagggtaagttatgcaagtgatgatattgcccatactgctcgagttaggaagcaatagcttctggccaggtgtggtggctcacgcctattatcccagcactttgggaggccaggttgggaggatcacattgaggccagcctggtcaacatagcaagaccccgtatctatttgaaaaaaataaaaataaagcaatagcgtctgtattttattttgtttattttttttgagatggagtttcactcttgtctcccaggccagagtgcaatggcatgatctaggctcactgcaacctctgcctcctcagtagctgggattacaagcgcccgccaccaagcccagctaatgtttgtatttttagtagagacggggtttcaccatgttggccaggctagtctcgaactcctgacctcaggtgatccacctgccttggcctcccaaagtgctaggattacaagcatgagccatcacacccagccagcttctgtattttgtatatattttttaaataattatgttttttttccttttgagtagctgagacaacaaggacatgccattagacctgcctggctaatttttgacattttttgtagcaagaaggtctcactatcttgcctgttcttgggctgaagcgatcccgcccacctcggcctcgaaaagtgctagggttacagggcgagccactgagcctggctgcattgtcctattttaagtctggtttctgtatcttgatccatgataagatgtaatgttgttaagtgaatccttaaattatgtatatatccaaaaatactaatgtgttctgcagaggaattactaattctgatctctttactttgaactttccagttcttgcctgttgaaaagctgaaaaagtgttacttttaaaaagtttgctgatatcagtgtagtgtagtatgccagtgtagttctgtattgtcttgaatgtgactgtggttttgggggtctagagatgttcaggagaaaggatcctatatttgtcactttaaaaaatattaccaagctaaagagtggtgttttatatttgtttcttagcatattttgtaaatccatctatttatgtaatttttttatgtttttcctcttgattctaaaagtagtatgtgttccttctgttacatttagaaaacaggtaaaagaataaagtgataattacctatctgtaattccactattctgtcatatttactctcagccttatttttatttttattttttgagacagggttttgctctgtcacccatactctggggcacatacaggtggcatgatcatagctcactgtagccttgaactcctggattcaagcaatccctcctgccttaggctctggagtagctaggactacaggcgccactatgcccggctaatttttaaattattttgtagagaatgggggtcttgctctgttgcccagctgatctcaaactcctgggctcaagaggtcctcctgcctcgacctcccaaagtgctaggatgacaggtgtaagccaccacacctggtacacgctcagccttttaagaggaagtttttgttcctctaaaattgtagttgtgatgtttagttttgtgtcctctctttttgatttagcttattacaagcattttctcaggttattggttgaacatataactgccagcctttaaaaaaacaggctcttctgattatgtgaatataggaaacagaaaaggcaaaaatcctgtttcatgccactggctgataggtacagccatccttagatgcacccttttgcattattatagtagtgcaataggctgtcggaaactttgataatttgctgctaattaactgataaaaatgtagatgtttctcatccgtgtgtagaagcagaacctaagttcacatttttccgtataactggtggcctgagtttcagtttggttggtcaagcatctgatgaatttgataaaaaatatttgagatggagtctcactgtgtcacccaggctcgagtacagtggtgcaatctcaggtcactgcaacctccgcctcctgggttcaagcaatccttctgcctcagtctctccagtagctgggattacaggccccctcccaccatgcccggctaattttcatatttgtagtagagagggtttcaccatattggtcaagctggtctcaaactcctgacctcaggtgatccacctgcctcattctcccaaagtgctgcgattacaggcatgagtcaccgtgcctggccaaaatattaagatacagtatgtccaccagaaaaacctaaaggcaggatggcagcatgtaaatagtatttgaggtctctggcatcagaactaggttttttggttttggctttttagaaaattttttaataaaaaaatcaagatataatacatagaccataaagtttaccctgttaaagtgtacagttccgtgggttttagtatatgtattcaaagttgtgtaaccatcaccattgtctaattccagaatttttcatcatccctcaaagaaacctgatacccattagtaataattcccattcccctttcttcccagcccgtaatctgttttctgtttctatgggttaatctattccggacacttcatttaatggaatcatgatttatggcctctttgtctggcttttttcacttggcatgatgttgtcaaagttcattcataatggccgggcgcggtggctcacgcctgtaatcccagcactttgggaggctgaggcgggcagatcacgaggtcaggagttcgagaccagcctggacaacatagtgaaaccccatctatactcaaaatacaaaaattagccgggtgtggtggcagatacctgtagtcccagcaactcaggaggccgaggcacgagaatcccttgaacccgggaggtggaggttgcagtgagctgagatcgtgccattgcactccagcctaggtgacagagtgagactctgtctcaaaaaaaaaaaaagaaaagaaaagagaagaaaaaagttcattcatattatagcgtatattagtacttcattcttttttttttccttttcattaaattcacataagcacctcatttcttttgatggccaaatagtaattacattgtatggataaaccacattttatttatccattcatcagatgataaaaattaggttgttttcactttctagctcttcaacattcatgaacaagtttttgtgtgggcatgtgttttaaattctctgataaatacttaggagcggaattgtgtcatggtaaccgtcttgaacattttgaggacctgacaaacatttccattttacatcctcgtttacatccccactagcaatatatgagggttctaatttttctgcaagactcaggtttttaaatatctgttcttctgtttctgtgactgtgggggacatttctggacattaaatgtctcatctgaaaaatgaaaggttattgtgagaattaaagtccaaaaatgtatagaatcacctactatgcttagaatgcagtaaatattcaattttaaattattattttaaactattacgcagcctgggcaccataccatggcaagacctcatctctacaaaaaaattttaaaaattagctgggcatggtggcgtgcccctgtagacccagctactagggaggctgaggtgggaggattgctggagcccaggagtttgaggctacagtgagccatgtttgcaccactgcactccaggctgggtgacagatcgagaccctgtctcaaaaaacaaatgtatatatatgtacacacacacacttataattatgaaggtatatttcaaacttgtagataatttgaaagataaaggaaaacatgaaaaatctttttatccatctgaaaatactcttttgtctttccagtcttactcctttctgcaatatttttttctccctcaaagttgagatcattggatctaacttttttctttttttgagacggagtcttgctttgttgcctaggctagagtgcagtggcgcaatctcggctcactacagactccgcctcccgggttcaagcgattctcctgcctcagcctcccaagtagctgggattacaggcacccgccactgcgcccggctaatttttgtattttttagtagagacagggtttcaccatcttggccaggctggtctcaaactcctgacctcatgatccatccacctcagcctcccaaagtgctgggattacaggtgtgagccactgcacccggcctcaatttttcatcactaattatgatactagctgtaggttttttatagatgttctttttttgttttttgttttatttatttatttatttatttatttatttatttatttatttattgagacagagtcttggtctgttgcccaggctggagtgcagtggcatgatctcgactcactgcgcctccacctcccgggttcaagcaattctcctgcctcagcctcccgagtagctgggattacaggcgcccgccaccatgcctggctaatttttgtatttttagtagagatggggtttcaccatgttggccaggctggtttcaaactcctggcctcatgatccaccctcctcggcctcctaaagtgctgggatttcaggtgtgagccaccgtgcccggctggatctaactttttaaatttaaaatgtaagtatttcttgctgccataattatgggcaaaggtttgtttttttgggttttttgtttgtttttttgagacggagtctcgctttgttgcccaggctggagtgccgtggcgcggtatgggctcactgtaacctccacctcccgggttcaagcgattctcctgcctcagcctcccaagtagctgggtttacaggcgccagccaccacgcctagctaatttttgtatttttagtagagactgggtttcaccacgttggccaggctggtcgcgaactgctgacctcgtgatccacccacttcagcctcccaaagtgctgggattacaggtgtgagccacggggcccggccttgtttgtttgagacaggatcttgctctgttgcttacgctgaattgcagtggtgtgatcatggctcgctgcagccttgatcccctgggctcaagggatcctcctgcctcagcctcccacgtagctgggaatatagatgggcaccaccctgcctaatttttgtttgttttgagacagggtctcaattctgttgcccaggctgaagcacagtggtgcgatcacagctcactgcagccttgacctcctggggtcaagtgatcctcccatctcagcctcacccagtagctgggactacaggcatgtgccatcacaaccggctaatttttttttttttttgagacggagttttgctcctgttgcccaggttggagtgtaatggcgcgatctcagctcactgcgacctccgcctctcaggttcaagcaattctcctgcctcagcctcccgagtagctgggattacaggcatgtgccactacacccagctaattttgtatttttagtagagacgggctttctccatgttggtcaggctggtctctaattcctgacttcaggtgatccacctgccttggcttcccaaagtgctgggattacaggtgtgagccactgtgcctcactcacacctggctaatttttgtattttttgtagtgacagggttttgccatgttgtccaggctggtcacaaactcctgagctcaggtcatccacctgcctcagcctcccaacatgctgggattacaggtgtgagtagagacgggctttctccatgttggtcaggctggtctctgactcctgacttcaggtgatccacccgccttggcttcccaaagtgctgggattacaggtgtgagccactgtgccccactcacacctggctaatttttgtattttttgtagtgacagggttttgccatgttgtccaggctggtcacaaactcctgagctcaggtcatccacctgcctcagcctcccaacatgctgggattacaggtgtgagccaccatgcacagcttcccagctaatttactttttcttctttaaagatggatctcgctatgttgaccaggctggtttcaaactcctgggctcaagcgatccgcctgcctcagcctcccaaagtgctaggattacaggtgtgagtgactgcctggccagcaaagatttctgaggtagttttcctgctatagtaacactttggtcaaagtgcaggtctagttaaggagaacaagtattccagtacatctttaaatacagttgcttgtttctggacacggaggggagggagaccattgctgggctatacagattagtcttatcttggctagttgaaaattggtaatagttttcattttgtggagaaatttcattgccaaatattgcaacattaaggaaatacataagaaatgactgaagtggctcaaaattgttggaccaatatgtttttgagtaaagaactataagttttaagtgatgactgtatatgtttaattcgtgcattaaagcttataaatacctttttcaaaaactcttaatttgcatttatacagcattgttatttttgatacaactgcataagatacattctgtgttgctgtgagccattaaactgttgtcttgtaatttatatttagaaaataatttgtggatacttaaaagtcattatgggcgcattattttttccccttgaattctggggtgacctagaaatggttgcatgattttgtaaacacttccctttttaaaaaagtaaaatgagtatgtaaaatattatatatttaaagccctcaagcagtcgtcttcaaaaagatacatcaggaaatgtaaacagcccaacattttaattaaaaaaaatctgcttggacaattttttttctcttttcataaaagtaatacatgatttttgggtaaaaaaaaattcctatcagtagaggagcaaggaaaataattattcatacagtattcatacaagcacatataaaacctattaaaagaaaacttggattacctacatgcttttgtataatttaaaatgatatagtcatgatttgtcttggatttcttcaattcttttctttgtcagtatttttggatttactttttttttttttttttttttttgagactgagttccgctcttgttgtccaggctgtagtgcaatggcacgatctcggctcactgcaacatccgcctcctgggttcaagcgagtctcctgcctcagcctccagagtatctgggattataggcatatgccaccacatccagctagtttctgtatttttagtagagacgggattttaccatgttggccaggctggtctcaaactcctggcctcaggtgattcgcccacctcagcctcccaaagtactgtgattacaggcatgagccacagcgccaggccttaccttgtttttaaatgacaatctgaggtccagttggacctccggtgataactggcaggtaccatagttttgtgtgtgtgcgtgtgtgtgtgtgtttcttaatcagcgtctcagtttcaattctgacttggcttaatcatatttgaacttaaaggttaattttggttaacttaaaaatctgatgctttcaagagacagctttgttggaccatttaaagatccagttgttttttgccacccccctttgttttatatcttgttactaaagatgccaaactttaatgtagctcctttttatgtattttttagaattatgttttctgatttttttgataatgttccatgctcaaaaaataaaacacttgtataacagttggtttttattattatgctcatgaatgagggcttgatgtgggctgatcacactgactagtagttgggaaggaataaacctgtatccgagtacgaagtggggaacagggttttacaggacaaaggaataaaaggcttgagtctccaaaaagaacttaaagttattcttggtagggtacagagtagaaagggttgttaagagggtagaaggaatcagaattgcctgtagccttcgcttctgttttggactaactgataaaagatagacttacttgcataggaatgtaaattagataagtgagataatttcagctcttttttaacttactagcattgcttttatgtgctaagtcatgctttgatttaaatattaagaaagtgtccttgcttaaatcaatacttgattgaatcgatacaaaaatctgtgataagataaacccaggcggccagatatgatatcctaagaacaatgatagattcaatgaggttattagatgttgatctttcatttatgagggctttagcaaacactgcagaatattcaggttttgagagattcatacttacaagcatttaatttgttcttcactgtcaccctacaaggaggtatagcctcttgttctagtgtggattttttttcacaagcaaacacattcctccctacttgtacttctgcctcaactgaatcattttaagaatttaggccggacacagtggttcacatctgtaatcacagcactttgagaggctgaggcgggcagatcacccgaggtcaggagttcaagaccagcctggccaacatggtgaaaccccgtctctactaaaaatacaaattagctggggtgtggtggcacgcacctgtaatcccagttactccggaagctgaggtaggagaatcgcttgaacctgggagatggaggttgcagtgagctgatattgcaccattgcacttcagcctgggtgacagagtgatactctgtctcaaaaaaaaaaaaaaagaatttagatattacttatattgtagatgaatgtgatagggtcttttattattatactttaagttctagggtacatgtgcacaatgtgcaggtttgttacatatgtatacatgtgccatgttggtgtgctgcacccattaactcgttgtttacattaggtaatgtgatagggccatttttataacaggttaatcagactttggttttcattttggcacatttaatgttgaaatggatttaagcaggggtaaaattggcttcatcttcctttattatcattataaggtcactaggacatagttacattaagttcattagaacatagttataccactaggacatacttataccagtgtattttttaccccttagcatcaaaatctgttacccaaattttactctgtaaataagagaaaatatttttacaaatcttaagaattctttattcacttacatgttgtctgaatcaacttctaatttgtgtttttaaaaatggtagtatggctgggcacggtggctcacgcttgtaatcccagcacattggcaggcccaggctggcagatcacttgaggccaggagtttgagaccagcctggccaacatggtgaaaccccgtctctactaaaaatacaaaaattagccgggcgtggtggtgggcgcctgtagtcccagctacttgggaggctgaggcaggagaattgctcgaacccgggaggtggaggttacagtgagctgagatcatgccacttcactcccgcctggacaacagagcgagaatacgtccccccgctcccctgcccctccaccccccaaaaaatgctggtagttcatagaatttaattggaagagatcttagatgatctgatccagtccctttatttatggctaatttctctggtctcagtgtcctaaagtcactcaactagtttgtcgcaaagctagagattagagcctaagtcagctacatacttgttaccttttactagtacatgctgtctctcttggtctagaaagcagaatggaaaggctttctgtaggaagtgttgcctttgggaatcagaaataaggtcatttcatttctaactcatttagaagttgtcttgaacagtcaacttctagttttgaactataaatttattgtaaaattatttcttggagtgtgcttttggtctggattttaaatctataatgtcttcttctagttggattggatgctgctggcaagacaaccattctgtataaactgaagttaggggagatagtcaccaccattcctaccattggtaagaaagtttacagatgactttatatcatgatatgttgtaaagtgaaatatatacagtctagttttgagattgtctttttgttaagcatgttgattatcttagaagtacttttaaaacaggccgggtgtggtggctcatgcctgtaatcccagcactttgggaggccgaggcgggtggattgcttgagcccaggagttcaagaccagcctgcataacataatgaggccttgtctctgttgatgtttaggcttaaatatattttttaaaaataaaaagaagtactttaaaaacactattctaagaaaattccacaataaaaggttttattttcttaatgacgctgcacagcggtcatttttgtttttctttgtaggttttaatgtggaaacagtagaatataagaacatttgtttcacagtatgggatgttggtggtcaagatagaattaggcctctctggaagcattacttccagaatacccaggtaagggatactgtatgtttttataacttttctttgtgggtttcatgctctaaagtttttattagtatctagtatttacttggatattggtgtttactatgagttggcatttgtcttatcaccacttccacattcttcagtggactctcacttaggccttgaaggctaacttatatagggtggaagagttgtaaagcaattgcggtaagtgtttggaagatggggtgggtgctggtgtagttcacaagaatgaattaggtctcttatccgtagttctttgctttccatcttagtttagaaagtaaggtctgtataaactgtcattgtagtttctgatgaatgtaagacaattgatagtcctttgtttagcccagttacttgtttactttattaaatacagtaaagtcagttcgctgcattgatttgtaagatatttttatattgccacatagtatgtatatataatactggcatggaagagactttagtgatcctgtagaacaggagttctcaaatttgggggtggcacgtaagaatcacatggggacctttgaaaatcccaagacctggatcatcccctagatgacttgaatcagaatatcaggggatataatccaggtacagtagtgtttcttaaactttaatatgcatatcaatcacctgggtatttgttaaaaatacacattgagtccataggtcctagctaaggcctgagattctgtatttctagcaagttctcgggttgtgctgatactactggtctggtatcttacagcacagcactattgacattttgggctgggttattctttgttgttgggtatggggagggctctctatgcattgtaggttgtttagtggcatccttgtcctctacccactagatggcaatagcagctgccctcaagtagcagccaaaaatctctccacacctgcaaaatatcccctgggggcaaaattgctccctgctgagaaccactgttctaatctaactctcttacatatgaggaaactgaaacttggaatgacttacccaagatgggagagtttgttctcactctacctttgtttaacctggtcccacctcgattgtgttttctaccacccaaggaatttcttgtcagtttttttttattacttaataattttttttaagtgtgatatcactgccactttatatttttaagacttgcaatgtcatcttgttatcagcctcttaaaacattgcatacaagtggggtttattgccatcaggtggcagtgaataccctaggtgagtggctgggacaaccaggtttacatagtatgtcatattaaataagtggtatacttttttatttaaaaacgagaatgtttaggccaggcacggtggctcatgcctgtgatcccagcactttgggaggctgaggcgggcggatcacgaggtcaggagttcaagaccagcctgaccaacacagtgaaaccccgtctttactaaaaatacaaaaattagccgggcgtggtggcgcgcacctgtgatcccagctactcaggaggctgaggcaggagaatcacttgaacccgggaggtggaggttgtgatgagccgagatcacaccattgcactccagcatgggtgacaaagcgagactctgtctcaaaaaaaaaaaaatagtagaatgtttatggtcatcaatatagctgtgactagaaaagatacttgatacagaggcacatgctttaaaaagcttccttatggaaaatgttaaatacaaggtgaacattccttatccgaaattcttgggaccagaaaccactgtttctgatctcagaattttgggggttttggaatatttgcattgtacccagttgagcattctaaatccagaaatccaaaatccgatatactccagggagttttttctttgttatgttggtgctcgggaagttttggatttggatttttggattaaggaaactcaatctgtacacctacaaatagaatagcataataaactcacatgtatgtattatgcagcttcagttactaggatataagcagtgctgtgttgtttcatactcatctctaatgtgctctaccctctagacagtttgtttattttttttgagatggagttctcgtcctgtcacccaggctatggcgcaatcttggctcactgcaacctctgcctcctgggttcaagcgattctcctgcctcagcctcccaagtagctgggacttcaggcatgcgccaccacacctggctaattttgtatttttagtagagacggggtttcaccatgttagccaggctggtctcgatctcctgacctcatgtgatccacctgcctgggcttcccaaagtgctgggattacaggcatgagctactgcgcttggccaatatattttgaaagagttagatatgaagtaaaaccttgctaatccttaagcctaataattcttgaccaagggtaaccctgggtttatccctagatttgtttagaatgctttgtaatttactttgcattcttaatttgaaattagacccaattctggcctctttggaccatctgagaattaaaagtctaagtactgcttcctagggagttcatgctagctggggaaagctttatgtgttacctgatagaatcaaagctaagctcttagcttgcattcccagcattactgatcagttctcctagctataaaatttaaaagaaactatagctttaaccatgtttctaacttatactaacaaaccatggcacagtgtgtagtaaattcctcttataattccaactaatttgccattgtaaataagtaaatatttggcttttcaaataatttcatagcagctgggcttatctgtagaatcctagcttttcttcactcttgattctaggctgttccaggaagaaaataattagggattaatacctaaaataattctccttctcaataatgtcactttgggactgatagcattatttgcattttaaaacaaaggctgggtgcagtggcttatgcctgtactctcagcactttgggaggctgaggtgggaggatcgcttgagctcaggagtttgaggccagcctggggaacatagtgagaccctgtctttacatttaaaaaaaaaaaaaaagaataaaaatgggaagttagcagtcaaaataaaattaggtcccttttaggggcattacctcttgtaaagggtaggtttcaggaccgggtgctatggcttatgcctgaaacaccaacactttgggaggccatgatacgaggatcacttgaggccagtccaggcaacagagtgaaaccctgtctctacaaaaaaaaattaaaaaaaaattacctgggcatggtggcatactcctgtagtcccagctacttgagaggctgaggtgggaggatcacctgagcacaggagttggaggctgaagtgagctacagttgcgcctctgtactccagcctgggggacaaaaggagaccttgcctcttttttgaaaaaaagaagaaacaaaaaaatggaaggtttggttctaaaaaggagtagcttttgaaatatggaaaggaggagacatatttgctaaataaatgcccatgataagccaagaacaatgatcttttatatctctgtgattgcatttaatctttaacaagcttatgaagttagtatttttattttatttagacgaggcatagtcaaggattagataatatatataacaagtagtataagatttgaatttgagtctgtcttcccaccacactatattggctcccaaagcatcaaacattattttttgtttttgagatggggtctcactctgttacccaggctagagtgcagtggcatgatcatggctcactgtagcttcagtcaacctcctgggctcatgtgatcctcccttctcagcttcctaagtagctaggactatagacatgtgccaccatgccctactaaaattttaatttttttcgtagagacagggtcttactctgcccagggtgatcttgaactcctgacttcatgtgatcctcccaccccagcctcccaaagtggtgggattagaggtgccatgccagccaaaagttttctcaaaggataggatatttaaagtgatggttttccaggtggtatagatgcagtgtaaaataaaatttaaaaattaagttatggtttccaacagagataaaggaaatggacttacaatttgctaaaacaaaggaaattgtcatttaatggatgtaaaataagtgttagatgctcctggagagcccagtactgtggtaatcctgagaggtaaacagaaaatgatgtaggatggggctgggcgcggtggctcacacctgtaatcccagcactttgggaggccaaagcaggcagatcacctgaggtcaggagttcaagactaacctggccaacatagtaaaatctcatctctactaaaaatacaaaaattagccaggtgtaatggtgggcgcctgtaatctcagctactcaggaggctgaggcaggagaattatttgaaactgggaggaggggtttgcagtgagctgagatggcaccactgcactccagcctgggtgaaaaaaaagatatagtatagtcctttgcccttagtggatgtaatctagttccttttttttttttttttttttgagatgtagtttgctcttgtcgcccaggctggagtgcaatggcgccatctcggctcactgcagcctccgcctgccaagtagctgggattacaggtgtgccaccatgcccggctaatttttgtatttttagtagagatggggtttcaccaggctgatctcgaactcctgatctcaggtgatccacctgcctcggcctcccagaatgctgggattacaggcgaaagccacctcaaccagcctcgttacttacataaatcagtagtgcaagacaatctgttataagtgacatgatcaaaattgatactttaggagtcaaggtttatctttttttcttttttattatttttatttttgcccccccccttttctagctgaaaattctatactttcccatttgaaagttcttagaaaaacagttcaactagttgcttcctaattccttccatttattttgtagtatagaattctaataatgggccaggtgccatggctcatgcctgtaatcccaacactttgggaggccaagatgggtggatcacttgagtccaggagttcgagaccacatgggcaacgtggtgaaaccccatctctacaaaaaatagaaaaattagctaggtgtggtggcacgcacctgtagtcccagctacttgggaggctgaggcgggaggatcatttgagcccagggggtcaaggctgcagtgagccaagattgtgctactgtgctcctaggcaacagagttgagaccctgtctgagaaaagaagctaatatttgtatctctaagaattgataactaccttcctttttttaaagaatgtcttactcgatcaggtaaatcttgaatttttctttctttttttttttaagagatagggttttgacatattgtcctggctggtctcaaactgctgggctccagtgatcctcctgccttggcttcccatagtgctgggattacaggagtgagccactgcgcccagtcttggatttttcttgctatcattttcttaagatgtcttcctgatctagagttggcaggcagcattctgaagcaagttaattttttccttccatgatgaagcagataaaaactgtagtgtacacactcgcgctatcccaccccccttttattactctgtacatgcctttgagtcagtaagctaattcagttagtaaattcatggggtttttttgtttgttttttgagatagggtctcgctctgccacccaggctgcagtgcagtggtgcgatttcagctccctgcaacctccgtctcgggctcgtgattcctcccacctcatctcccaagtagctgggactaaaggcatgcaccaccacacctggctaatttttgtatttttttgtagagatgacctttcgccatgttgcccaggctggtctcaaactcctgagttcaagcaatttcaggcctgatcgtttgcctcagcctcccaaagtgctgggattacaggatgagccaccatgcctggccaaattcacgattctttaggatccttgatttgttatttttctttttgttcctactttgtggctattttggtacctgcacttaaatgtgagagtgcagagggaaggggaaaaatagatacaatttattcttagggtagttgagaaaagtaattaattggtgaagaataaaaattttttagatttgaaatagcactaataaattaaacttacaaatagttctcaaatcagcttttagcattacagccttaagttcttacttttaaagagacattttcttcctaatgtctaaccattggtaccattttgctgcctacactgtttcatatagagagtgtcgtttaactgttaaaatttactgaaacaatttttccccagggtcttatttttgtggtagatagcaacgatcgtgaaagaattcaggaagtagcagatgagctgcagaaaatggtaagaaatatactttaaattcatcattttcaaggtgtgcttttctggattaaactggtggtggtttagtacattttgactatgattagattacacaaatggattgggggggctagaaataaacttaagaaactatattatccacaggttcttaataatgtacttcaaaatctcttatagagcgttttaaaaaacacatggaagagtagctacttcagtaagttgggaggaaggcagagcagtgttgttttttttttttttagaatgcctcatgggtaatcttgatgcctatctctggctgaggatatctgatttagctcagtcccttactttacagatatcaaatctatagtgctgtagtggttttgaccctaggaatcttggttcagatgttttgttcccaaggtcatcggttccattttctctatgctgtgccaataattacttcagaaatgttttttaatagtaaccatttaaggataaggaattccttctgaaagtagagacaaatgtttggttcacagtggcattttgcagccttcccatagattggattaatgttttcatgtgttcatgttgttaaatgtactaaatggaggaagactgctgagaatccttgtcatgattttaaacttgtagccataaaatatttactgaaatgaaatcttaattcttgttcattcctcctaagattagagggcagtttgtaaaaccattgtgccagtatatgtgtaactaagtcattgttggatttttgcctgagtcaaatgtcaccagctttccctcttcaaaaaaaaaaaaaaaaaaaaaagcttggttgagacatacttcacacactataaatgtcatcctttttaaatgtgcatatcaatggcttttagcatacatagttgtacaaccatcatcacaatctaatactagaaaattttcatcaccctcaaagaaatcttggaccattagcagtcattcccatttccttcctctcgtacaccacactcccagcctctgacagccactaatttgtctttatacagtcacctattctggacattcatataaatgaaaacatacaatgtgttcttttgtgactgattttttcacttagcataatttttcagggttcgtctatattgcatcatgcatcagtacaacttctgttcttggtactttttttttgtatatttcatgatactgccaacacccagataattgtgttattgtcccactgttgttggaaaggatagaagtccgaaaagaatcatcatctatctaagtacttctgctactaagtaccataagaacctgccataaacattttattcccacatgtatttcttgcccttatcagtcctgacaatgggtaatcatgaaggctgaatgatgagtgatttgctttaatttaatggggtgtaggatgattgacttggaaaacagttctgtcttatttgaaggcatatgattgtttgctctggatttaaaaactgaaggatatgagacttcagttgtaagagtgaactttgtgtcgagaaattaggttaatgtttaataatgtatttaatgctgagtaaagtatatataggaagacattttcaaaaattggattccggttggtagttgttaatgccttaccttttatttccagcttctggtagatgaattgagagatgcagtgctgctactttttgcaaacaaacaggatttgccaaatgctatggccatcagtgaaatgacagataaactagggcttcagtctcttcgtaacagaacagtaagtatttggaggttgatattaacctcttgactattaagacttactaggatagttgtgtaagctaatattcagtttaaacatttattatctcctttggacaaataatgagcacatcatttatttaaaaatatggtaataaactttaaataccttatttgatttttgtaaagaaacggaaaactactgtagaataggtctaaagattattgatagtttcttttttctttttttttttttttgaagggagaggtggaaggaatggaaagaagattattgatagtcttaattttaattttgtatcttttaagtaaccctacagcaaatattttgaaatctggctttcttattaagggtccagtaatgtttgtttgcttgttttaaaagtggagatggggggctgggtgcggtggctcatgcctgtaatcccaacactttgggaggcctaggtgagcagatcatctgaggtcgggagtttgagaccagccggaccaaccagggagaaaccctgtctctactaaaaatacaaaattagccaggtgtggttgcgcatgcctgtaatcccagctactcaggaaggctgaggcaggagaatcacttgaacccaggaggtggaggttgcggtgagtcgcgatcgcgccactgcactccagcctgggcaacaagagcgaaactcggtctcaaaaaaaaagtggagatggggggtctcgctttgttgctaggctggtcttgaactcctggactcaagcaatcctctcactatctcagcctaccaaagcgctgggattccagccatggtgcccagccttgtttgcttgttaacataacagtttatggaggagaccaggtaccacggctcacacccgtaatcccaatactttgggaacccaaggcaggaggattgcttgaggccaggagttccaaaccagcccgggcaacaaagtgaaaccctatctctacaaaaataaaaattagctgggtgtggtggcatgtgcctttagtcccagctacttgggaggctgaggtgggaggactgtttgaacccagaagttggaggctgcagagagctgtgattgtgcccattgcaccccagcctgggtgacagagcaagactgtttctttaaaaaaaaaaaaaaaaatttgtacttctctaaaattgcttatcattgatcagtgattcagtgatggagataaattatcagaaacttagtgtcataggctttttacagtagttttgcattaacctgtaaataagggaaatactgtggctgtggtaaaaaatgaaacaaacaacaaagaacctattgcaggccgggtgcagtggctcacgcctgtaatcccagcactttaggaggctgaggtgggtggatcatgaggtcaggaattcaagaccaacatggccaagatgatgaaaccccatctctactaaaaactacaaaaaaattaggtgcagtggcaggcatctgcaagcccagctactctggaggctgaggcaggagaatcacttgaacccaggcagcagaggttgcagtgagccgagatcacgccactgcactccagcctgggtgacagagcgagactccgtctcaaaacaaacaaacaaacaaaaaaaaacaacctattgcctgtttgagatatctcaggctgatttgaagaacataaactgggccgggtgtggtggctcacacctgtaatcccagcactttgggaggcgaaggtgggcggatcacttgagaccaggagttcgagaccagcctgggcaacatggtaaaactctgtctctactaaaattacaaaaattagctggtcgtggtggtgcatgtgtgtaaccccagctacttgggaggctgaaggcacgagaatctcttgagcctgtgaggcggaggttgtagtgagccgagatcacgccactgcactccagtctgggcaagagtgagtactctgcctcaaaacaatcagtcgatcaatcaataaataagcaagcaacactaactgtaaatgatacaagttttccatgctgtgaaggtatgaatttgagcctttccccagcctcctaggttactgagatttggtattcaaataattggcaacatggtatacctgcagtggccttgcaacattaaactggtcaaaaaaattaataaaagtaaactatgccttaaatgtaaattgttttctaggttttttttgatactttcacacagttactagagataagattcgttgccatttaaaagcaagaacgttttggaatgcatgagactaaagatggtgaaattgtctgaaaagcttgcccttaaaatatcaacaaaccctactctttctttctttcttttttttttttttgagatggagtcttgctctgtcacccaggctggagtgctgtggcacgatctcggctcactgcaagctctgccttctgggttcatgccattctcctgcctcagcctcctgagtagctgggactacaggcgcccaccaccacgcccggctaattttttgtatttttagtagagacagggtttcactgcgttagccaggaaggtctcgatctcctgacctcatgatccatccgcctcagcctcccaaagtgctgggattacaggtgtgagccaccacgcccggcctaacaaaccctactctttcaaaaatttgcctcttctactttgagtttagttttatgggaaacgagagttataaaaaccagatgggtagtttattagttactaatttccccatgatttcttttttcagattaagtggtagaaagtttactaaaagggaaccaaaaaccagcactgaaaagaaagctgaatgaggggggaaaatcttgtctaaatataatgaataggtagaagtagcttgattgattgagacggagtctcactctgtcgcccaggctggagtgcagtggcacagcctcggctcactgcaacctccagaataggtagaagtggctttatttttaaaaaataatttaatctaaaaaagtagagacaaagtctcaccatgttacccaggctggtctcgaactactaagctcaagtgatcctcccatctccgcctcccaaagtgctgggatttataggtgtgagccaccacgcccagccagaagtagctttaaatatgggagagttttgtgagatgcaagaggtgtgaaaagactcttaagtttgattaagaaagtttaaacactggtgttatatattaactttgttaatcaagtattttcttgtcttctctttacagtggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaa

SEQ ID NO: 35774 - DNA, 32034 bp, Homo sapiens
gtggatcggtgggtttatctcaaggcctgagtagccggtaacaaacgagggttcccgggattggaccgacgcagccatggtaggtccagatcccgtagaagggagcggggtcccataggttacggccgattcctggagcttctggactgagggccgcggtaagcagtggtctgggctcccgctgcggccgccgcctcaggccttgcggggtcttggtcgtttgattccaggaagggagaaggcggtggggcctaggggaccggggtgatttggggaggcaaagcctgctagtgaggggttttgtctcccctggcgcttgtggcgcttgccagagctcctgcagtctgcagcgggatcggtggtgtagggaaacacagaagccgaatgtgttgaactccgtaggaggctttggtaaaactaaagtttgcctttaaaacggtggtagttaatctacactcctgttgggcttattctggggatagtgtgtgctggctacaaactataaacaagcaaagaagccaaaaacaaatgtatatggagtcaaaaatggaatttcaaatgctttgatatctcagctgttaggtttctaaggggagaagaagggttgggaggaagggggtgctgtttataacactggctggtgtgcttttatgcatttgcaaatccagtggctggtaagaatagtaattgttagagcactttgttattatcaccgtaaccctaaaaaacgccctagactagtttgcacaagagtgttataataataaggaaagaaaacgatagtataagaatatcttccgtctctattgaaaatgcaaaaaaaaaaaaaagaaattagccgggcgtggtggcgggcccctgtagtcccagctactcaggaggctgaggcaggagaatcgcttgaacccgggaggcagaggctgcagtgagccgaggtcgcaccactgcactccagcctgggacagagcaagactccgtctcaaaaaaaaaaaaaaaaaaacttgttatgaagcacagaatcaaacattttggagcttgaagacgctagggattaagtccctcatcttaagttaaaaaatttttttaaattatgtttctacaaggttaattgtggcaaagttggaactaggaaaaagttaggaatactcccagggaaaatgcacagagaaacaaacatttttgcataaaattcagtgcattcattcacagacacccccccccacaatccatggaccttctttttttttttaatttgttttataaaaaatatggaacgcttcacggatttgcgtgtcatacttgcgcaggggccacgctaatctcctctctatgtgctgccgaagctagcactatccgtggactttcttgggcacccaggttacagtccctgaacaagacctcaagcctcttaattagagcacttcgtattactaactacctgatgtagtttgggtctgctgtggttgcagtaatggacgtttttggaaaaggctcttggatctgcctaatttcattttcttttgccgtctttacatttaccagtgtatttctataatgaaatattgccttcattctttatatattttaaatcctttgtggaaaatacaaaacgtgaattcattcatttgtacatttaccatagaatatttagtgtctgccatgcactttgctaaacatggctgcctaattctcacagcagctgggagatagagttatatgtttgtgaagtggttactgtaggtcaggcactgctctaactggctaactctgaatttaattcttacagcactaagaggtagataataataatattcctgttttacataagtcaaacttgaaagaggttaagtaaatttgcccactattgcacatctgaaatgagtggtggaactgaaatttaaatccatcatggctttctagtcttgtgttatggtatctgttcttaaacccccatactcaaatatataaggtgatctggagataaagacatgtataagcaatgaccctggctttaaggaggatctactctagaaagcaagaaaagatgtgtacacaagtgtaccatgaacagttaaaatgaaatcctataggattccctaggaaagaatgcttcaggctagggtaactagaaaggtcttactggtggcagtggcatttaagctgagtcctaaatgcatccagcttttggaaggtggagggatatatttaaagttgaggatacagtgtgagcatcctaatcatctttgtcccaaagtacctagtacattgtcttattcaaaatagtcacttaactgttgggagaaatattatcacaagaacccttgcctgttcgttctttctttcttttctttcttttctttttcttttctttccttccttacttccttctttccttctttctttctttctttctttcttgacagaatctcactctgtcgcccaggctggagtgcagtggtgcaatcgtggctcactgcaacctccacctcccagattcaagtgattctgcagcctcagcctgccgagtagctgggactgcaggcgcgtgccaccacgtccaactaatttttttttttttttttgtatttttagtagagacggggtttcaccatgttggccaggctggtctcaaactcctgacttcaggtgatcctcccgcctcagcttcccaaagtactgagattacaggcatgagtcaccacgcctggctgcctgttcttttttaaactgagatttgtgctttgggagtatgtagaggtttactggggttgctcagagttcattggcccaacttatggagcatcacttttactcaataatcaataatttaaaatattttaaagtaaaatgttcacaatttgtaagtgtccaatttcctcattactggaggaaaattgtgagacatgctggcttatatgaaaaccctcaccatggttcctgcctggtacataatagactcttcatacctgttgactccatagagatttaaaaagaagttaaaatttgtaatagtaatttatggggcagaattcagaaatgaagtaaaaagccttgattttgggaactagcaaggaatgttaagatgatgatttgaaagtggaaaattggagctgggagaccgaggtgggtggatcacaaggtcaggagaggagttcgagaccagcctggccaatatggtgaaaccctgtctctaaaaatacaaaaattagctggacatggtggcaggcacctgtagtccccagctactcgggaggctgaggcagaatcccttgaacctgggaggtggaggttgcagtgagccgagatcacgccactgccctccagtctgggcgacagagcaagactctgtctcaaaaaaaaaaacaagaaagtagaaaattggagagaggaagggactgatgacagtgaaaacatttttgaggagattgaagagaagagccagagaactctgatcttttaaagtaagaggtaaaggttgttgctgaaaatgaaggaggcgtgggtagaacaagacttgaagtagtcaatgacccaaatttgataaaaatccccaaaaaagatgagtaaaagcattgtgaggtgttttgtctcaggaagttgtctctgctagatcttctttttatattcaaaagtaaccttaaatttctgtcccattcatgatcatcatagaagatcacagcaataaagatttgacagtaactcaacttgccaaatgagcttttaggttgtgtttaagacctgttgaaggggaaatatattttaaatcagtcttttctcagcatgcctcctagagagaattaagcccactgccctaaggatcattgtatatattgaattaacttttctcctataatggcattttttggagaatggagaaaatagttattcaaataattatctgttctgtaattcaaaggaagaatttggcttgaaaatgctagtataaactattcatattttctgacttgagagaatgtttttatttttgttttaaatttttccaattttcattgtttctgtaatttaaatccattaaaatatttcagacattcccatttgataccaaaggccatcatgcatagggatataacccttattgatcacacattatgttacctagcatttactagtatttttgacaagataaatctaccatttttctccaaagaactcaatattatgctttatggttactaggacttcatgaataacacttcttcagaatatttcctgatatgacactattgacctgggcacaaaattgtgatttgtgaatatttaaaattcattggccgggtgcgggggttcacgcctgtaatcctagcactttgggaggccgaggcgggcggatcacaaggtcaggagatcgaaaccatcctggctaacacggtgaaaccctgtctctactgaaaatacaaaaaattagctgggcatggtagcatgcgcctgtagtcccagctacttgggaggctgaggcaggagaatcgcttgaacccgggaagcagaggtttcagtgagcagagatcagcgccactgcactccagcctggacgacagagcgagacttcgccactgcactccagcctggacgacagagcgagacttcgtctcaaaaagaaaaaaagtaaatttatttactagataattctatgaactagaggttctcaaaatgtggtctgcgattccttaagagtccctaaaactctttcaggaggtccacaaattaaaattattttcttaacagtgagacgctattggcacctttcacaatgttgatatttgcactgatggtgtaaaagtagtggaaggtaaaactgctagtgaagtgacaccaaattgtactgttagtatattcttcattgtgacagttttttaaaaagtcattttcacttaagaatgtcattgatgaaacagtaaaaatgttattacctctccacacttgagtatgcatcttttaaattctgtgtggtgaaatggggagtatgcataaagcagttctactgcataccgaagtatcgtagttgtctcaaggggaaacacttgtagcgtttttaagttgtgagctttacttgaaacaatgactgagaaactctgcttattcagacttgaatatttggtcgacattttttaaaaacctgaaagaggttggctggtccctgacagtatttcttgccaatgataaaattaaagctttcaagtgaaagttcgaattttgaaaaactcactgaacttgatggatttccaatgcttaaaggcttatcagttgaagtaggtggtgaaattagtgaatgtgtaatttttttaatacagtatcatgatgttgttagcatctagaagatgtgcataattcagtggaccagcattttccaaacgaccaatgcttaatggtagaaaaacatgcatgagagaaagatccattcaaagtatggacttaaccaatggattttaatgtaacgaagtataaacagcttattgatacggtttcagattttaccttgcaagtagcctttaagaaactaccacttctcgaatttcgaagaatttcaagtaatgaaaaaactattaagatactcctcactttccaactaggtatctgtgagaccaggcattattttgtagacattaaccaaaacaacatatcacaacatattgaaggcagaagcagataatgagaaaccatctgtcttctgttaagtcagattataaagagttctgcaaaaatgtaaaatattgccactcttttcactaaattttttgaaaacatagttatttttcataaaaacatgttattttaattaacatgtactggatttatttttgttatttgaaaatgaattaatatataaatattttaaagttgtctcaggtttaatttttaacatggtaacatgccaatagctaaaactcacataaacaaaagctcttaggggtcctcaaagtgtttaaggactataaaggaatccttagagcaaaaagcttgaagaccactgctgtaaatcttaaaatgttgaatattctgatttttttgatgtgtaaatgaagaaataagtgcttagacttgaaactgtttcaaaagcttagcaaagtagtagctgaattgttttgtaggcctattcatgcacttatttagttaaaatctcaaacatattttatttggcttagcaatttaatttttttaatgtttctttttagcctctgcgacttgatatcaaaagaaagctaactgctagatctgatcgagttaagagtgtggatctgcatcctacagagccatggatgttggcaagtctttacaatggcagtgtgtgtgtttggaatcatgaaacacaggtaggaatttttcaggactgtattagaaataaaatactatgtgagactgtgtttataatgaaagagaagaaatattataacagaatccagaatctatatgcaaactgctttctcaagttggtacaaagtattttaaatatgaaggaactaacatttatgaggggatagtttgtaggagaaactgtcctgggtatgttatatacaatatttaaatataacaactctgacttaggtagtattagctcttttttgaaattgagaaaactgatggtattatagaatcacttgctaaagtatttaatcgttagttttccattcagtgaatactctatcttaagaatgatatcgttaaatttatttttctcccagatgcccaatataatgatacacagataaatctttcactcagccatatagattatatcagggaaatatttatagtcagcttttgattatacacacatcttacagattgtctgcctgaatgcttgactcattctctttcacctgagtaaataacatatccttcaaattagtttgtctcatattttccagtcttcctagactgtatttaagagtacaaagcatatagttagcactatactatacagttgtgtctacttatatagtaattatccttaacgtccaaagttaagttcttgaaatccaggtaaaattcgcatttgaggaatttaaaatggcaaaatgacatcaaggaaccaaagccagaagtaaacctaaaaacacctttatacttttatactcactgtaatgaaacagaaatgactgtacactaaactcataccctgtattagtctgttctcacactgctgtaaagaactacctgagactgggtaatttatgaaggaaagaggtttaattgactcacagttccacaggcttaacaggaagcatgactgggaggcctcaggaaacttaaaattttggcagcaggtgaaggggaagcaagcaccttcttcacatgatggcaggagagagagagcaaagtgggaagtgccacacacttttaaaccatcagatctcatgagaagtcactatcacgagaacggcaagggggaaatccacccccatgatccaatcacctcccaccagggtcctcctccaatttgacatgagatttgggtggggatacaaatccaaaccatatcatagtccatcagtgacattttatataaattaacattttgttttctgctgtatctcagtacctataacattacctggcacatagtaaatgctcaataattatttgttcaaccaatgaataatatgcatttcacttatcactagttcagtatttgtgttctctacaatttcagatctttatcttgtgaattgtttttgctttgatgcaaataactttttttttttgctttttgtttagttcttgagatgtttaaaatatttctgattttatgtttaacagatacgttggtgtcctctctctctgattattcctagggattccctcttatcagctacatttacctatctcagctctatcacttgatcatcgtatgttctaaagcccaggcgtacttttcttatctttctctaggctttattgtaatatatctctgctttatctgcatttccactttgcctcctttttctcttctatacctttttctgccctatgacaggaccatctgcttcccctttcataattcatctcagtggtaatttcatgtttaatttccttctttcctctaagaatggaggttctgtgaggacaaggattaccctcatcttatttcccactgttggtccagtgcatgaggcactacctgatacactgtcaggctcctggtagatagtaagtctttgttgaatgattaatctgtctttgattctccctgttttttccctgtgtttatatcaccaacagcatttaccactcctatattgagagcaaattcttgagagagccaaaaaggtttttggaagtaaaaaggtttttagatgtacttgaatttcaaataaggagatgctatatattctttgaggtggtacatgcagtggtttaaaaaacatagtattttaggatttgaagccaacttgctgattaaattatataggcaagccttttaaccatgctgagcctctttatttatctgaagtgaagatgatattattgccttgcctacatcacaggattgtcaaaaagataaaataaaattagataaaattgtgtatgaaacctataaagtaccatataagtattagtcattagttatactttcctaatctacgttgagtatttgtatgtattgtgtgtgtagcttttcttactctttatttgcatcagtcatagcccctaacatggcgttgaaccttggctatttcttctgcagctgctttatttttactgctcagcagatccctggatttgttggctcctcatgagcttttgtggatttttctgccgtgttatagatcgcatgttgtgtctactctcagtttctgtatcatagtcagctggtagtgattctacaggttagagttgaagtgcctactcattcagcctttgtctaaagaatctttgaactctggcttgaaaagtcagagtaggacagttcttatgaaccggtccctattacttttttagtgcacatggttaatcaatcagtaagattatattgtgtttcttagttatttcatttttgctctctgatacaaaaaaggattagaaaatgatagtttgactttcagacttttaagaacaggcatcaaagaaggagaacaaagaggtaccatgatctctgctctttctaggagggtctctacctttatcctatgtgtataattccattctgagcagctcggaggaacatataagtcacggtgttttcatattttattaaaaagaaataataacatttgtatggaatcatattgctaaagcatgcaaaagaattgtaccttattcatgagtcacttttatgggtttcaatttcaaaaagactgactaggtgcagtggctcacgcctgtaatcccagcacttgggaggctgagacgggtggatcacttgaggccaggagttcgagactaccctggccaacatggtgaaaccccgtctgtacgaaaaatacaaaaatttgcttggcatggtggtgcacacctgtaatcccagctacttgggtaactgaagcatgagaatcacttgaacctgggaggcggaggtcgcagtgagccaagattgtgccactgtactgcacttcagcctgggtgacagagtaagactgtctcaaaaaaaaaaaaaaaaaaaaaaagaaaagaaaaaaagaaactaagagctaattcattcaacaaatatttattacacactacttgtgtgccagccactgttctatcctctgcctatacagtgtgaaaaatattcctgcctttggagagcttagcaggaaagattggcactaaacataattatgaggtgctacattatgaaagggaagtacaagtttccatgggtggattttcaagtcagagacaacaagagcagaggtgaggctgggagtagccaaaggtgaggctggaaaagggagggaagggctggagcacagaggatctggaataccatcttgtggatatttgccttctcttatcttttaaaaagtgttttaatttcgaatctattaaaagatagttggtcttttttaaaaatttgaatgttgagcttttatattttagcctgagaatatactaaaatgagaagtgatcttaaaaattggatgtttgaaatataacagagtagattttgtggttattttcttatagctcaatttgtgtattcttgttacattttaaagacactggtgaagacatttgaagtatgtgatcttcctgttcgagctgcaaagtttgttgcaaggaagaattgggttgtgacaggagcggtaagtaattaatatgaatctctattcccattttctgaattggtcaatgattgtgtaaatttgttgcaggattttgattcccgatttgttttgttatttacagcaatgttttgaggcatagactttattccttgagcctgtgatatagtttttttgtataatttacttgataacagggatgatggttttaaaatttctgtttctaggatgacatgcagattagagtgttcaattacaatactctggagagagttcatatgtttgaagcacactcagactacattcgctgtattgctgttcatccaacccagcctttcattctaactagcagtggtaagagatgaccttttttggtcatgtgcgtctctttgggtaattcattttcattcactgagacatgctatgctttaactgctgttacaaatataattctaattccaagcggcctttaaactatttagatccattactgtgctattgatgctgcttgtgtttgtactataatgaaatatcaactgtacttaggatttgtgtaatgattgctccagttcctgtcagagaagacctacaagtctagatgtttaaacatctgctgaacagaaaggtcatttacatgttgatgagtgagtttttggcagattgccatagaccctattcagttcaatctttatattcaaactagtttgctccttggtattgtgtataaatagtagacctcttggaggactggaaaaagaggtagcactgaattagtaatagctctttgaaatgtttttaaattaaaaattgagaagtaattaaaaactttttaaaaaccaatcttgtgagggcaaatgcttgttctctacatagtcattgctatcactattcagtcatgcttagatctagtcaaacttatattactctttggccattctttaatgcccactgaatttttaagttttttcacagaatttttatattttctatttctaatctattttatttattttatctccacttttctgtagagagttaaatttatttttaagataaataagcattttgaaaactctatttggttttgattctatttctgtaagtcatggattatatggtttgtgttaggtttgcttcttctaaagactgtgtcttagttatgaagtgaaaaaatagaattacaactaacttgagactttcttttggcctagatgacatgcttattaagctctgggactgggataaaaaatggtcttgctcacaagtgtttgaaggacacacccattatgttatgcagattgtgatcaaccccaaagataacaatcagtttgccagtgcctctttggacaggactatcaaggtagggcatccacattttgtgtcagttatcattattagtgaactatacttgccttaggtgttttactgttgactggtcagaaatgtacccatcttaaaaattttcctcaaaagcctgttttgaagtcaaaataggatttctcattttaatccaaacgacatgttctgtttagaaaaatattgtggcaactcagtgctcttaatgaggagcgtttttctgtgtggaggcagcatgttataaaaattttttagcctttggaaacccagaataagaaaaatgccaatatctttttaggatactactgtcctctccttttagtattcattgttgacttctgctcatcgtttatctattttacatttaaattccatatgcctctattctctctttcttactccattttaccacactgctgtctgttatctttctgaaacagttcctgatctaaggataaagtccaaatgccttagtgtggaatacaaggatttccaggactagcctgggctaatattatgcgacatctcctaaaaccctggtctactcaccatcctctagagaggctatgaatgttcacaaaaccttacttcattgaactgttccatcttcctgcacttctctttattttcctattttgatatattttcctccggagaattactcagcttttaaggtttagcacaaatatttactcttgagaacctcttgtcagacatcaacttcacctctagacagagccagttatgcttatcccatttcttccattgctttttgcctctgtttcagcctttctcagattgaattattattacacgtttttggaaatctttatcccctgaaatactggatttgggggatagaaactgtgtcactccctttccccagccattcaatagcaaacagcaaagtgccttacctgacctagatgcttaatacatgttgcagtgagggcaatcatgcttcttttttttatcataatatttaaaatatttccatgccaggcacggtggctcacgcctgtaatcccagcactttgggagaccgaggcaggtggatcacaaggtcaggagatcgagaccatcctggctaacacggtgaaaccccgtctctactaaaaatacaaaaaattagctgggtgtggtggcaggcgcctgtagccccatctactcgggaggctgaggcaggagaatggcatgaacctgggaggcagagcttgcagtgagccgagattgcgccactgcgctccaacttgggggacagagcgagactccatctcaaataaataaataaattaattaattaattaaaatatttccatatgcattgacttaaaataaattaacttttgcttacatgtttgctttcacctatataaaacactgttagtagttttcctttatgtaaaatgttatgtgtctgaatatcttagggttttaaccttagctattttgcctttgattggattatccttgcttttgacatagattaactttgaaattagttgtaaacttttatttttactaatttaggtttatcttgagaacaataattgtcttatcttcagttccaataaagtttattttatacagtaattgataaacatttgttacacgtttatactccccacagggcctcccatataataggcactcaataaatatttgtaaagataaagcttaattctgtgctgtggtaatttttaacaattttctacactttaaattggtaattaggcagtaattttctccttttaataggcctttatttttatttatttatttatgtatttttgagttacggtctgtgttgcctaggctggagtgcagtggcatgatcacagctcactgtaacctcaaacttctgggctaaagcgatcctcctgcctcagcctcctgagttgttaggactacatgcgtgtgccttcatgcccagctaattttttactttttacttttttgtagagacaaggtcttgctgtgttgtccaggttggtcttgagctcttgggctcaagtgataacttccatctcggcctcctaaagtgctgggattacaggtgtgagccaccacacccagcaacttttaatatatcttactaaatctactttcatgagctgtatattaaatctataataaaataatttcataacatctagattcctgggcgtcactgtggattgactgacttataatctctagagataaagcctggaaattggcacttcttttaaagaacgccatagtgattttgctccctgaaaattcaagtaaaatgagaaagaacaaaaaccaaacaggataaaaaataaaatttgatagctcttctctcctgggctttggcattttacataatgtgtcagaaatatggtggatttgccttttgtaaagcaaggccccatattgactggccgatgctgtttctctctgcaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcaggtacagtttttcataaccttacttccatatgttagatatgtttcttactatttcttataggacagttaagacttgggttgttgaaaactgttcacagcataataacttaaggtatcagtatttgcacctaaactgtgttcccagaattctccataaaaatgaaaacaatgcatatcaagattttaaaaataaaataccaacatgttcatatttcatttcataattgcatttagaaattttaacattttaatgttgaattatcctccataatcttcattgatagacttctattcatttttgtaagctagcagatcaacaattaccaaccattttgccaaatcgtactcttgtaaacctagttatgaattcttgttaacatgcttcctatctctaagattttcttatattttgatatttttgttttccacatcaaaagttcccataagcaattaataaaatgaggtctagaaagtcagtttttccttgaaacattttcagatttgtacttaaatccagaataaaaatattaaaggctaaagcagcactgtctacttagccagtgatggtaggtgtgagttttaagggggaaatctattatcctgagaatttgggggaataatattcagacaaaagccttcttgggtttttttccccttctttaaatgtgatagttacatttacatttattttacaaagtaattagataaaatattcatatatacaacaagatcatcctatttcaaaaatttctatattggatattatttagattttcatgactactatcatttataatgtatctgtacactgagaaaattaagggcgggctggttacatgtttttcattaataaaacatgttttctatgtcttaattacagaataaaacatgtgtgcagacactggaaggacatgcccaaaatgtgtcttgtgccagctttcatcctgagttgccaatcattatcacaggttcagaagatggtaagttagaagggtatgtttattcctgtgctagtaactactcagtgggcatttaaagcaagtaatgtctctgcattataattgtaggtttccaaggattttgatatttttattaaagtaccagacttaagctataaaagagtaaaggggcattattttcatcatcatcatcatcatcatcatcatcatcgtcatcattctcatgtattttgattctgtcacttaaataagaggaccgtcagctgtcctaaagagaaactgaaaaagcatgtgctttggagtcaaacaaacctgggttcaaaatcaggctctgttatgtcatgaatgtgtgtttgggcaaattatgaaatggaaacatatatatctgcttcataaaattatagtgagaagaaattgtgggtagaaagcatctggcacataggaaacactttacccaggaaatcctgttattatttcatgtttaaaatcgtaattcttagtttttgtttcttatatgttatgtgttatgtttatgttgcttttaaaaatcatttaaagacagtaggtcaaaaaattggtcattaagctgccaggaagtgttatctgtttgaatagaaagacttctatgggtctctttcacctgacacagtttattgtcggatgtttgtatcaaaagggagtatttacattgttctttttaggaacagtacgtatttggcattcaagcacctaccggcttgagagcacactgaattatggaatggagagggtatggtgcgtggccagtctaagagggtcaaacaatgtcgctttgggctatgatgaagggagcatcattgttaaggtaattatactatccctctcagtaggtggacataggcaaaaccattttctttgtattttagtactgtcatcttccaagtaaccagttttataaaactggcacttctttcattaagcactagacattaagcaatgaagatttaaagtggaagaaaggaaatggagctctctgttaggtgaaaaaaataatctgttttgttttggttttattcattttccttttcattgctgagagctatttttctttctttcagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtaagccatcaccaaaattgtccctcagcttctgtgtatgttagaacaggtttgcagatccacagtccactcttgccctgtggttggcatctctaatcattcctcaatgtgcttttgccctggcctcacaatcctcaacacagctgcagtcagccatgccacttgatcaagttggcacaaaagatggagcatgtttcccatctggacttgttctataccacacaattttgaatagttaaatagtagtttcctgttatttcgcatgcattgagtttgtgtttttgtgtgctcctttgagggcaaggagtatgtcttatgctgagacttagtaggtgccctctctaaatgcttgctgactcattgctctttcaagaagaaaacctgactctgagatatgtgtcttttgaaaaagttttgggattgataataattctgtttcttatttgtaattcgaactgtcagttgaatttctcccttaagatttgtaagtcaccaaacatcttgtgagagaggagtttctagcacagtgaagtctaaacctgtggagctttaaaattattttacagcaggtctgggcatcttataatgctgtgctgagtattgaaaaagacaaaagatataaaccaagtatgccgcctagttcagtaaatggtatccataattatttgtaatataattgtcttataaaggttaagaatgcattatgcatatttcccttaatatcgtaaaacattcttggctgtaagttttgcctttggcagtcttttgataccagcctttacagtgttataaacaactttaaagatagttgtcttatgtccattgggaaaattttcgttgactctgcagcattctgttttctcattatttaaatgttaaaatatcctctgtattttgctgaatttaagtctttaaaacctggagtgagatatttttattcatttgaatgatcagctttaaaatgaagatagtctttgtaataatatagtgccttcctgtggtataaatgtcatgagcaaagttctaggcatcttggtgctcaacaaatactggttgaataattggaatcctcctcctttgcatttccagccattctcaccttcctgcctccagttgcctttatttatgagaagaccattccaataacatttcagcagtaatgccatattcataatttccttttcaatttgttggctagaattttttttgtaactttgtattcaaagaaatgtataacttttaaaagatgttaaattgtaataatgaactaaataacatttgttattagaattcttttaccataacatgaattattgttccttaacttctacatgtctttggtcctctgtacttccctccctggcttctgtgatttctaggtttgtggtggtgtgtggtgatggggagtatatcatctacacagcaatggcattgagaaacaagagctttggatctgctcaggagtttgcatgggcccacgattcttcagagtaagttttgattgtatgatagccagcatgccctgattgcagatgtgttgtgtgctgcttgaagactctcaaggcttgatgtgggctgtgattctccgtgttaaaaaacagttctcaccagagctgtccattggaagatgagagtcagaggcgagtgtatagcatgagccgtcttagtgctttctttgttctgcgttaggctggctcactcaagctgatacaataattccatttaactggggacccagcacccatttctttgatggagcccatggcaggacctggtgctttatgggcttaaggcacagtagaccctcatgtctgccttggcaggccttggcatgccctccctgtgatgtagtgtcctgaggtgctactgcccctttatgagctacttgggagtgatgttgtggtttgatcattttgatgagaaatttattaaatcttttttaaaacttattttctgtgatagtacccactgcccattcttaacaaatttctgtctgaattcagaatgttcataaaatgttctcattaaaagcaggaaagatcatttaactctgacttttttactagtcattggctctggttcctttttgattcctgtttaatgcacgtaataaacattaggggtttagtgttttcagaccacacaactgaattacattttcacagtttttttagttttgtttgccccacattttatgttgcatcttgcccccaacagtggggtaacttaagcctcagcgttgtgtaataagatacattttttaaaatgttacaacagtaagatttattgagaggtatggaattgttctgatattttcataaatttcctaaatacacatatacatacagttctatgtattcaaaggtaatgtgttatcttaagcaaaattatagttgatgaattgccttctctcagcacacctcttcctctattttgatagtcctttttttcagctctatccagccaagaccttgctcagcatctttcctgtcctgagcaaagccctcatcacatcacttcctcagacaatcttaaatatccagtgatagccacagctccttttttcaaggcagaggcctgaatataagcagttgttgctgatgatggctgattaatgaaccatttgtcacagtttttattatttaaatcgcccttattgaggtataatttacagaagacagaatgtaccacttaattgtacagcgatcccccgatctgtggtttcccttcctgcagttttagttacccacagtcaactgtgttccaaaaatattaagtggaaaagtccagaaataaacaactcataagttttaaattgcccagtgttctgagttgcatggtgaaatcttgagccatcctacctgggacgtgaatcatcgctttgtctagcatatccacattgtatatgctgcccacctcttacattataggaaaaaacatagtgtatatagggttcagtactatctgaggtttcaggcatccattggggcttagaacgtatcccccatggataagggaggactactgttcatgtcagtagatttgggcaaatgtatgtaatccgtaactactaacacaatcaaattatagaacatttctatcatccccgcaaaatccccttgtctccattaacagtctgtccataccccccatccacccattccccagtcccaggcaaacactgatgagtgccttttgtcactatatagattagagttgtctttggagtttcatataaatggaatcatacagtatgtactcttgagtccagcatcttttgttcagtataatgtttttgagattcatccatattcttgcctggatcagtaattggtttctttatttgcagagtagcattccattatatgaatatacgataatttgtttaatcattcacctattgtggacatttgggtcattttcagtttctaaagtggtttgtaagccctagtaattcatgtcatacacagtataaaaccctttcatcatttgtccaactgtaaggagttctctgatctcttaggaaaacagtacatcagataatcttcaaatatttattttatatttttgcataattactgaaaaatatttgaagatatttccaacatttggtagaactatgatttagtatataacatgttatgtttgccttcccttttttctcccaggtatgcaataagagagagcaacagcattgtaaagatatttaagaactttaaggaaaaaaaatcatttaaaccagattttggagcagaaagtgagtgtgatctacatatgatacatttttaaattctttgtaatggctcaaaaatgcctaagcaaaactctttttatgttccctttaggtatctacggcggcttcttattgggagtcagatctgtaaatggcttagccttctatgactgggacaatacagaactcatacgaagaattgaaattcagcccaaacatgtgagtttcccctccattgttgtttttggaatatttatttttgtgatgagttctgggtccctaaggccaagaagtgtcttttgtaccctgctctccctcttcgattatcaaaagccatttaaaatataaaacagcacttagaatttaaataacttcttatacttttgaaatacacattgtctacggcctcattaggatacaacaatcctgattttctgagcaattggaggtaagtggcagtgccattttgacaggaaaaaagcatgctttgagaacaagaagtcagagaattcttgacttggaaatgccttcttccacatagttcagaaaaccttttcatacattttgatgatagctgcttgaacttgaggtgaccatctccagtgacaaagtgtttacctttagaactgcccgctgctttgacagttttcactgtcaggagattatctttggaaacaaaccagcttttctggggtctggttctagagcacgcatcctcagtgggtgtaaacattgacttgggggcttactctttatgaataaagcatagctatacatatgtatatgcattatatatgtatatctgtggtattaaaatttcattgggggaggtgattagaaaaatgtccagaaagacttctagggagggtgggtgaaaatgaaaaaaataaaaaaggtgataaacactgttctagagcaagagggaataggctactggtcctctgtgtagcacattcagtgtttactgacagctctcctttcctgtctccctttggtctttccattgctaggctaaatagcatagccacataatagctggccaccctcccaaataatgccacataaaattgttaagtgaatacttatcatcttgatataagaaggtaaatgttgtaagaaaccaagtatgtgcagtttgtcatatccactcagaaatccaaatcagttgtctatgattttgttgtgttgcagattttctggtctgactctggagagctagtctgtattgctactgaggaatcattttttatccttaagtatctgtcagaaaaagtcttggctgcacaggaaacacatgagggagttactgaagatggcattgaagatgcctttgaggtaattgcatcagcacaactttcgctttcagctttgtttttaaatgatttatattcttacaacagactttactgattttaacatttcgttataaattaggtgtagggagacagcatttaaggatttctggtgaaatgtgaaaaattaaaatcgtaactcatagatcaaaatttaaaataaatatgtttaaaagaaatttgtactttgattttaagaattctttagacttactttgatatctttcagtaaagaaattatagttgttttggtcctaagactatttagtcagtgatttaaataagctcccaaatggtaaatcatttattgtgcagatgtcctagattttgtgaaatacttaatatttcattgtcatgttatgaagggtctaagtttagatcagtattcttttatatcatgattttgacccaacaatgagatttcacattacaaatactaatctaggaatctgttctgtgttttgttttgtttttttttctgttttgagcctaagggttatattgagtaggaatctgttcttaaatgaagaaagaaattccagcggggtgcagtggctcacacctataatcccagcactttgggaggccgaggtgggcagatcacttgaggtcaggagtctaagaccagcctggccagcatggtgaaaccctgtctctacgaaaaacataagaattagccaggcatggtggcgggcgcctgtaatcccagatacttgggaggctgaggcaggagaatcacttgaatccgggaggtagaagttggcagtgagcagaggttacgccactgtactacagcctgggcaacagagacttcatctcaaaaaaaaaaaaaaattccaaggaaaattttttttttctagaaataggaaggattttactttgcattccttattctgccatatcaccctcagatatattcagctttttattgagagatttctgatgttggataaagtaattgtctttatttttctttctgcaggttcttggtgagattcaggaaattgtgaaaacagggctttgggtaggcgattgcttcatttacacaagttctgtgaacagattaaattattatgttggaggagaaatagtcaccattgcccacttggacaggtacctgagtatcattttgcatttgtcctaaattttaaagtgtgtttagaaaaatctgttgctggcttgtagcaatgataggctgatttttcagtgttatagttttagtaggttgcctattgttaaccagaattgtgtcaatcaaatgggaaggttttgagcaagagggagattggcggggtgtgtgtttgtgtaattgcagatttgaatttctaacttggtttctgtttcttttataggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcaggtaagaggttttgtttttttctttttgttttttaaaacttgcaatttgaaagcaaattattatggagttgaaaaactttatttcttaattgccaactgatttcctgtggcaatagaatttctcctgtgagtttaaggcacttattacagcacatgatacacccttcttacactcttccttctcctttctcagtgccccctttaaatgttggaggtgattttcagtcttccttttctgtgcacttattttccagtctcctgatattttcatttctacactgcatttttagctttatcccatctgctttttaaaaaaaaatgattaaaatacatataaaatgtaccatgacatgactttttcttatgtaatgttttttaagcaaagttacatatgtgcaaagcataaagtaagttttgcaaagcttaagaaaaaaatcagccctcctttttgctttctactccctagaggtaattattttatctaattcttttggtatttatttccatatctctaaataacttgaggtatagcagtttcttcatttcttagctttaggcatttcttgtgacttccccctctgtagaagatgagaatttcgccttctttcattcccctgcgtctaccacatacatgccactttcctatcctttatctctcagaatagttctaattttgattgatcactactcaaatgtttacattattatggctatgtaatcactgctcacaggtgaacatgtagcatattatctagctttcctttcctgcaattgtttgttttccctagtttataattgtctttttcccccctttgcttaattttctatgtacctgtggttaattctccctggactttgctggttctccagagttcctgaagatctcctttcagtttgcttagtctccttcagactgcactggttttcctgctctcatcatggatttcccctcaccatcatgttggggcttcctttgcttctgtcctgttggatccattgtttcttatacccctatctcctttcctgctttgctccctcattttaggggaacatgcccttcagcaatttcctgagaaaaggattgttaatgagagataaattgttttgtgactttgaatatctgaaagtgccattgttctaccctaaaacatattcaaccatttaactggtatataattgttggaggtaattttctctcagaattttgaaggcattgttccattgccttgtagttattgttgaagtctaaagccatttttattcctcattcttagtacatgacctggtttttctctgtggaaactttctgaatgtcatctctgttgtactgaaatgttataatcatggtaggccttggtaggaatcagttttcattaattctgccagttattagatgagcttttttaatgggaaacttatgtcctacatttctgaaggattttcatgaatcgttctatggtgatatccttcgttttctgtattctgtctttctggaattgttcatgttgtatgtcctgcactgattttcctattctcttttaaaatcttattgtttatagataaaagtttctcgtatctttctacagatatgaatgatatatttctgtttttagattttgaagttttctcttccccctatatggtatgcttccttcacgttccttttattgcttcattttgatctgcatctttgctgttagtgattttcctcaagtatctgatgtccttgggccctcatttaagagtgaaggtacaagaaacagatcagaaggtctgaatttgtgggtggggcatattgggtttggatttcacaatatctggtgtggttggcccatttgattagggagtctcaatgtcagtatctttagccaatgaatttttgatgactttccatttatgtaatgaatttaacaagcacttaacaatgtgctaggcactgttcctgctgacatgtagccttcatggagttgacattttagtatttttaagtcttttcccttgggctcagtagattttactgaaaagctccccagtcaccatcattttggggtctcagtagaagataccttggagtctcagtatttaatatttcattgagtctgtgtatccattttcataatctcctgtcttcctttgatactctgtactttttcctccaagtgtgcttggaatctcctggtctggagactctttagtttgtcctctccaaagaataaacctgtcttctttgtcatgaggtgggagaggggaggtgagagaggggaggtgggagaggggagcggatctagagtttctgaatgcttttagggcagtttgtttgtttttagccctaccattcatgagacacactgggtgtaaatcacattgtttctatgctgttctcactcctgatttaggatctgttttctctactgttttaacaaaatgtttatattcctccaccagctttccagcttccaaacttttgttactgtttcctctccctttctgtgtgtcgttgggagcttatgcctttaaaaaaaaatccttttagtgtgattttattagtagtagggaattagcagaaaacaaaagtatatattttagtccgcctcatttcatgtgttttgcccttggctgtatctgactagttccagagatcttccatcctccactcttgggttttatgttatctatatcaatgctagtggaaaaaaagtaactccggttatttagaatgccttatttacatcgtattcatggatggatcggggcgggttggcagcctgtataagctgagaagttaaaacatttcaaacttgatgataaagccatcctgaagatatagccagacagaaccctaaagctgtccagcttctcaatcttgactatcccataaatgagcattctccctcagtctggtgaagaggtaaactatccctgagctttttgtgtaacacattacatccctagagctaaaaatgaccccatcagtagtgtttgtcttgaaggagaagctaatttaataattacaatagttgatttaaaacagtggtccccaacctttttggcaccagggaccagtttcgtggcagatagacaatttttccacagatgggaagggggtacatttcaggatgaaactgttccacctcagatcgtcaggcattaagagtctcataaagagcacagaacctagatccatcacatgtacagttcacaatagggttcatgctcctatgagaatctaatgccgttacaggcggagtttaggcggtaatgctcactcacccacccacccactgctcaccctctgctgtgcggcctgattcctaacaggccacagactggttgtttgggagacccctggtttaaaagcttgttcttaatgccttaatggagcatgggaaggaaattttagacttcctgtcttttggatacttgctgaggaactggacttgagaccaacaataaaggaataggtaatgacacctaattggtgactggacctgaatacacaatgtttgctatgacctacagatgacagaaagttggaaggttttatatttgactcccgtttctttggccatttactgctaatagtctcatctgcaaaatgaggggttggactagatgatctctacttcccagcctagttgagtagattaccaacagctaagtttacactgctgtgcctagttttcttcttttgaaatgattcttgtttagtcaactttgcaaaattcctttctttttgacatatctgtttatatttacatttccagttttactggttacttgagtttaacattagccagcttccattatcctaataaacagtaagaattctgtcactgaatattttatctgccaggtttgttcttaccacttcctttaatgactccttaattattccatcttcttattaaatagtggggtttctagtttgagagggaaatgatttgctctgtgaatgtgtgtacactgtatatgtgtgtgtatatatatatatataaaacatacatacatttttgtatgcataaatatatataatttttaaaaatctgtttagggcttcaagcagcaagctcttacagtatccacagatcctgagcatcgttttgagcttgctcttcagcttggagagttaaaaattgcataccagttagcagtggaagcagaggtatgtactaattcatgatttttcataactgatggaaaagtcagtaggtacttctatgtgtttggtgtaatgttttgttattaaagttttcccaaatgcaaattagtggctcattttgttgaagttattgtctctctcttatctttttaaaagatgtattatgttaaactttgcataagttaaattgattacattggagatattcttagcactctaatttgttttaagaaaaattgttttcatatcttatgtgagctctattttgcaagataagaaaagatgtaaaatagtatgtaaactagtctggaaagcctaagagtacagacatagcagttatttgccaatgtctgaaactaactaaaaatatgttggttttgaaagacagcccaaccccctcatcttttggtgttgaatagagcaggcagtcagagaaggacagtgctgccttggtggcactcaccttcagcagcagatgctcttagcacatctggtctaaatgtttgagctaaatgagctgttcagggaggctcaagtgggagaaatgttaataccatttttgtaatgatatttttatagatctttgtatattgaggctcccaattgtttcagactggcatttactggtaaattaatttcagatgtgcaaaataaattttagctacgttaagatcatctaaacatgcagcattttgagttctgaaaagctacaagtgagacataatattattgtgaaatatttaaagacgtagttttgtatgctttcaaaaaagtgatattaaatcacttgttaaaataattgcagtctaattgccttaaaactccagtgagatggttttactttccctgtgtaattataagataaaagtataatgggttgacgataattatttgcacatcattaaaattgatttgtgtttaaattcattttgtatacattaataatttccatttcctcactgtacattttgcaatgccattcttattttgatagagccaacttaacaaacacagctctttttataaacattgtctgcacagttaacagaataatgttggaaatgtaaatgcttatttctaaagatattttaacttggaaactcttttcttacagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaagtgagtattaatttaaaagattaattaattctacactgaggatggtttttggagagggaagtgaagaatgaaccctggagagaactgatgaatggccaaatggtgttgaatagacggggcagtcagaacaggacagtgctgccttggtggcactcaccttcagcaagggatgcccttagcacatctatctaaatgtttgagctaaatgagctgttcagggaggctcaagtgggagaaatgttaaacaccttcttcaacagccctgccagttaatggtggaagcattttattttatgattgcaggaggctattgagctgctctagtaggtacctgaagggcaggtgattttacccaaattggataactttgatccatttatggcaagaacaaaaggggataagtatgccacttacttgtagatttgagcccactataaagcataaagatgtctcatatttttaagtctaaccgagttagcataaaccaaatcatttggacattagttggcagtattatgaaataaaacacaaaagtattctttcctttttttttttttttttttgagatggaatctcactctgttgcccaggctggagtgcagtggcatgatctcggctaattgcagcctctgtctccctcgttcaagcccttctcctgccttagcctcccaagtagctgggattacaggcatgcgccaccacacccggcttgtgtttttaatagagatggggtctcaccatgttggccaggctggtctcaaactcctgacctcaaatgatccgcctgcctcgtcctcccaaagtgctgggattataggtgtgagccaccacgcccagcccgaaagtattctttaaccttctcctacatactgatttttttttttttttacaatcccatacttcgccatataactttgaacgtgcaccccattgtatgtatgtgaatgtatttatgaatttatatacctgtaagaatagaccctattccttatccataattcaaaaatccaaaaatattctgaaaacagttataactgttttgatggcaagacctgagctgaactgctttagtatttttagttgcttttataccaacttggtacatttttattgcatttaacattcctatgtaagttattgcagtattaatgtttgtggctttttcatgctgaggatgtaaggtaatacatagtatacatactgtatcacctttcgaaaatccaaaaaatcctgaattctgaaacatattgtccacatcataaaacttgcacagaaaaaaaatgaaattaaaatagaagaaaaaataagacaccatggtattctgctgggcaccactggcttgtctggcccttcccatgttggagacactgccctagatatttgtcttgtggaactgaatttctgctggcatatatccttatgcctttaaaatttgctaatctaacctgccttaactcctcttgaaaagcccctttaggttcttaggaattataataattaagttaagtagattcaaagtagtcaggaaagctgtcttatccctcatacccttgcagtgtgttgattaacaaccattaaaagacaagtgacagaaatgagatatatgtgtgaagattggggagatttttggctttgtaacactaaatttactttgtgttaagtacccattattatagtgtttattcttggtaacagtacctctcctttttaatgtttagggttgatgcctgcctagagctcttaattagaactggacggctgccagaagctgccttcttggcccgaacttacttacccagtcaggtttcaaggtacagacttttaattttaggaagaaatgtttccaataaaaagagagcacatttacttagtctctctttggttccatgatgtctataatagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacggtgagtggccaggatgtcaagcttcatttattgtaactacagggtggaagtacattcaggacttcagattttgaactgctgtcttcttttaaaattaagagctgatatctgggatttaggccaagttcataggtaaattatgatttcagaatatctcatttcatcattgctttattctctgatagccaaatgaagagagaaatgtcatggaagagggaaaagactttcagccctcaagatctacagctcaacaggtcagtagagcacttcatgtgataaatttggctgagatggttcactttttttttttttcttttgagacagagtttcgctccattgccctggctggagtgcagtggcgcgatctaggctcactgcaagctctgtctcccgggttcacgccattctcctgcctcagcctcccgagtagctggggtaattacaggcgcccatcaccggtccggctaatttttttgtatttttattagagacagggtttcactgcattagccaggatggtctcgatctcctgacctcatgatccacctgcttcggcctcccaaagtgctgggattacaggcgtgagccactgtgcctggctgagatggttcacttttaaacatcatctcccacttcctaattctgatcatccttttcttgggggaaaactttaaattcccgagtaaattcccttgtcttcatatatatcttcacttgtggtttcaggaacttgatgggaaacctgcttctcctactccggttattgtggcctcccacacagccaacaaagaagaaaaggtaggtcagacatcatactcaaacctccctctaccccatcttcctccccatcaatatctggaggatacgtaggcctctgtggtttaagtgacatcagtttcagagcaggggctttgaaatgggaagatgctctttttgactattaagaaaatcttagttctcactttgaatcatgaacccacggataactttcctttaacagtactgtaaaacttaattaccctcttccttttgtctgcagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaatt

SEQ ID NO: 35775 - DNA, 4195 bp, Homo sapiens
agttaaaagggtgggagcgtccgggggcccatctctctcgggtggagtcttctgacagctggtgcgcctgcccgggaacatcctcctggactcaatcatggcttgtgtgagtgtggggacccccccccaaggtccaggggatagggcaggaactgatggccagaggagagctgggcagatcgggagcagattctagccccagctgtgtggcctggaaccagtgccttctcttttctggacctcagtggccacatctgtaaaatgggggtgggcgccatggtccctcaaggccttctctgcattgataattgtctggattcctccagggtctgaaagcacagttatttctgcccagggttgacattctgcagctctctgagaagtgagcgtgggaagggtgtggccaactgggggacacccaggccactatccctttccccctcctccaccccaaagagcctcctgtcccctcccccctgcagctgtcccggtcaccaggccagggcagagttaccctctgctccagagaacgctgaaaagttgccaggacccgagacaagctgcccaggatgggcccttctaggtcgggggtggagggtggttgtgtccaggctggtggcggggggggcgggggaaattcccttccaccacccccaagctgggaggttggggtggcagggaggtgagaatcttcctcgggccccagggaaagggttcaagtttctggcagaagaaaccactcaaaccagttaactcttgcccacccactcggggtgccagggaacagcagtgcccagcagtttgctcaatcttgttaaccctgagccagcccagccacagcccgactgcagggctattctccctaatgcagagaggccgtgtttttcagggtctcctctctagcccctgggcctctttgcagagaggggcttgaaggagaatagtggggtcgcccgcccctagccacttcctctccagcagaggggccggcccctccattcagtgtgacggtgggccaagtgtcggcccctccccagcctgatcctctccatctgcgatgggacagagcaccccatctcccaagtcactcttgagtccaaaattcccaagccaatctgcaaaatcttctagagcctgtcttctagaaccttcacgttacagactgaagccaaccccggtgggaatagggactttcccaggaccacatagacaatcggaggctggaaattacagctcaatcctttccccaggcttccccttggcttggtcagaggatgccgggcgggaacaaccccactcccacccccagccacccccggacacttcgagcagtggaggccttgtcctctaacccggctgggccggggcttgtctgtgcagggtctggtcgccagcaacctgaatctcaaacctggagagtgccttcgagtgcgaggcgaggtggctcctgacgctaagaggtgagaagtgaagtcggggtggtgggcggcagggacgggcttggtccagcagggagggcgtggccggccaagcccacatctcctccctggccgggagcgggttaacggccagccgccgatgctgcgttttctgggtgactcacttcccccgcagggtctgggcgcccccaccgttgccgccccctcccccgctccctccctgctgtagcctcttaaactaaaccagctgcagcctcgtcatctgtaataccttgactcccccgcccccacccctttccggtctgggcgggacctgtcgctggggagggcggggagaggagtggggcgggcgtcaccgccgccttccccctgagtccctccttcctgcgtctggtcattcattcattcactggctcagtccggtccttcttccttcacttctcattcactcagacggctgccttattttctcggcagttaggtgaccttggaccagtcaaccaacctcacctagcctcagtttgttagaaaaacaaggggggaggtggttgtgtggaggaagtgagatgcggctggcgcagtgacagtgaggaggatgaggatcagctgatattgttaagagccgcacacttctcatgcactaatttcatttcaaccaaaccctcagaggcaggtattgctattatcaccactcaacaaatgtatttattattttatttatttatttattattttattattttatttatttattttttgagacacagtctcaccctgtcgcccaggctggagtgcaatggcgtgatctcggctcaccacaacctccgcctcccgggttcaaacgattctccggcttcagcctcctgagtagccgggattacaggggcccaccacaacgcccagctaatttatgtacttttagtagagacggggtttcaccatgttggccaggctggtctcgaactcctgacctcatgatctgcccgctcgcctcggcctcccaaagtgctggggttacaggcatgagccaccgtgcccgggagtattattattattatttgttaattcgccccataattactaagcatctttttctggtgtgccccacttgtgctgggcaccgggaatacagagatgtacaagacaggacgggaggtcaccatctggagggagtcactgaccttgaccaaacgggctaggatgctaatgacttcaagaatcaagcgagccctcctgtgcagcccccattgtacagatgagcaaacaggggaagaggggcaggagcaggtggcatggccagagctagaatccaggtttcttgtctctgttagtgagttcttccagcaaggtgcgttcatgggatactgagtgacagattagtcggtcagtggggctggagctggccgaggtggcctcatgcccacccgttaccccccagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgggctgcagaccggaaccggggaccagggacaggggctgggtgggctggggcggggctgggttagtgactagagaccttggccctgcctgctctttcccctccccttccctcccttcctgtgtgatggccagtgtctgcccctctttgaacctcagtggttgattacaataaaacgaaggggaaaaaaaaaggctgggcttggtggctcatgcctgtaatcccagcactttgggaggccgaggcgggcggatcacctgaggtcgggagttcgagaccagcctgaccaacatggagaaaccctgtctcgactaaaaatacaaaaaattagctaggcgtgatggcgcatgcctgtaatcccagctactcaggaggctgaggcaggagaattggttgaacccgggaggcggaggttgcagtgagccgagattgcaccactgcactccagcctggccaacaagagcaaaactctgtctcaaaaaaaaaaaaaaaaattagccagcgtgctggctcatgcctgtaatcctggcactttgggagaccaaagtgggtggatcacctgaggtcaggagttcgagaccagcctgaccaacatggtgaaaccccgtctctatataaatacaaaaattagctgggcgtggtggcacacaactgtagtcctagctactcaggaggctgagacaggagaatcacttgaacctgggaggcggaggttgcagtgagccgagattatgccactgtactccagcctgggcgacagaggagactccatctcaaaaaaaaaaaaaaatctatcataggattagagtaaaaagaaagaaaaaatattataaatgtacctccgcaggctcagccacaaactggggctgtgtcagggccacatgaggaacgggttctggaagggcccatggcatgtgggcccggctcactgctctcctctacccccaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctg

SEQ ID NO: 35776 - DNA, 2813 bp, Homo sapiens
ggaggcgcggaaagccgacgcgcgtccattggtcggctggacgaggggaggagccgctggctcccagccccgccgcgatgagcctcggccgcctttgccgcctactgaagccggcgctgctctgtggggctctggccgcgcctggcctggccgggaccatggtgagctagcgccgcggccgttgccggcccggtgaccgttggggcgggcgcgcgatccctgcctccgctcgccggcgtggggaaccctcaggctccagtgaccttggtggggggcgtctgggggctccccctccccacccccggccgggcacggacgcgggtgaccgtactgcgacgcgctccgcggccctccaggccgttgtaggcgcgcgggctggggtcggggaaggggaaggggttgttccacgcgcgcgggtcgtggtcggggaaggggccgtccaggccgttgcaggcgcgcgtgccggggccggggtcgggggtccaggcttgcagggggcggggtccgggacggctggggcggagctggaccgttgagggccacggcggggcgtctccgggccgagcggggctgctgcgcccgagcggttgggggcgcggagggctggaaatcccggatcacgcgcccccgggcgccgccccgcccccgcaccttggcctagcgcggtggcgtcacagtcgcgcagtcctgactacggcctccgggccctttgtccccgctagcggcgctcggggtgggggagccaggaggggcgggagacgggcgggtatgggccgcgcgggcgcaggctcccccgggcgccgcaggcagcggtgccagagccggggcaggcggcggccgcgagcccctcggcggcggaaggccccagcgtgcaggcgcaggagggcgcggcgccggcggaagaagccctgtccccgcagcttgcgaccggagatccacgaatgtcccaagtcccaggacccggtgcgcgcggggcccccacaccggctaatgtggcacattttggggttggaaccctctcccggcctccgggtctccggtaaaaccggaccagaagtacaagggggcgtgtgcgtttaaggaggaggagcgttcaggtcttcagggccgcagggcctcggtgtccccgccaccgacccgctcccgatcccttcctgcctcagggtcccgggctcagcctcccgtccacgctccctgctcagcttcctttgccttgcagtgcgcgtcccgggacgactggcgctgtgcgcgctccatgcacgagttttccgccaaggacatcgacgggcacatggttaacctggacaagtaccggtgggcgctcgcctggggtggggcgcggggtcgggccctgggagggggccgtgttcttctgcgctgacgccgccgatcctcgcaggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggtgggctgctgcgtccccggggcccgcagaggcgggtgggtgggggtcggggtgggctccagcctggagagggcctgggagtgtgcagggggcccggactgagggggtgccagcccccgactcactcacacaccttggccgccacaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaagtgcgtgacctctggggacagtacggctgctggggtgggggtgggggggctgctgggatgctcacacctccctggggcagaatggctcatggctcggggggcggttgcggggaggtgctgggactctcacatcgcgtggcctcctgggggtaagatggctcagggggacatagagggctgtggaggcagccagggatgcccacacctttgtggcctcctggggacaggatggctcgggggcctgtggggggctgttgggactctcacactgcatggcctcctggggtaagatggctctgggggggcttgggggcactgtggctgtggaggcagccggggaagctcacacccttgtggcctcctggagacaggacagcttggggactgtggggggctgctggggacgctcacgtccatgtgcttcttttccagtgccatcaagtggaacttcaccaaggtaagggggctgtggggggtaggggaccagcttcccctggccacagccgtggcccagatgggcagcggacaggaagggcagcctcagccccttgcaggggtggccccacagtttggacaccgtctctccacagttcctcatcgacaagaacggctgcgtggtgaagcgctacggacccatggaggagcccctggtaggtcctctctagggagcccgcttgaggctcgggggcttgggaggtagctgccctaacccagctttcctccccgacaggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattag

SEQ ID NO: 35777 - DNA, 16393 bp, Homo sapiens
ttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggtaagtcgcccccggcggccgccgaggaccaaagctgcccgggacatccacctggagcgctgaggcttcagtccctctggtggaccccggaacctacactctccccgctcgcctaccccagcccgctcctctcagccgctggaggactcttcagggcaaggctccagagccatcctctccagccttgaggttcacaaaccaactcatcaggacaccccaagatttccttactctctgaagtcctccttaagcctttgtatcagcactccagggaagagtctgtacttcccctgccctccctgcaaccccaaactacagttcctgatcttgctcaccttcgacttcccaaaagcccccaaattgttggtcttgcgccccccacactttaaaaccagcatctctttcctccacctctctctctctctctctctctctctctcatgctctctggaaagtaatcctgttgtccttcatttcagcaaacgcggggtcaaagagggatggtcccggccctgtccccatgcccagccccgtttctgcgcaccgtccctccctgcctagctgatctctgaccctcggctcttgtgcttcctgctacaggatccctgctgggcaccaacagctccaccatggggctggcctggggactaggcgtcctgttcctgatgcatgtgtgtggcaccaaccgcattccaggtgagtttgtgtggcacctttaggggaaggagggacaaggaagaggtgctggctatcccaggtgtgccccctcacgtgctgtcctctccctcttgagcctgactggacatcaggacgcagcttcactctgatcctggtatttattcacctctttcagtggttgccaggagttttcaccccaaccctttgtctccacccctaaggactcagccccctactgctggtcccagcctagaaagctcactttgtgttctctcctgtctaacagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccaggtgaggcttcttctctgagccctgctccgtgggatcatctgctagacaggtgacctgccaggagggctacaggaaatcctgtctgtaaactaacgcagcagttctcagattttaggcagcatgagcatcacctggagggcttgtgaaagctcaccctgctgcaccccagccccagagtctgggattctgtaaaactgcaactctaacaagtaccaggtgatgctgatgccggtggtctgggaagcacactttgaaaactactcaaggaaacaagaaatggttttcctttagcagtcagcctgttcaagccttagatactccttaggctcttaagaaaagagcttatttcaaatgcattcccccaattttaatcttgtttgaaatggatactttctatgggcagaatcagtaccactttgctattggattcctcatggggatgcagctggtctcacataaaaggttaaaatagcagttagttgttgctgttacagcttcatctgtgccttaacttctagatctttgcaacggtggctttgaactcccacatttaactctttgacactggaaagtgtcattatatcctctaggcttaggatcagattccatttcctgtgtacccaagtaggctgataactgaattctttgtaaaatactcaagacttggcagaagtcacaattaagattttgaagttgtttggcgattaatgttgctgtgttattttgacatagtgatcttaagacagctctttgaagcttttagaacatctattgtatgcttttcctagcatacagacagtctcccccaaccccatccccaccccgctctgcattctacaagtaatgtgtgtcctctgcccacagggggtgctgcagaatgtgaggtttgtctttggaaccacaccagaagacatcctcaggaacaaaggctgctccagctgtgagtacccctctatttttagggcacatagggaatcagggggaattccaccaaaaacaaactgaggaatttagcaatagtggttatacataaattacccccagtgagatcatcaagaggcatacagaagtgactccaaggggtattatacacacacacgtatacacacgtgcgcatacacgcaacccctctacctgcatccttcacaccaaatgaaacgtcttctaccactaagaactcaagaggctggttggtaagagtatctatttgaagttttcattttgtttcttgccagctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtggtcagtggcctctgcacccagcccgttagcatgaaccctggaaggtttatcgcagatggtcccaaatgactgaaaatgcggggggacactaatgatattctctcccatttagactgaagagaacaaagagttggccaatgagctgaggcggcctcccctatgctatcacaacggagttcagtacagaaataacgaggaatggactgttgatagctgcactgagtgtcactgtcaggtaagggaccttcaccagccagaataagaatcgacggcttttgtttgaacctacatctttggggaaataccctaatcgccacagagattctttttatgttccatggcctgataacaaagtgttttttttttctttaagatgcaattatggcatctataagttcttctttaaactctcagatggtttatcaaagtattaattataccccaggctaagtatctaagagaatgaatctactaagacatctgaataatttacctaccttagttcaaagactaagtgttgaatgtcaggtaaataaaacctggttggaacattcatttttttttcccaaccctgatttatattcagctttggcataggttcttttagtacagtagcaattgtttttcaaatcacttagtctgacactgttaggatgttactgtctgctttgctcagatggcactgccaggtgtgtgattcactctagcatccccgcatgccagtggccagtgagtttggaggttcacctggcttatctattaatagcaaagtatttgaatttgcttaaatacaaatcacagatgactggctgtgggaaccaacttcattaaattccctttcttttccaatataaagacagatcacagatctatagatgaggaaaaagtgcttatagatcttccttcctccccccaaacacataatataaaaatgtaaaagtcctggctgaattttctgagtttgatttcagacatagatttgacccatgatgtttgttggttcctctgctataaattctttgtactgtaacttccacccttgactaagtagcaattaaaaagaactttccaaggaatggagtgacacgtaaactagcactagaactgtctctacgatagtggtggctgcaaatatgacagagacagatctatgaaaatcattccactagagcattgacagccctgaccatgttttggcttgtaaaggaaatgttacaggatgtagacttctgtatgcaacatgctcagcagcctgttcccctctcactctcttgccctgcagaactcagttaccatctgcaaaaaggtgtcctgccccatcatgccctgctccaatgccacagttcctgatggagaatgctgtcctcgctgttggcgtaagtttctcaaatggcatagctattcttcagtgactaggtcagttctacatacatcctagacagccgagcacaacactggaaccccacccccatctccatcatgcttccattcagtttcttgctgcagcagctggttaactgacagcttatctgctgtacagagccaaaactccattatgagtacatcgtaattacccatctggattgcagtaatggcagtgaagatcttggtatagctcattaattctgattttttgctttgaggaaaagagatgaagacgtggcagcaacagctctaagttgactgcttttagaatttgaccttagtggcacagagttaagaaaaatctgctcaccagagatattgacaggcttactgtgtaagcattggcctgatcgggcctggaagttttgcccctttcatctgtagggataagagggcctaagagaatagcagcaatctgagctctagagcaccaaaagaaataaggcacgatatcgttccatggcacgttatccctggcttttgttaccagtaaaatgaatgactttgctgagacaatacttagtgtagcaggtacaagttataaaagtgattcattacaactaagataaggaagaaaacaggaaaacagcacttgcccttcacacacacagaaacacacatgcacacacacacaaacacacccttgtcacagctcagaataaccaattccatccagggatcatattagcgatattggcactgtaatggtcgtttttacatttattttctgttccgcattcacttaacatgtgcgttaaaaggaacaaagctagctggaggtagcaaagttttgaacttgaatcagggattgctaagaaaacttacaactaatgaccacagaaagtaagttctttgtcttctgtctgatacagctagatgtgattgtagccgtggtgcctgggcagatggtaaacaaacatgctgtcctcttatgacaatatgtgcagagaaggccccaaacgctggggtgagaggaacaacaaactgactaactcacggccgagttggagccagaaccaacaacagctcggctgccttcacactcatctgtcaaacacatggtgtatggctcccctgacagaaatgactcctataagcttcctcatactcgcgcattcttggaagtctgagactggaaatgcctacccagatatgttaagtcagtaaaggaaaactcatttgcaatgctgagaggagaaagaaaatcaatgaataggagagcatacactgtgggaaggctcagctgtactgagccaggcaaagcatccgattaccccactgctgtacacatcatgacctgggataaacccctgggccgttggcctaagaaatatgttgcttttcatcctgtataactgcaactttgtgccggctcatattatgttctagagagctcatgtacaccatggtgaccatagttaataatactggattgtatgcttaaaatttgctaagagagtagatcttaagtcatcaccaaaaaaagtaactgtaagatgatggagatgtgttaattagcttgacggtggtaatcacaatatatgtgtatatcaaaacatcacattatacaccttaaatgtatataatatttgtcaattatacctcagtaaagccaaaaagaaataaatatattgcttttcaccctctggcaagtggagggccctgaacagagccctctaaagaacagcttgtcctaatcatcacgtacctgatgaacctctgtttcccctgcagccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatgtaagcatcttagcctctcagggacgtggagaactgacctgtccttgttgtcgtcaccaagggcagctccacagcatgtatattaagaacacgggttctaggatctctggatcccaatcccactgcttagctgtgcacccttgaacacaacttaccctctctgaggctctttcctcatttgcaacttggagataataatagttcttgataagtttatcttgagcattttatttagatactgcatgtaaagcagttagcactgagttttggtttatggtaagcaccctgtaaatgttaggatattaacagcaacccataaaaacagcgaacttatccgttctctggtagaaaacattccatgttgacatttgggcatgtggccaggagccaatttctaccgtacactgggtttagttgccattgaccatttcctggaaatacttctgcgtgctcctgatgggagcctctatttggctgtctctaagccaaaaccatttgtgaccatcaactctgtactttagttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccagtaagtgtgaggtccgctgcaagggtgagcatgggcagcagctctgcccagctggttgcctggcatctgcagcctgcagttcagtgggtcatagagcaggaaggttacctactagagaaacaaacagaagcaaagtcctgcaggctcagcaacttcttttaatgaaaaacaaactcaccctcttccccagcattctttccatgtgtcagagaagcagaggtttcttgaacgggcttaggagagtctatgacaagggagggatttgaaagttgatcttaattgttgcctgtggttcatcttcttacagtcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattggtgagccacgcagcccaggatgaaacgacccaggagctttgctcttttactgaatgctgcagtcagcattcgaggagattccagcttggttagtcctgagcgatttgattgctctaagatgcaggtggacaacataatcccaacaagttatcggttccctataccctataatatcttacactgtgttaagtgcccagcatggcagtatggcagcttagaccaaccatttactgtgactgtctctctctccttgtctcagatggatgcctgtccaatccctgctttgccggcgtgaagtgtactagctaccctgatggcagctggaaatgtggtgcttgtccccctggttacagtggaaatggcatccagtgcacagatgttgatgaggtgaggaactgatggggctccgagtttctggatctaggaaagcagctaacctgtgcagtcgcttccttatggcagtgacttctaaacatgatgcacgctcttatttcctccatagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtacagtcaactagacgagtaaaccagaggacaggagagctgtccttgaccaaaataactgggagcgggaggaatgtaatttcatacccttcaccaaaaaaaaaagggcgaggagatgaatgtacggtctagttttagaaacgtgattagaaaatccatggtaaatcctgcaggggaaaaacagtcttccatatttaaaaatgctgctctggaataagttgtgagcagatggacttgtaaacgcctaggtgctgagcaaattcaagaaaaataaacataaagcaaagtttgcttatagcctcagggagaatggggagggacagaggtaacccacactcttccaaatggagcctctgtctactcagagatgacagggatctggattcttgtttccatgatatctgaggattctcaaaagctctgtgtaacagcagcatggtgtaccctcaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggtagagccaggtcctttgtgtgcctccagaaagagggcccatcaccttatcaaaacacaggctaaggaattttaaatacttaaagtttggacatgaaactgaaagattaaatctcccaaagggagaggggcactaattcctattaaaattaaatcacttggtgccaaaaacatgaacagggctagctctttttgggcaactgtgttccatagtcaactcttctgtccaaaaaaaagttcagtactctatccaaataccagcaaagcatgacttgtgttcacaacatctataaagcctagagcatttacacaaattctgtatgtatatcccccaagaaaagttttattttcttgtcttcccataaaaaaaatatgctgttactgagccaaattctgttctttttctatttggaattccaggtacactccctcgtgcatgagctcagcatgaggaaggcaactgaagcagtgatatatatcttctctttcctaggataattgccccaaccttcccaactcagggcaggaagactatgacaaggatggaattggtgatgcctgtgatgatgacgatgacaatgataaaattccagatgacagggtaaaaacagttttctatccctttttcatcttttcagttcagcaacagcctgaaacactttgggattcaaggaaattacatggctatagcaaaaaatataccaaatcaatacacaggataattagaaattattcattgtgttccagtagtttaaggatgtagatgttgccaagagaatttttaaatgagggttttgtttttcatcagaactgtttttctctgtacttgagaaattataatgcataaacaaatgccactttgttccctagattcatttcaaatgtcacatcgaaattacagtaaaattgactttgggcacactatgaactgagatgatgggattatattctacatctcactaacttctaacccacagggatccatttttttaactatgtccttttaacttttgtagtgatcgttttacactgagtgatcaattagcctatccactaggtagaaagtattgctgattttcacagttttagacatattatgcacatggtttgaggcttgagctgttttcaaggacaacattgttaagtgctccatttcttctctttgcaggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtaaggtgctgcctgatcagagggcccgcgggagacagggacatgcacagctttccaaacgtacttctgtctagtcctggctattagtatgcactttggtggaaacatccaaggctggagagcccagctcttatttgtcccttgttctcttcaggtatcctcaatgaacgggacaactgccagtacgtctacaatgtggaccagagagacactgatatggatggggttggagatcagtgtgacaattgccccttggaacacaatccggatcaggtaggtggatggactcctttcagagtctttcagtaaactgttggaatatccctttcatggcctttgaaaaatgagcttaacaaagttcaaacactttcattactgtggctccctggcttctcatagccaactggaatacgttcatgtaaataatttgcctgatgtgagctccttgcacagagtctcacagatctttagcatgaagatctggtaacttcagtcttaccttctgtaagaagggctactggacttgctcagcatcgtctaccattgttaagacaaattatacaaagcagacatctgtgactgacaactgtacaataatattaatcatatgtaatactaagagatggaaaaataaatgtgcataagcaaaataaccattttcatggctaatgatgtaatctagctataagaaaatcatcaaactaaggatacatccaaaaccaaagtaatttatccctgtcataaacattacccagacagtatacaacacagggaccagtggtctgtttccatcttttcaggacttttcagagaagtcgacgtgtcaacagttttacaactgaaaccttctaaggaaattctctgttataaagtatccagaaaatttcatttaacattaagatgtaaacagttaacatttcatttcatctttagtaattaaatatcactctatttgaccttatttagaaagttttatatgtaaaacatttttaaattatcccttctcagatttttatacgaaaacaaagataaaggaaaaaaacttttaaaatgtaattgctactattgctatctttctgcaggagtgtgtaaatagacatgacaccccactggctgtatcaaacaatggagaattttccctgtggtgggggcataagttatctttaacatgaatggtttatactgcaatttaccctccatttacatctctctttcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggtgagtcatgggagccactttctaagacagggactgctggcacagctgtgtagattgaagaaatgaaaccaaggctcaaagcatttgacaggatgaagggaccaaatgccaacttagacaagatagtgacatttctgacaccagtaataataatagcactttagaattttgctgaactcttgcttttttgacctcaggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggtgagtagcgagttcttagatcctaagagactgatgcatacatggggaaaaacaaatataaaacctggcagttgtacctatccctgtgggtgctgaggatgtctaggaacatgatggagaaccttctgaaggctgcaggttttaacctggctctgggctcttcttccaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtaagaagcaaagccctggaacagagagagagcttatgggtgcctgactagcactggggatgctgtgctttgaccaagactctgaccagggagtcttagaaagttcccagcatcaccagctgcagcattgaactctgctttgtaaaaacataatagtgttgaaaagggagcttgaccaagaattgccctgcaaatcctaaggtgccttcagccttttcaaacaaaaaaacctccttccctcctctctgtctgctttatatgtgtgctcagtggcacacaacaaatatgagaggacttggaaaaattccccattgcagccctctaacttagatcagctcagtacctttcaagcattgtttctgatggaatgaaatagaaatctttacctgaaggagctgtgtttcaacctttccttttccttttccttcaggtgcgcaccctgtggcatgaccctcgtcacataggctggaaagatttcaccgcctacagatggcgtctcagccacaggccaaagacgggtttcattaggtacgatcatactgattcactttcacttacagtcacactgagggacaaaaagacaaaaagtattaaatagcattgtcactaaacaagattttttttccctgcagagtggtgatgtatgaagggaagaaaatcatggctgactcaggacccatctatgataaaacctatgctggtggtagactagggttgtttgtcttctctcaagaaatggtgttcttctctgacctgaaatacgaatgtagaggtaagagcaacatcaccatgaatgtacactggacatctctatttcagactaatatcaaggatgacggttatgggggagtccagtgtaaagactgttttggagacagggttatttctattttgcttttgaggacacaaggacaaaaatggaataatgcctaggcactgtggcttatgagttcctgagtccttagctataatattagtttgcttagcaatctctgtgctcctcatacacagtgcaaaggtaagctgcagaaaagctcctatataatttggacttcattaataatactgttctttacaattatatatttatatatcttactgcttattgttttatgcatgccatcacagcacgagttagcattcccaacttttccctgtatacaaagaagggagaggaatgttgctttcatattggcatgttaaattaatgttcactattaaacttagcattttttttcctcattcttttttacttagtcattacttaagctcgctgagtccaacactggctctaccacaaaataagtgcttaatatatatttactgggccaaggccagatacctaaaagatcaatgacagtagagaaagatggttgattttactcaaaaaaatctaaattattaatgtaatttttgagtccaaatttttaaaataagactccctaaactgttaacattgaaagcctttggaaagcataatatatgttctggaaggttcacgctgtgtcggtctcctagcatcaatgtcagctaataaaattaaatgctaatgtgcttgaacaaccttaaaattaggcttttgtcattagaaaagtagagctattcctatgtggttaacttattaactaagatgtctatgcttttatgaattagttttcatttgtatatttatttatatttgtttatttaacagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttgtttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaatttatatttat

SEQ ID NO: 35778 - DNA, 6684 bp, Homo sapiens
cggcgccgagggtggggcgcgggcgtagtggcgccgggagtcgcgggtgcgcgcgggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggtgaggcggcggggcctgcgcggggccggggacgcgggcggaagtggggctggggagcccagagagggccggggccgggcgcggcgctgtgggcgcccgcgggcgtgcgcggggcagcggcgcgggcggtcagggctgtagctgagcgcgggccccgctgccggtctccacgagtgcctgcagaggcggcgtttggcgtgagccgcgagcgctcgttctccccactcagcgcctcgcttggggcccggcctcgcgtggggccccgggcacgggggccgtgacgacgccatcttgagcacccctggccccggccgggcgcgtgggtcgcgccgccgccccggcgagcagaggccgggcgagggccgctctgggccgcggagcgcggggggtaggccgtgcgctcgctggggggctgttcacgcagccgggtggctggggagcgaactactcaaaccccccttatggggacccccacccgctccggggcaacacttattctctaggcccaggtgggcttcgagaacaaagcggctcgctggcctggccggtggcgggcgcctcccaggtctccgcactctgccgggaggagccttcccggggccgggctgcagccgcccgggtcaggactggtttggacgcggccgtttcgttttgacgagggctcgtgtacattgaccttagtgacattgtttgaaacttaaattcgtaccatcaagacgtgtcagtttaattggtcagtctgtgagatcgttattcttttatcatctggtattcagaggtttgagcaggcagagaaagcagcacacacggttctgtaaattttgatttgttttcattttctgaatctttgttttgaaatgaaggcccagtattcatcaggtgatctaactcagcttaaagaggactaggagtcggctgacccctgtacccaccccaatactgccacccccgccagctggccgccgctggctttaacgaacccatatagcttctctgggcctcgagtcagtcgaaggtcaagtgagtcagtacctgagaaagctcccagaaaacccaaacacttcagatcaatacttctcagccagggatggttttgggcccacacggagccactggcagtgtgtggagacttttccagtggtaagaccttgcagaggtgctcttggcatttggagggtagaggccagggacgctgctcaatatcccacccgtgctcagggcggcaggcacagggagatccccctgcccaggtgctcacagtgctgagctggagaagccctgctctaaaccaggaggcgctgtttatcccaatgatggttccctttgtttctggcttgactcgggttgactgtcagtgattgttcatgcttttaataacagccatatccttctccagcatcagccataaacagtttgggataacacttgacaccttgtccactgacggcaaatcaggccccttctcatggctgtcacatgagtatgtcacagtgcaggaaacagtgcattgtggctcaatataatttcacaactacagaaacactgccttcagaacaccagacttgagtgaaagtctcaggcttccaggctttgcatgggactgattcattgggttgaaaggaaacacatgccgattatataatggttacttactagctatgttgtaactaaaactacatctcagtatttgaaaggcccaggttgggcacctaggtgagcacgcctgggctagctctaccagcagtagatgaatacccctgggtttgcaggatgtggtgccagccacagtgacagacaagtagaggagaaaggggtgtgggtgaacgcaccttccagtgggagctgctacccggagtacgtaccccccaggacccaggttcagatctgctcctactgctcgctgcctggcagtagaaccatgtatcacttttttgggaggatagggtggggtgaggggacagggtcttgctgtctctgtctcccagccgtcatggctcactgcagcctccaccttccaggctctagcgatcctcccaccagcccccacagtagctgggactacaggcttcagccaccacacctggctaatttttgtactttttgtagagacagggttttcccatgttgtccggctggtcttgaactcttgaatttaagtcatccacccacctcagcctcccaaagtgctggaattaacaggcatgagccactgcacccagcactcatatcactttcttacgtggtttgtggatcttaattaaaggttggtgttcgaggaagagacattgttgttcttggtgtggagaagaagtcagtggccaaactgcaggatgaaagaacagtgcggaagatctgtgctttggatgacaacgtctgcatggcctttgcaggtatgagtcggtggggagcgctgtcttactctctagagtctcagcgaagaatagggctttggagattaacttgggtgtgtgggctattgtgagccatataaactgagtaaatgaaaatcatttaaaagaattggatttggacttttaagttggctagtttctttggtggcctctctctgccatagcaggtgaaacaaatggctaaatggatgaaaacacttctggctgctgcgcaatttgacctccactgttatttttctgtatcaatcagttacaatctagagaaaggctggactttctagagctaactgcatctgtggcatggagaggacagaaccacgtcctgccatccccagcagtaaaaaggaccacactggtggatgcaggccatgcctcgccatgttctcagcgctgttttggtcttgctcatttctcctctcagcagatgcaatctaggaagatctcaattcatgtaatgaaattagggattaactcaatttctaagattcccaagaggactcaggtactgtatttaagtatggtctgaagtacacaattcttcatatgcagacagtccctgttgatctgtgtttttaaaaatccagattctgcacggcagcctacaattttttatttacaatgggtttatggggtagtaaatgcattttcagccaggtatttttgacttacgatgagtttagcgggataccaccccactgcacatcaagaagcatctgtacccaatttcctggaagttcccaggggctgataggttccgctgccagtcagttagaatagccttgctgccggtttggggggtctgtggaaggttaaatgctgggtcatcgtgtctgtccccaccctgtagtttgtgctgtctctctagcagaagcctctctgctttccttgcaggcctcaccgccgatgcaaggatagtcatcaacagggcccgggtggagtgccagagccaccggctgactgtggaggacccggtcactgtggagtacatcacccgctacatcgccagtctgaagcaggtgggtgcctgcccgcttgcatgctcacctctggcagcagggcagtcacggctccgccatggagggtcctgccatgtcacttcaggtgaatcagaaaactgatttattctggggcgtgatcctaatcttgacttgcacaagtgtaacttgacctagctcaccaatttcagtaacattgttctgttctcagttcctggcatgggatattccaaattcctgtgtctggagggaaatgatagcttttgtcttgccatcctgagtgaccagtcacaaagcagttgaagggggctggaagccaccctatgaggacacgccattagtatgtaagcagaatgtgtgtctacctgtcaaagtaatttccagtaacctgagttcacaattctggtcctaggtgagtttttctaggagtgaaaatgcagaaaaggatgttgaaagctattggctaatgtatcatttgaactgctgataacctgagaaggggctcaggcatggtttaaaatgttcgtatcttcactaagtacggttctttcctcacatgcagtttcttaattggatggcactgacctgtttcttttcttgctagcgttatacgcagagcaatgggcgcaggccgtttggcatctctgccctcatcgtgggtttcgactttgatggcactcctaggctctatcagactgacccctcgggcacataccatgcctggaaggtgagttcgtgacaaaggggctttggacagtcttgccagaaaaaggctttgaggggtgggaggtcctgggcttcctgctgtaggccctgtatcagtgaatgagtcagtttaagttaacctagtcctatgagagcaagaaaatgattaaacattgctgtttggaagaaaatcaaagggcagcaaggtgtaagcgtagtccacataaattaaaattcttgggtgggcgtggtgactcacgcctgtaatcccagcactttgggaggccgaggcagttggatcacctgaggtcaggtgttcgagaccagcctggccaacatggcagaaccctgtctccactaaaaatacaaaaaaaatttgctgggcatggtggcacatgcctgtaatcccagctactcaggaggctgaggcaggaaaatcgcttgaacccgagaggcataggttgcagtgagccgagatcacaccactgcactccaggctgggcaacaagagcaaaactctacctcaaaaaaaaaaaaaaaaaaaaatctcccattgcctcttgatagcgcagtaaaacatacaatcgtataaccccattctcggtaagaatcagcatcaactctaaagagctctttgcaaaaggaagccacgaggcagggcctgtgtccacagctgctgtccagcactccagcttgcctcctgccactgccactggctgggcggcccatgtagggcagctgtgttccagggctggccctgggttgtcatgccctatgccacgtgagaacatacgtgtctgttttaggccaatgccataggtcggggtgccaagtcagtgcgcgagttcctggagaagaactatactgacgaagccattgaaacagatgatctgaccattaagctggtgatcaaggcactcctggaagtaagtttgcatttggaatccaggcaaggtggtgaagataccacgttttggtggtgagtggtaggtagatgagcaggaaggaaggtggcaaggatccagcagtaatgcttaatgactgctgtgttccaggcactgctctggtctatggtgtatcctaactgctgtgttccttgaaatagccatgcaagatgtgatcattagtgtctttatccagccggggcagctgagggttgtgcagggacacacagcatgagaaccagaggcaggatgtgaacccagctgtccagctgtggaatctgttctcgagccatcactaggccttccagaggcttgaactgttgctaaagtcaggggattagagaactggagatatggttgggctttgtcaagaccttgaagtgctagcaggtaaaaccagagagggactagctggaaggccaggcgggagcgtaggcatcaggattcctggttgtaaccactgtgtcaagaggagggcctggagcagcgctactgtgcaggagagaggagtcccagtgctgggaggcggaggggtgtgcaggcatcccaaacagacttcacaaatggccatgagtttaggacaaagacacaggttttgggggctgggacctctgttcctgggacggtgctgggtttgggtacacacctatttaaggtactcctgagagctgcttttgtcttgaatagggaaaggtggttaatgctcctgtcttctgtcccttcaaggtggttcagtcaggtggcaaaaacattgaacttgctgtcatgaggcgagatcaatccctcaaggtaatcaccaagtttgtctgctttctttacctgtcagttttctcccatgatcagggctgagcagtaccagttccgaaggaaacatcatagggccattctgtggttttaacattaggaaaatgtctttctgaggctccccatacgtcaaagagaagattcccatcttcctctgattagatggtccacgcgtgttctctgggcatgctgagcggctgccagtcagatctgctgctgctgctactgctgcttaatacttgtctaggtcaggccagcatcctcttgtttttcttgaggttcctctccaaagaggctgtatgagcagcagtgccaaagcctggccgccctccccagaagagggcgctggttccttggcaccttgtgtggcttaggtaaccatgaagtttttttctatagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtattttt

SEQ ID NO: 35779 - DNA, 8844 bp, Homo sapiens
cgggatgcggcgcgccgcgcggtgagtggggtccagggaaacggggtcagctgggggtggcagttccaggccgcgaggccgggctcctgggtcggtgggctggtgtcttggcggacgtcccgcagctgccgcgtggatccgagccggggcacccgccgtgactgggacagcccccagggcgctctcggccccatcccgagtagcgcggcctggctgctgccgccatcaagcacgttcgagccaaaagctcctaacgagtcactcgttagacacgtgtgcggagcctgtgtcccaggccagtgctgtcccgtggagatagattgcaagccgctagggaattttttaactttctagtaggtgtacgaaaaaagtaaaacgaaacaaatcaattggagtaaatccataaatatattcaaactattatttcaattgtatgtgaaaaaattattgggatattctttgtactattcttagaaatccattgtgtgtccaacccaaacatcacagttggactcaccacatctcctgtacttcgtagccctaggtggctagtggcataagacacaaaaatctcagctctcctggagcttatggtctagttggagcaggcagacaatacatttaaaatatacagtttgttagaaggtaaatgttgtaaacaacaataacagttgaagtactggggagagttgcagttgtaaatcagatgggcagggcacaaggtaacatttgagtaaagatgtaagaacttgaaggagatgggcaagtgagctctataagtatacgggagaggggcaagcaagagttcagaggccccttgctgtggggagggatccaaggtggaggagtgggaaccaggaggggagaggaccagtggagcagatctcataggcagttgtaaggacttggggccttattcaatgaaatgaggacactttggagagttttgaacagagcagtgactgatttatgttttggttttggtttagttctattattatttaataataggcttattatttcacagaagttttatttaataaggcagacctcttgtctggaaatgagacaggtgccggagagctggatggaggcagatcgggaattccatttggggcaaactgaacttgattgagaccctggtagttgtccagatggaacaggacacctgagtctagggttcgggaagaactccagatgggacaaacactcctagctttccttttctctttttggatgaccgctacagggtgagacatcggtatccaggcacgataaatttccaagtggacacaatgtctggtgtcaactacagctgttctccttcttttcccagtatcctttgggtgcagtgagacaccaggagagctgctgctttgggggatggacaggggcagcaggaatgcctttgtgttttcgcagtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggtaagtgagagtttgggaaggtgcttcccccacagcatccctgaacttagaagtgttctgcaagagaatgggaacagtttatctaattgatcccacttcctgttaccttgggaaaattaacctctttttccctcagtttcttcttaagatagtaacaaggattaaattaagtaatttgtgggtttggagttagttttagttcagaggctggttggagatgaggacttagttctggcggtgatggcgattacttcactggcagaggaaaatggttttcctatcttcagtgcagattattcaggtatttgcctgtgctgtagccagagagcccctcagtgtggcaagcctggcgccaggcaccaggagccaagactggtgaggatgcactctctggtctcgaggggaccccctctgttcactcatgtctgtttgcctctcctcctggcccccatatttgctggccatgaattttcctgtcccttgggccctctgtctttcctaataaagtggcctgcccaacacaacccttgttctttgcccccatttcttccctggtgatctctcctgcagttggattactcttggtggtgaagcagggacccccatctccccctttgagtttatttgagttttaggtgctgctgcattcccccattcctaccacttacataagagtggctttccaggtaattttcaaatccatctcctattatatttttaaactgaggatttagtaggtgagaccaggtcttactcatttttactgtccttggcaccaggcaaaatggatctcagccctagttgcacattggaatcccctggggagctttgagaagcccatctcatcccatgccaagccaagatcaattctcgttataggcaggcaggagaaccctgggcctagaaatctagctagaacctcaaattcattagggatatgtattagtccattttcacattgctataaaaaactacctgagatagggtaatttataaagaaaagaggtttaattgactcacagttcctcatggctggggaggcctcaggaaacttaacaatcatggcagaaggtgaagggaaagcaaggctcttttacatgatagcaggagagagagagcaaggggaactgccaaccatttttaaaccatcagatcgcatgatggcttgatctcactcaccatcacaagaacagcatgggggaaatccacccccacaatccagtcacctcccaccaggtccctccgtcaacaccgtgtggattataattccagatgagatgtgggtggggacacagagccaaatcatatcaggatgttttctgttttgtttacctgagacaaagtgctgttcacctctcctctcccacataatcaggggctccctcctgcggctccggtagcttttcctcactttcctttcagccctcgggacaccttccttggctcctttcagagctcagttactacttgggcccaatgtcaatgccaccttctagattctttccggcagcacctcctctggtcgcacatttctcttccagttattggagctgtcaaaaaagctccccagtgatggacgatagcgatttcactgtgctcacagactggtcaggaaaccaaacagctgccacagtgaatgtgttgatagcagcggggcagcagtagcactcgctcacaggcctggtggttggtgctggcccccaccctgaatacctacatgtggcttctccatgtggcctgtgcatcctcactgaagctcagcctgtctctccaaattggtctttccactcacctgttccccaaacctgcccagaccttcctgctgtaggcttttcccttcacttggcacactctttcccttgtcttcccatggccccatctaagccccactgtcagctgaagtgttatattctttgaggggccacctgaagccaccttgcaatgagggcctccgttttctacctcagctcaccatttgttcacagcacttgtcactgtggcgagttacttgtctatggcctgttgtcgttctcctgcctagacccagtgggctgagtgggggcaagtgttggcttttatgtccagttttgatcttggtgccagcacattgcctgggtggaagcatgtcctactatcggttacagggatgtcattctgcccagtgctcaggggcatacacttggatcccagttgtgtgcccttggacacattgcttaacctctctgtgcatcagttgggtgataatatctactcctggcacattttcagcgttggctgagttacatgtacagtgcttaggccacctgggggagagtaagagtgggatacgtgaggatgtggagtctgttgcatttctgtctgctgctggcatccttcttgtcttgttttgagttgctcgcctctgtctgctccctagggcgtagatttgaggaatattcctggttcttcccaggcagcaggggctcaggctgtgctggagtcagctaggctaaggggctggtctggcatccgcgttgtcctgtcacctccttggtgttttctccaggcctggatctgtgctgtgtgggcacctgtattcctccctcctgccctcactgattctccatacctttcttctcgagagtgccaagcccctcccatgtgttcttgttcatacctaggatcccgggaaggggctggggaagacggtgcccaggtgccctgggtaaacaaagccacctgactccacgggaatggaatgggtggaggggatctgaggtctgcattttgagtatctctggtctcagaggatgaagcatttggtgggggttgggggtggggggtagggtggaagaatctaaagtcttaaaagaaaatggcagttatttgtgggacagggctgtgttgagacttggcatgcttctttttaagagtcagtgttgtaatttaggtataagtgaagcagtactttgtattagtttcctgtaggcgctgtaacaaagcaccacaaactggttgacttaaaacaacagacatggccgggcacggtggctcacgactgtaatcccagcactttgggaggccgaggcgggcagatcacaaggtcaagagattgagaccatcctggctaacacggtgaaaccctgtctctactaaaaatacaaaaaaaaaaaaattagctgggcgtggtggcacacgcctgtagtcccagctactcgggaggctgaggcaggagaatggcgtgaacccgggaggcggagcttgcagtgagctgagatcgcgccactgcactccagcctggatgacagcgagactccgcctcaaaacaaaaacaaaaacagaaacaacaataacagaaaaacacagacatttactctctggcagttctggaggccagaagttgaaatccagatgtcagcaggattggctccttctgaaggcccgaggggagggtccttcctggcctcctccctggtgttcctgggcttgtggccgcatcactccgctctgcccgtcttcacactccctcttgtctgtgtgtctgtctctctgttctcatgaggacacttggcatccagggcccaaccacacccagagtccctggtctcctgtggctgactcactttttactgtcaccgtgaagtccagggggtccttgtacttgatgttctctcctggcaaggccagggccctgtgattggcctctcatggagtgctgggcagggcctccatggcctctgtcgggcgggggggctacttcatctctgagtctgtacccctcgtgtcccaggcagtggagtgggagtgaagaagctgtgtgaactgcagcctgaggagaagtgctgtgtggtgggcactctgttcaaggccatgccgctgcagccctccatcctgcgggaggtcagcgaggaggtgaggcagggtgctacacagtggggccgccaggcagacctggcctcccactagaacacctccctggaggtggggttgtggggaagcaggttcagagacaatggactccagaggggtgggggctgcggtgccagctcactaacaccagagctttggtgggctctggccccaagattatacctcctgtctctgcattccagcacaacctgctcccccagcctcctcggagtaaatacatacacccagatgacgagctggtcttggaagatgaactgcagcgtatcaaactaaaaggcaccattgacgtgtcaaagctggttacgggtagggagcccaatgagaggatgtgggtgatgcaggtgaagagcccagcggtggtgtgttagggatggtgtgagtggggagcctggggggagtgggggggtgtggcctgggcacacgtgtgttcttgaggaggtaggtgaggctccaggcggtcggaggccatcagattgggtgagacctggctgggagatgggtctccccacctccatccaagggcagtgactccaggaagcaggcatgcatcctggagtcctaggtgagaattcaccaatgtggttgtggagaactggcttgttttgcccgttggggtgactggaaggagtggtagcacctggggctccctgctcaggcctgatgccactgctccccagggactgtcctggctgtgtttggctccgtgagagacgacgggaagtttctggtggaggactattgctttgctgaccttgctccccagaagcccgcacccccacttgacacagataggtgagcagcagttctcgggagctggaaccagctcatggtcagtggaatctttgagttgcacctaggaggggctgcctcccttctcggcaccctggaggaccccaccttctcccgcaggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggtatggagcccacctggctgcattcagccccagcccaggagcctgcaagcctgtaagaccctccttccccagggcgagtagggtaccctgtgaggtctcgcaggtcggtgggaagcgccctgcagtgactctggggcctcctgcaatggggctcctcatgcccaggccctcgctgaggatggtgggaggcttgaagggagtgagggtctatgggacaacaactgcatcttccagctggtggggctctactctcctctgagcctgggactcgcctgggcctgatggccttctgggcttctattccaggccaaatacctcaccaagaaaacccaggcagccagcgtggaggctgttaagatgctggatgagatcctcctgcagctgagcgtgagcgagctgggggctggaggggtgatggggattgcagtcttcaaagctgccactgggcaacagaaggcaggcaggagggcagggggagtggccggagttggtgtagggggctccttcggggccctgtgagctctccctgccctgtgccttccaggcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcaggtagctggcacagccacacttcagtctgacccagccttttgcctcaggaggcacaaagaagggaggggagggagggcccaggaaggtggcagggctgcagaggcccacctagcatctgttccttctctctggggcatccccacaagagcgccagatgagctctgggctgaccactatgggtggcacccaaagccaagagtcagctgagctttgccttgcagatttttggggacatcaggacagaacgtgagtgacattttccgatacagcagcatggaggatcacttggagatcctggagtggaccctgcgggtccgtcacatcagccccacagcccctgacactctaggtaacaggctcagccatacagggtgggagcagagggccaggaggcctggcaggaccctgaagtgcacagggtccccctgtgggtttgcacttgccagcattgctgagaactgtctgaggagaagttcagaggcttggcacctgctctggaagctactctggaatcttaattctaaggccaatggctgcccaccccaacgggcagcaacagcagggccaaggtcttgtgacaatgtctggaggtgcccctattgtcacactgggggtctcctactggcctgcaatgggaggaggggctgcagccccacatcctgtgcagagtgctagtgctgaggcggaaccctcctcagagctgccccttctcctccaggttgttaccccttctacaaaactgacccgttcatcttcccagagtgcccgcatgtctacttttgtggcaacacccccagctttggctccaaaatcatccgaggtaatttttgtcttctgggggcccaggctgatttgctgatttgctctcacctggggacaaggttcacagagaagaaaacctgcattgtggagtccccctggcccttgtgggatggacagctgaggtcttctgcacagctgccatttcactgtgggagccaagctgcctcgccagctgggcagggactggaacggctcccagcctgtgtgcctctcaaggctaatctctggtctcctattgtcactgccccactgtgtgccaatggggactcctgtttatttctggcagcttctctttgaggcaggacttacttggaacctacagtgggtcctatgtgacttctttgcaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcg

SEQ ID NO: 35780 - DNA, 767152 bp, Homo sapiens
atggcctttgaggagctcttgagtcaagttggaggccttgggagatttcagatgcttcatctggtttttattcttccctctctcatgttattaatccctcatatactgctagagaactttgctgcagccattcctggtcatcgttgctgggtccacatgctggacaataatactggatctggtaatgaaactggaatcctcagtgaagatgccctcttgagaatctctatcccactagactcaaatctgaggccagagaagtgtcgtcgctttgtccatccccagtggcagcttcttcacctgaatgggactatccacagcacaagtgaggcagacacagaaccctgtgtggatggctgggtatatgatcaaagctacttcccttcgaccattgtgactaaggtaaagggtcctgttaacctgttctggatacacaatccaggtgtttagaagaaaataaacatgctttaagcctctagttattgtgtagatagtgtagtcagcactcagacactcttttggcaaatagtgattgctcttttttttttttttttttttttttttgagatggagcttgactcttgttgcccaggctggagtgcaatagtgagatctcagctcactgcaacctccacctctgaggttcaaacaattctcctgcctcagcctctgaagtagctgggattacagacatgcatcatgacactcagctaattttttttctttgtatttttagtggagacaaggtttcaccatgttggccagacagatctcaaactcctgacctcaggtgatccacccgaaagtcctgggattgcagatgtgagccaccgcacctggctacttattttttaattgtcaggcacttacattgaatttgaggcaatgaactcaaccaactagatataaatacagctatcacaaaactagcttgaagagaagactaatgattagaaaaatattcttcctggtcacttgttctcagcctaagttgcaaattggaaacatctgtgttatttttaaaatctgcctgctttggctacatgttacagaagcaaatcagagtggatttcatactagcatcaatggtttaaaaagtctccttaatgtgtttaatgtgtaacaaaaattgagaaccactgaggtatgcagtgctgaatgaatataaagacagacattaacataacctggaaggttttgtgtgaggatttccagagaaatccatgcttaagccaagacttgaatggtataggtaagaaaatgtagtaaaaagaggctagagagtgtgtccactgaaagctattgcagcaagtgaacaatgagaagtcaaaagctgctgtgaagctatgctgtattggcttccttctcttccagtgggacctggtatgtgattatcagtcactgaaatcagtggttcaattcctacttctgactggaatgctggtgggaggcatcataggtggccatgtctcagacaggtgagtgtctccagatcagggttatcattactctgcagtgtttttatcagcttacaattaatttttttcacaaagaagtgttattgagttacaatatgcaatttacactgttggtgctgctctgttccccagagagttagatacagaaatgaattacagtgagtttagtgagtgccattttgttgccacagagatctctgaacagcatctctgtataggatactgaatacaaaaatatcaaaatagagaattcatcctccttgaagatacaaatatatgaaatggtgtgtagaccttggctagggatattgtgttaagtccctcctggactctgtgagctaaatgcttgtgggctccccagcctggttgtcattatcataattaccccactgtaattagtaggagtattagtctattctcatgctgctaataaagacatacctgggactcggtaatttataaaagaaagaggtttaatcaactcacagttccacatggcttgggaggcctcacaattttggtggaaggtgaatgaggagcaaattcatgtcttgaatggtggcaggcaagaaagcatgtgcagggaactcccctttataaaaccatcagatctcatgagacttactcactaccaggagagcatcatgggaaaaaccagcccccatgattcaattacctcccactggctccctcccatgacacatggggattattacaattcaacgtgagatttggttggggacacagagccaaaccataacaatatgaattttaaaataatagtttttagctctgtgaagaatctcaatggtagtttaataggaatagtattaaatctataaattgctttgggcatgtattagtccactctcaccctgctgtgaagaactgcctgaggctaggtaatttataaagaaaagaggattaattgactcacagttcagcatgactggggagaccccaggaaacttacaatcatggtggaaggggaagtaaacacattcttcttcacatggtagcaggaaagagaagtggagggtgaagggggtaaaagccccttataaaactatcagatctcatgagaactcactcactatagtgaaaccagcatggagataatgccttcatgattcaattacctctcaccaggtccctctcataacacatggggattatgggaactacaattcaagatgagatttgggtggggacacagccaaatcatatcagggcagtatagccatttttataacatggactctttctacctataagcatggaatgcttttccatttttgtgtgtgtcatctttgattttttttttttttgagtagtgttttgtaattctccttgtagagatctttcacctccctagttagctgtattcctaggtattttattcttttgtggcaattgcgaatggcattgctttccttatttggctctcagcttgactgttattggtgtataagaatgttagcgatttttgcacgttgatattctatcctgagacttgctgaagttgtttatcagcttaaaaagcttttgggctgagactatggggttttatagatacagtatcatatcatctgcaaacagggatagtttgacttcctctcttcctatttggatgctctttatttcttactcctgcttgattgccctagttaggacttccaatactgtgctgaattggagtggtgtcttgtgccagttttcaagacgaatgctttgagcttttgcttattcaataagatgttggttgtgggtttgtcatacatggatcttacttttttgaggcatgttccttcaatacctactttattgagagtttttaacatgaaaggttgttgaattttatcaaaagccttttcttcatttatttagataattgtgtggtctttgtctttagttgagtttatgtgatgaatcacatatatttatttacaaatattgaaccaaccttgcatcccagggataaagcatacttgatcatggtggataatttttctgatatgctgctggatttggtttgccagtattttgttgaggatttttgcattgatattcaccaaagatattggcctgaagtttttgtgtttttttttttgttgttgttgttgtttttgtaatctctgccaggttttggtatcaggatgaagctggcctaatagaatgagttagggaggagaccctcctccctaattttttggaatagtttcagcagggatgttgccagatcttctttgtacttctagtagaattcagctgtgattctgtttggtcctgggtgctttttaaaattattacttatttatttatttattattattattattattattattattattattattttggttgataggcttgttgggtgtttttctgaggtgattagatttgattcctctttctgtctttatcatttgtttattggttctcctagtactttatagttttacttgctttcattatggtaactgccatctctctacttcaagatgtaagactccctggagaatgtttttggctgtttctgtggtggtaattcctttagttttcacttgtctgtgaaagattttatagttctttcatttctgaagcatagaagaatttttctgggtataatattcttttctgacaattttttctttcaggactttggatatattatccaattttctcctgccctccaaggtttccactcagaaatttgctgttagtctaataggaattcctttatgtgtgactcaatgctttcttcttgctgcttttagtactttttctttatctttgcttttttgaaaatttgactataatgtgcctgctaggggacctgtttgagttgactctatttggcattctttgagcttcttgtaccaagatatccatgcttatcccaagacttgggaaattttcagctatcatatcataaagtatcataaaatatattttctaaccgtttcacttcccttcttctggaattctcataatgcaaatatttattcacttactggtgtttatacattcggtaggttttcttcattctttgtaattcttttttctttcatctgcctctattatttttagcaaactgtctttaagctcagaaattatttctgcttgttccagtctatggttgaagctgtcagttgcatttttttttacttcattcattgaatattcaactgtaagatttctgtttggttcttttttatatctatgtctttgttaaatttttcatttaaataatgtattgtttttgtaattatattgaattgtctatagtttcttgtatctccctgagtttctttaatattgttattttgaattcattttctggcattttgtatatttgtctataattggggccggttacaggaaaattattgtggtcctttaaatgtgtcaaatttctttcctttgtaatgtttgatttgtctctacattgatttctttggttgagtggaaaggttgcctcttacaattttatgaagagatttcataaggaaaggcttatttgtatgaatgggtcttgtgtcgtcagttttatggggtgtgtcaggctttggttctaggtgggcacagtagtattctttctgtgtagtttcttcagctttaacctaggctagtgacatgtgctagtgtcttagtggcataggctgcaagagttggttatggttgtggtaaggctttgctgggggtcggcttgccaggctgtttctcagatgtggggtgcatgcatgcacgtggtgatttggccaagttaagccaagttagacttatggagctattattctggccaggaacacatacatgaggttgctctgccaggctggtggcaagcctgccagtagtcccccacagggctgttttctcagacccaggacatgggcacacagctactcagccagcctggaggtctgagtgccagcgaagctttcagttgttctgacatcctgattgcaggtgcagggccattgggcataccaagggcttgtctgcagggggtggagcatcatggagctatcctcaggttctagaaagaggagcataggagcaggctttactggctggaaggctgttagttgcatagagttccagggtctttcccccttggggaagggtatgcagcagtttagctggctcaacagtgggttcaccctgggcagaattgccagattgtttttccagatgaaaatgagggtggtgggatttgtttctctgctttgtaggaccagagccaccactgatcctaagcccagactctgcactgctggggttgtggtgttcagtcactgatgtgggcttcatggaatgaagatagagttccagtgctggagaggtgcagtggctactggcccccaggacaggatgcactccagaggtggctctggtctcaagatggtgccatgctgcaacagcttgactcacaagggataggcgtgacctggggaataatactttgtgcccctaatctgggcaatgcagttgggtaaattttcggcagctctcttttggactcaggacttgtgcggactatgaaattctcctatggtaagaactgttgctgtttgtggtggcaatggagactggtgggttcttctgctacagaggctgggtgcctccatgctgccctcctggacttccaatctccacaggtgtgtctccaccccctcgctgcattgcagtgctctcccttccacactctagtgaaatcttacctgtttatttgttgccttggtttttttctcattggtgtgtgggttggggggaatgagtgtcaggagtctctacttagctatcttgctgataccactcctctagatactatttaaatatatctagagttccatttcaaatgtagaacagttcccaacccaaaactttgtttgttaatattactgggcatatacaataagcacaccccatttagtccaagttgtcccctttaagacctgtctttacaaacaccctgtaaaatgccaaatttcctttcccttttcagccttcactttctctctcccttcactctactttctacgtatttttttcctctgagaagtttctgtacttttctctttctgggttgtggctctcttatattttgttctagctggaacacagaggcctataaacccagatcaacaatgggagtccatgtttctttatgagagcctcttaggcaacccaacagaaactttgatgcattgttccactgatgtatcttatacataagtttagccttggcctgcatggtcttagagacccaaatacatatttagctcccttgtatttcatatactatgtagactctctactatgctggatacatatgtcaatatagtagatacttattcatattacaatttccaacattgtagcttcttttctacagtatctgttggtatcagaggccttcttattattaagtgatgaaggtttgattttgatattgttagtgtatattataaacagggagggttacttctgaggatatttctgtgtcaatttagctcttgatatttcaggatttaaagtacacaaaataattagttaaaatattatcaaattttagagtgagctttcattttcttaagtttttaccataaattattattgctgtcataatctaacatgactcgctgtttctcaggtttgggcgaagatttattctcagatggtgtttgctccagcttgccattactgacacctgcgctgccttcgctcccaccttccctgtttactgtgtactacgcttcttggcaggtttttcttccatgatcattatatcaaataattctttgcccagtaagtcaataattgtgatcttctctattttatgaccctttaatttgaccttgaaatttcatctctatttgaccttaaatgctatatgggttttctttcagttactgagtggataaggcccaactctaaagccctggtagtaatattgtcatctggtgcccttagtattggacagataatcctgggaggcttggcttatgtcttccgagactggcaaaccctgcacgtggtggcgtctgtacctttctttgtcttctttcttctttcaaggtaggagctttctctctcactttgccttatggggtcctgggatgaaaatgaatattgaataagaacatattgattttcttattgccacttctggacctagacccatgttctcatttattcactctgtgcagcttgagaaaaaatggtaaatagcaatggctcttctgcctgggagttctgacataaaattggaaaaacttttattgtagacatagaatgattccatcttttttttactaaacatatagattcagatgtttcaaaaagaatatctttgattcatttttgccttgaaataaatcaagttatggtgatatgtgtaatgtttttcacttttataggtgaaattggaagaaaccacaagtgtattcatataactctttgacaatagtgcaggaccatttcaccagtactaaaagttgggcagactgagtgatttatagcatgtgttcagcacttcctcctccattagataattttaacaaacatttatttgtggctaatttcatctctacatttgaaaccaatctatggaagcatcagattcagttagaaattactggaatattgagatattactatatatttcacacagtgagatgaattccgatagacagtagagtataatccatgtcagactcttccattatcttatttcatcttcataacaacccagtaaggaatatggcactgctgtttttgttttattgatgaggaaactgaagtagatgtaaatgagtgactcacttgcatagtaagttaccagcatagctggtagtggcagaagtacttccaacctttgagcagctttaaccttacataagttgaagacttatttttcttaaacaatacatatcatgaacataaatttgctagaactcacgccaaactttggaaagaacttacgcatgtagggaccctaaagcttaagcttcacagacttctttgaaaattttcctgtgatcaaacaaagaagtgatttgtctccaaagtctgttgctaaaccttgaaggtgtattgcaggatcatggtcatattttcctagtatttgtataataaaataggactttgtgttttcaatacaactaagtggtggataataaatggaagacaaaaggcatccatagccaataatcatatgactaataagaaagacagagatgactgcacttgtgtatttttcttgtatcaggtggctggtggaatctgctcggtggttgataatcaccaataaactagatgagggcttaaaggcacttagaaaagttgcacgcacaaatggaataaagaatgctgaagaaaccctgaacatagaggtgagtaggaaagggaaggtggttactgggttgaagggaagacatacgctgacatctgccttctccttattgagacagactaactgcttctaagaagggcagctagctgagaacacaagctcggttcttattttttcaaggccatctcatataaaagaagctttgggaattatgtaactatctctttctttagttcacttcctgatctgaatctacaacctatgcatccttgtggatacactataaccctttggggccttattttcaaatgtctttattgctgcataatttcctggaggctcctttaatgttctccttcatttttcttcacaccgctttcacttctgtaattgcatatcatatatcacactcgagagaaagggaacatatttctcttgtcctactaagtgccagttctcacaacaatgcctgggatgatgttgataaatgataaatgtttattattgaaggttgtaagatccaccatgcaggaggagctggatgcagcacagaccaaaactactgtgtgtgacttgttccgcaaccccagtatgcgtaaaaggatctgtatcctggtatttttgaggtaggcttcgtatagtatatgaggagcattaaaagtttggtgacatgaatcactttcttatttcaaaggttgcaacagtagtgtgtgtgtgtgtgtgtgtgtgtgtgtgtttaggactgatttgtagataaaagatgaagaaaatacacaggtaactgctacatttgaagagaggcagagggttatgtagactcacatcatcctaccagtctcatcattggtgattgatactgaggtaaattgtgttgtttaattttctttatttttttcaattctacttgaaacaaatcttagtaatgtgcacagattatgaatgtatacaactccatgaatatttttatacataaaaagtgtaatcaagtcaggcgtgatggctcatgcctgtaatcccaacactttaggaggctaaggcaggtggatcacctgaggtcaggagttcgagaccagcctggccaacatggtgaaaccccgtctctactaaaaatacaaaaattagccaggagtggtggtgcaaagctgtagtctcagctacttaggaggttgaggcataagaattgcttgaacccgggaggtgaaggttgcagtgagccaagattgtgccactgtactccagcctgggtgaaagagtaagactctgtctcaaaagaaaaaaaaaaaaaagaaagaaaaaagaaaatgtaatcaacacccagatcaagatgtagaaaaaccttggaaggcctccttgtgcatcatctacagcaataaaaactgcccctgccaaaaataacttaagaacagttctggcctccatcaccatgaaggattattgcctgattttgaccttcacaaaatgtaaaagataacatggctccgtttgtcacaggctccttttcctcaactttattccttcaagatttatcagtgctgttgcttgtaatagtaggttgttctccttcccagtgtttcagtattccaatagatgaatacagaacaatttctttacctacttctttgttggtggacttttacatatttccaatttcgggtgttcgcagaagggcttctgtaggcaagcttgtacattgtctcttggggacatgtaagtacttactttggtagtgtcagtaggaaaaattttaaatataattctaaatttttgaaaacttataaaaagtgttacaggagagcgtatgtccacttccaagctgaagacagtactattaaattatacagtttacctcttcctaggcatatcctataggtggctacttcatttaattgcattgtgctttatcacttttcccctatccactacattacagactctggcttctgaatcctagacagtcagagtgggtcaaaaaagtagagatagtggtcagaaaaggacttacttgcttggaattgctatgatctatggtagtttcttctgccataatgtctaaagctagctctttctgggtgtggtagatcattaatgtggactagttctctgtagatgctttctgggtatattgaagatcctcggtaggaacctctgattttatttcctatggtgaagttggtgtaggtttgtttgcctggattctgacactttttcttagctctggggaatgagatatgaacctctttagtgagaaacatcctcctcaggcatcctctgcattgaattgtaccagatttttttgtttgtttgtttcttctcttttctttgcgatcagtgtcaacgtgttatcatttaaaataacttgttataactatataacattttttacaagccttgtggtaactgcaaagcaaaaacctataattgatatgctaaaattaaaacacaaagaaccaaaagatactactagagaaaaccacaaataaaaactgtcaaagtgaaacaaaggggaaaaaaaatctacaaaagaagtagaaaacaagtaacaaaatggcagtgttaaacccttacctatcaataattaccttaagtgttaatggattaaattctgcaattaaagacgtggagtggttgaatggtcatttttttacttaaaatggctcctggtcagctcttacttggaaagagcccacacagatggtctatgagagaaacacatgtatccctgcctctgtgtccatacagtgtgcttattcactcatcacattctctgtctctgctctgacccctcaggagatagccactgtttctcaccttaaatgtcttggaattgtgtcaggcaccagaacactgtgctcccagacagtgctgccaggcacgtagtctttttggagccttactctctagcaaagggaaagttcttcactgtagtagcactggggagaagagagagagcacttacagcatactgacagctctcagaaaatgaattatttccctaattttcaagctttaattcttctgtgttcaatgcttatataccattgagtttgatgactgattcaggttaagtttccctgtcattatcaactatctgcttgggaacttggacaaaagaatgactgacaggagtcctgttcttatgtaatgtcatgcaattattcatgatagctctaagatcaccatctttaaaacaaagaactctacaaattttaccgagcctttattccttaacactgaccaataactgcctgggccaatatgataatcaactgcgggacataggctctaaaccttatgacatgtgtctcttctattttgttcaccacagatttgcaaacacaatacctttttatggtaccatggtcaatcttcagcatgtggggagcaacattttcctgttgcaggtactttatggagctgtcgctctcatagttcgatgtcttgctcttttgacactaaatcatatgggccgtcgaataagccagatattgttcatgttcctggtgggcctttccattttggccaacacgtttgtgcccaaaggtgagagaagactggactttgggggaaagaaaatgtcttctctttgttcttcaggaattgtattggtcacacttgcctaaaaccaggaataaagaggagtgccatttaaaggctacatattccctcaaagcaatatgagcgtgtaaaacgaatttggctaataattgagaaaagagccaggggcagctcagatgtgtatttatcttcatcaactctggaagcagctggatagtggtgacattcattcctgacggtttctctaggagatcaattgatcacttgccctttggttaatcacacttttgataacaagcatggcatgtctaggccttgcgattatatcccatttgaggacacgatatgattgcttcctttgtgtgggctctgtctaggttcttcctcattactatgtcttcagtgaccagtctactcactgctatccgtgtagccacacttggacgtgatgttaagtcaccatgaatgcagcccttgattaggggaaacctttttgactttaacgaagtagaaatcctttgtttacaagcagagaaagaatatatgatagggacaataaactaggcagattaaaagcctatttcactccctgttagactattttataagttaatatgatgattgtatgtaatgattaggggaaccttagtaggcactatgccttccctgcttcccaatacaagaatgtattttaccgcataatagattggggaacttgattcctcttcctgaatattatcaataatgtatatctcctgacttacatcgagcactttctaatcttataaatctataattctctttctttctatattaggcagaaaacattctctgaaacttccttttaatggtttccaaattctgaatttatttttccccaagcagaagttccattgcttggttccttatgcctattattctggatctagcctctctactctgcccacttacaaaggagttttttcattagtctcttgtacaattccaactcgtgacaatactgtgtctgtactagattgactgagttacccagatttacctgggactttcttggttttatcaataaaaatttaacttcactaaaaccccttcatccctgggaaatctaggatggctggtccctttaaattctgcactttaattgtaaagttctcaagtacagtgctgagtctcagactcctcagtaattgtccacatgctggttctaccttctatagaatgggcatagcgaatactggacagaataagtaagaaaaaatttctgctagagtcaccgtttctcctccctctctgaaaaatcttagatatacagagagatttcctgcattaatgcagataatattatgcactttttgccacctatgttgataattctaagctgataatttctcagcttatcaacctctggatgttctctggcactattcagttttctacagtatttttcaaacatgcaaatactcgatagattgtttttaaattaagtttggtggatgttgcttccttcggcccagatatcagagtctcactggtctcttccttttgccagaaatgcagaccctgcgtgtggctttggcatgtctgggaatcggctgttctgctgctactttttccagtgttgctgttcacttcattgaactcatccccactgttctcaggtataagagatacagatgctccacctgagcccaaaataagaatttcccactaaacaatacttactgagggaataaagctgagacctgtttattattttaaaagcaatcatttataatactaataatacactaacaaaaattatggccaatgattattgcaagctgactttgcactatctactgtgctagacagtattttaatgtatcatctcactaatctttcggaccactcatcagcgtaggtgtcatgtgtaactgtctgtttaaaatgatgaaaaggagtcttaactcacactgaacctgattaaaaacagctagaaaatcatagagaaaatctcaaaagcagctgtttgcccatgtacctaatgattgtgttttattgtcttctgcagtcaagtcaaaataatatgtcacaaattacatgtgtagattttttttctgattatcatgtattgttatttatctgtagggcaagagcttcaggaatagatttaacggctagtaggattggagcagcactggctcccctcttgatgaccttaacggtattttttaccactttgccatggatcatttatggaatcttccccatcattggtggccttattgtcttcctcctaccagaaaccaagaatctgcctttgcctgacaccatcaaggatgtggaaaatcagtgagtgaatcttttagccatgtcctgagagaagcagtgtactctatatccgtgataagaaatgaaaaactccatgtggatccttgagattattgtgaaagcttagcctttcctgagctacttccacttgggccattgcctttcattagcagcagggccagctctatccattctgagttccaactctagagtacagagacaccctcattggtagttttagtgataaagagataaaaatgagctatgttgtgatggcacatactacctttcctcatgaaagacacacgctcatgatggtatttaatgattcttggattcatagagcttgggatatggtggggaaggaaacaaaatagtgaaggaagaatgttcagaaatatcacaaagagttaaagatcctccttgaaaagatagtaaaggagataactcttgtttagttgcctgtgaaattcagtcaaccttgctgccatgagtaatagaaggtttgaggatagagaaaataagaaactaggaaaaagtatttttattttttaattttaaagtttcattttatttgtatatttaaagatggggtctcctctgtcatccagtctgaagtgcggtggtgcaatcacagcttactgaagcctcgagttcctgggctcaggtgattctcccacctctgcctcttgagtagctggcacacgcctctacacatggctaaatttttgtatttttagtagagattgggtttcaccatgttgcccaggctggtcttgaactcctgtgttcaagcaatccccctgccttggccttttattttgtttttaattgactcaaaataattgcacatatttatggggaacagtgtgacgttttgatacatagaaatcatggtaattagcatatctataatcttaaacacatcattttttggggtgaggacattcaaatcctttcttatagctcttttgaaatatataatacattattgctaattatggtcaccgtactgtgccatagaacactagaatttttttttttttagacagagtctcactctgttgcccaggatggagtgcactggcacaatctcagctcactgcaacctctgcctcccggattatagtgattctcctgccttagcctcctgagtagcccgccaccacgcccagctaattttttgtatttttagtagagacagggttttgccctgttagccaggatgatctcgatctcctgacctcgtgatccacctgcctcagcctcccaaagtgctgggattacaggtgtgagtaccgtgcctagcctataatttctttctcctaacaaactgtagctttgtacctgttgatgaacctgttcctatctccccctaccttcttccttccctagcctctgacaaccactattctactatcaacttctatgaaatcaacttttgaaagattctacatatgagtgagatcatgcagcatttgtcatgtgcttctcttatttcacttaacatggttaatccatgttgtcattaacacatcataatccatgttaagtggacaggatttcattcttttttatggccaaattgtattccattaagtatattccactgagtatatatatatctctctctcttcaaaatctactttatctgttgatggacacttaggttaattccatatcttgcctatggtgaatagtgctgtaaaacatgggaatgcaaatatttctttgacataccaatttcatttcctttggatatatactcaatagtgggattgctggatattatggtggttaacttttcatttgttgaggaaccttcatactgttttccataatggctgtactaatttgcatttctaccaatcatgtataaattcctctttctctacatctttactatcatttgctattttatgactttttggtaatagccattctaattggaatgagatgacatctcattgtggctttaatttgttttttatcaatgattggtgatgttgagtattttttcatataactattgggcattcatgtgtcttcttttatgaaatgtctattcagatcttttgcccattttcaaatcacactttgttttttactcttgagctcctcttgtgttttagttattagtcccttgttagacgcgtagtttgtgaatattttatttcactctgcaggctgtctcttcacttcattgattgttttctttgcggcataaagcctctttagtttgatataattccatttgtatatttttgctattttagaattccttctttaaatgtttagtagaattcacctgtgaaggcatcaagtcctgggcttttctttaatgggagactttttattattgattcaatttccttatctttttattggcctgttgaggttttctacttctccatgattcagtcttagtaggtttgtatgtgtctagggatttttctgtttgttttttttttctgttttttaattttttggtttgtatttgttcataacagtctctaaggatcctttttgtgatatcagtggtgatgtctcctctgccatctctaattttatttgagtcatctctcttttttcttagtctggctaaggcttgttgatgttgtttgtcttttcaaaaaacaaacaaattttcctaatcttttgtatttttgtcttttttatttatttttgctctgatatttattatttccttctactaattttggttttagtttgtttttgtttttctagttcctttaggtttaatatcaggttgtttatttgagatctttaaatttttttgatgtagatatttaatgctataaacttccctcttagaatggcttttgctgtatcccataggttttggtatgttgtgtttccattttcttttgtctcaggaaatttttaaattttgtttttatttcttcattcacccaatgactgtttaggagcatgttgtttaatttccatgtatttgtaagttttccaaagttctttctttctgttactaatttctagttctattgcattgtgatcagaaaagatatttgaaattattttgattttaaaaaaaattgttgagttttgttttgtggcctaacataggatttaacctgaaaaatgttctgtgtgcttctgagaagaatttgtcttgtgtagctgttggatgaaatgttctgtaaatgttggatctaggatgtgatttaattttaatatttctttgttgattttctatctggatgatctgtccattgctgaaagtctcctattattattttatgcagactatcactccatttaggtctattaatatttgctccatatatttaggtgctctgatgttggggcatatatatttataattgttttatcctattgctgtattgaccccttaagtattatatatggtcttatctctttttgcagtttctggcaaaaaaaaaaaaaaactgcaaaaagaaacaagaccataatgtttattttatctgatataagcatagctactcctagtcttttttagttttcatttgcatgaaatactttttccttttgttcaattcaagtctacgtgtgtccttatagttgaaatgagtctcttataggcagcatataattaagttaaaaaaaatccattcaatcattctacgtctttaattgcagaatttagtccatttacattcaaggtaattattaataggtaagggcttaacactgccattttgttaccgattttctacttgttttgtacatttttttcccctgctttcacttttacagtttttatttgtggttttctctagtagtatattttgattctttgtgttttaattttagcatatctattataggtttttgctttgcagttaccacaaggcttatacaaaattatataattataacaagttattttaaatgatagcaacttgacactgatcacaaagaaaagagaagaaacagaataatctggtacaattcaactctccttccacgttttgatttttgtcatgatttacacttttattttgcccacctcttaacaaattattgtagttattatttttgataggttttttttagttttcatactaaagatataagtaagtggtttacatgccacaattacagtactagagtaacaatcacattaatgcccttttctttaagttcaaaaaactccatttagcatttcttgtaggagatagtgatgaattccctcagcattttttttttttgcctgggaaagtctttttatctcaactcatttctgaaatatagcttttctgggtagagtattcttggacagcagtctttttttttttccttcagcattctgcatatatcatctcaatcctttctggcctgcacattttcagctacaagtctgcttccaggcatattggatctcccttatatattatttgcttctttttttcttggtgctttcaggacgctctatttgtctgctctttgagagtttattataatttttcttgggatattcttgtttgggtttaatttgattggtgacaagaaataatgttaaaataataaaaatagcatattcacttcttatgtctttcataacaagatatcacaaacttaggcacttaagaaaagaaatttattgtctcacagttctggaagctagaagtctgagatcaatttattgaaaaggacttgacctcactgaagtctgtagggaagaatctattccagacacctcttctcacttctggtagatccttgggtatagtttcccaactgtaatcttcacatggcatttttccccacgtgtgtgtctctacattcaaatttcccccaactatttttttttttttagatagagtctcgctctgtcacccaggctggagtgcaacctctgcctcctggattcaaactattctcccatctcagcctcccaagtagctgggattacaggcacccaccatcatgtcaggctagtttttgtatttttgtatagacagggtttcatcatgttaatcagcctggtcttgaactcctgacctcaggtgatccacctgtcttggcctcccaaagtgctgggatgataggcatgagccaccacgtctggcctcaaattcctccttttttataagggcaccagtcatattgagtgaggggtcccactctactccaatatgaccttgccttaactagtaacatgtgcaacaacactgtttctgaataatgtcacattctgaggtatttagagttaagacttcaacatataaattttctttggtggggggacacaatgtaacccataattaatggtgagatttcttaaattttttaattcaccccttaactttcaaagatgccatttaccacaggtctaaaaagaccaagtgagagtagcaattttcaaaactccctttggatctgcacaggcagcaggaccttttacagagtgagtgtgattcgctagaaatactgacttataaatagctgatggtgtaatcccatttttgggtatatactcaaaggaatataattcattctactataaagacacatgcacatgtttgtctattgcagcactattcacaatagcaaagacatggaacaaacctaagtgtccgtcaacagtagactggataaagaaaatgtggtacatatataccatggaataccatgcagccataaaaaaaaacatgtcctttgcagcaacatgggtggagctggaaaacattattctaggcaaactaatgcaggaacagaaaaccaaataccatatgttctcacttataagtgggagctaaactacaaaaacacatggacacaaagaactacagatgctggggcctacttgagggtggtgattgggaggagggaaaggattaaaaaaaacctatggagtactatgcttattacctgggtaactaaataatatgtacacaaaacccctgtgacacactgtttgctatataacaatcctgcacatatacccctaaacctaaaataaagttaaaaaataaataaataaatgctgatggtcagaggttcagcttgcaatggtgcatagaggacatacaaagtaattttgattttttctgaacgtttgtttttgtttgttctttttcaatttattgtttctgttttgttttgtttttccagaaaaaaaaatctcaaggaaaaggcataaaaatgattgctacacaaaagtgaccaaattttaagaagccttcatgagctgattggtggggaaattcagaaaaaaaaatacaggaaaagaacacaccagaagggtttttttccctacaaccagcaagaacatatattagatacatgaatctcaattataattatggcattaatttgcattttatttcaaaattaacttgtggggacatgtaatctcttgagcaatctgatatttttgggaagtcctttaaaaagttacaaatttatcaataaattactagtagataagatgattcagaaacaaaagaaaatcacagaattaggatgtggctggctggtgtatgaagcaccatgtgatgaattcataaagttgcaaaagtcaaaacaatactgtacatgcaaccagaaatcaaaataaatccagaaatagagacctatataaatgcatttaatacatgatacttttgacataataagccattggaaaacggaaagattagatactaaataacattgactatctctttgtaaatacagtcactaaatgatgttagttacttttccatggtggaattttaattactttttctttgtaatttttctctctgtatattttaaacaaatagctggtatagtttacaatattataaagatattgttcaaattgaagggcaaaggccaggttcagcaattttcaaactgtatgtacatttaataaaataactataaattaaaaaattatatttcaaatgatgtgactaataaatgaaagtacatatagtagtaaagtaatttcaggcaaacctatataaccaaaatataaactttcattttaaacagcaaagattttaagtgctaatgattctcagagtgggtgaagatacactgaatgttggggtgatcagacccaacgccaggtcgtcggggcgatgaagtctggcggagtcaaaggaatgagaaaaagacaatttgagagagaaagtgggaccgggggccatcacaagtgtggaggctgcgaaggccccaagctctgggagcccatgctatttattggtgctcaaacaaacaaacaactggtggtgaggtgtcgggggaaattcagccagatgtcgggcaaaattcacccccgatatttcacataggttcttttctactttcccaaagcatcgaccagtttgagaaataaagggacggagtacaaaagagagaaatttcaaagctgggcatctgggggagacgtcacatgtcggtaggttccatgatgtcccctgagccataaaaccagcaaggttttattagggattttcaaaacaggagggagtgttcgaatagggtgtgggtcacagagatcatgtacttcacaaggtaatagaatatcacaaggcaaatggaggcagggcgagatcacaggaccacaagacgggtgaaattaaaattgctaatgaagtttcaggcaccattgtcattgataatatcttctcaggagacagggtttgagagcaactgatctgaccaaaatttactaggcgggaatttcattatcctaataagcctgggagcgctatggaagactggggcttatttcatccctacagtctcaaccatagaagatggtcacacccaagggggccattttagaggcccaccctcaggtgcgcgttctctttctcagggatgttccttgctgagaaaaagaattcagcgatatttctcccatttgctttcaaaagaagagaaatatggctctgttctgcctggctcaacagcagtcaaaatttaaggttatctctcttgttccctgaacattgctgttatcctgttcttttttcaaggtgcccagatttcatatagttcaaacacacgtactctacaacttgtgcagttaatgcaaccatcacagggtcctgaggcaacatacatcctcctcagcttacgtgatcacaggattaagagattaaagagagagcgccaagatggccgaatacgaacagctccggtctacagctcccagcgtgagcgacgcagatgatgggtgatttctgcatttccatctgaggtcccgggttcatctcactagggagtgccagacagtgggcgcaggacagtgggtgcagcaaaccatgagtgagccgaagcagggcgaggcactgcctcacttgggaagcacaaggggtcagggagttccctttcctagtcaaagaaatgggtgacagacagcgcctggaaaattgggtcactcccaccctaatactgcgcttttccgatgggcttaaaaaacagctcaccaggagattatatcccgcacatggctcagagggtcccacgcccacggaatctcactgattgctagcacagcagtctgagatcaaactgcaaggcagcagcgaggctggggatggggtgcccaccattgcccaggcttgcttaggtaaacaaagcagacaggaagctcgaactgggtggagcccaccacggctcaaggaggcctgcctgcctttgtaggctccacctctggggacagggcacagacaaacaaaaagacagcaataacctctgcagactgaaatgtccctgtctgacagttttgaagagagcagtggttctcccagcacgcagctggagatctgagaaccggcagactgcctcctcaagtgggtccctgaaccctgacccccgagcagcctaactgggaggcaccccccagtaggggcagactgacacctcacatggctgggtactcctctgagacaaaacttccagagtaacgatcagacagcagcattcacagttgatgaaaatccactgttctgcagccaccgctgctgatacccaggcaaacagcatctggagtggacctctagcaaactccaacagacctgcagctgagggtcctgtctgttagaaggaaaattaacaaacagaaaggacatccacaccaaaaacccatctgtacatcaccatcatcaaagaccagaagtagataagaccaaaaagatggggaaaaaacagagcagaaaaactggaaactctagaaagcagagcacctctcctcctccaaaggaacgcagttcctcaccagcaacggaacaaagctggatggagtatgactttgatgagttcagagaaggtggcttcagatgaacaaactactctgagctacaggaggaaattcaaaccaaagacaaagaagttaaaaactttgaaaaaaatttagatgaatgtataactagaataaccaatacagagaagtgcttaaaggagctgatggagctgaaagccaaggctcaagaactatgtgaagaatgcagaagcctcagaagctgatgcaatcaactggaagaaagggtatcagtgatggaagatgaaatgaatgaaatgaagtgagaagggaagtttagagaaaaaagaataaaaagaaatgaacaaagcctccaagaaacatgggactatgtgaaaagaccaaatctacgtctgattggtgtgcctgaaagtgacggggagaatggaaccaagttggaaaacactctgcaggatattatccaggagaacttccccaatctagcaaggcaggccaacattcagattcaggaaatacagagaatgccacaaagatacccctcgagaacagcaactccaagacacataattgtcagattcaccaaagttgaaatgaaggaaaaaatgttaagggcagccagagagaaaggtcgggttacccacaaagggaagcccatcagactaacagtggatctgtcgccaaaaacactacaagccagaagagagtgggggccaatattcaacattcttcaagaattttcaacccagtatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccgataccaaccactgcaaaatcatgccaaattataaagaccatccaggctaggaagaaactgcaacaactaacaagcaaaataaccagctaacatcataatgacaggaacaaattcacacataacaatattaactttaaatgtaaatggactaaatgctccaattaaaagacacagactggcaaattggataaagagtcaagaaccatcagtgtgctatattcaggaaacccatctcatgggcagagacacacataggctcaaaataaaaggacggaggaagatctaccaagcaaatggaaaacaaaaaaaggcaggggttgcaatcctagtctctgatgaaacagactttaaaccaacaaacatcagaagagacaaagaaggccattacataatggtaaagggatcaattcaacaagaagagctaactaactatactaaatatatatgcacccaacacaggagcaccaagattcataaagcaagtcatgagtgacctagaaagagacttagactcccacacaataataatgggagactttaacgccccactgtcaacattagagagatcaatgagacagaaagttaacaaggatatccaggaattgaactcagctctgcaccaagcagacctaatagacatctacagaactctccaccccaaatcaacagaatatacattcttttgagcaccacaccacacctattccaaaattgaccacatacttggaagtaaagctatcctcagcaaatgtaaaaggacagaaattataacaaattgtctctcagaccacagtgcaatcaaactagaactcaggattaagaaactcactcaaaaccgctcaactacatggaaactgaacaacctgctcctgaatgactactgggtacataatgaaatgaaggcagaaataaagatgttctttgaaagcaacgagaacaaagacacaacataccagaatctgtgggacacattcaaagcagtgtgtagagggaaatttatagcactaaatgcccacaagagaaagcaggaaagatccaaaatagacaacctaacatcacaattaaaataactagaaaagcaagagcaaacacattcaaaagctagcagaaggcaagaaaaaactaaaatcaaagaagaactgaaggaaatagagacacaaaaaacccttcaaaaaattaatgaatctaggagctggttttttgaaaggatcaacaaaattgatagaccgctagcaagactaataaagaaaaaaagagagaagaatcaaatagatgcaataaaaaatgataaaggggatatcaccaccaatcccacagaaatacaaagtaccatcagagaatactacaaacacctctatgcaaataaactagaaaatctagaagaaatggataaattcctcgacacatagagcctcccaagactaaaccaggaagaagttgaatctctgaatagaccaatgacaggctctgaaattgtggcaataatcaatagcttaccaaccaaaaagagtccaggaccagatggattcacagccgaattctaccagaggtagaactggtaccattccttctgaaactattcccatcaatagaaaaagagggaatcctccctaactaattttatgaggccagccatcatcctgataccaaagcgtggtggagacacaaccaaaaaagagaattttagaccaatatccttgatgaacatcgatgcaaaaatcctcaataaaatactggcaaaccgaatccagcagcacatcaaaaagcttatccaccatgatcaagtgggcctcatccctgggatgcaagactggttccatgtatgcaaatcaataaacataagccagcatataagcagaaccaatgacaaaaaccacatgattatctcaatagatgcagaaaaggcctttgacaaaattcaacaatgcttcatgctaaaaactctgaataaattaggtattgatgggaggtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccaggtcaatcagacaggagaaggaaataaagggtattcaattaggaaaagaggaagtcaaattgtccctgtttgcagacagcatgattgtatatctagaaaaccccattgtctcagcccaaaatcttctgaagctgataagcagcttcagcaaagtttcaggatacaaaatcatgtacaaaaatcacaagcattcttatacaccaataacagacaaacagagccaaatcatgagtgaactcccattcacaattgcttcaaagagaataaaatactaggaatccaacttacaagggatgtgagggacctcttcaaggagaactacaaaccactgctcaatgaaataagaggatacaaacaaatggaagaatattccatgctcatgggtacgaagaatcaatatcgtgaaaatggccatactgcccaaggtaatttatggattcaatgccatccccatcaagctaccaatgactttcttcacacaattggaaaaaactactttcaagttcatatggaaccaaaaaagagcctgcattgccaagtcaatcctaagccaaaagaacaaagctggaggtatcatgctacctgacttcaaactctactgcaaggctacagtcaccaaacagcatagtactggtatcaaaacagagatatagaccggtggaacagaacagagccctcagaataatgccacgtatctacaactatctgatctttgacatacctgagaaaaacaagcaatggggaaaggattccctatttaataaatggtgctgggaaaactggctagctgtatgtagaaagctgaaactggatcccttccttacaccttatacaaaaattaattcaagatggattgaagacttaaatgttagacctaaaaccataaaaaccctagaagaaaacctaggcaataccattcaggacataggcatgggtaaggacttcatgtctaaaagagcaaaagcaatggcaacaaaagccaaaattgacaaatgggatctaattaaactaaagagcttccgcacagcaaaagaaactaccattagagtgaacaggcaacctacagaatgggagaaaatgcttgcaacctcctcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaaaaaacacatgaaaaaatgctcatcatcactggccatcagagaaatgcaaatcaaaaccacaatgagataccatctcacaccagttagaaaggcgatcattaaaaagtctggaaacaacaggtgctgcagaggatgtggagaaataggaacacttttacactgttggtgggactgtaaactagttcaaccattttggaagtcagtgtggcgattcctcagggatctagaactagaaataccatttgacccagccatcctattactgggtatatacccaaaggattataaaacatgctgctataaagacacatgcacacgtatgtttattgtggcactattcacagtagcaaagacttggaaccaacctaaatgtccaacaatgatcgactggattaagaaaatatggcacatatacaccatggaatactatgcagccataaaaaatgatgagttcatgtcctttgtagggacatggatgaaattggaaatcatcattctcagtaaactatcacaaggacaaaaaaccaaacaccgcatgttctcactcatagataggaattgaacaatgagaacacatggacacaggaaggggaatgtcacacaccagagactgttgtgggctgtggggagggggaaggatagcattaggggatatacctaatgtaaatgagttaatgggtgcagcacaccaacatggcacatgtatacatatgtaacaaacctgcacattgtgcacatgtaccctaaaacttaaagtataataataataaaattaaaaaaaataaccaggcatgatggtgtgcccctgtagtcccagctactccggagggtgaagtgaaaaaggaggatcacttgaaccagggatgtcgaggccgcagtgaggtgtgaaggcaccattgcactccagcctgggcaacagagcaagatctgtctcgaaaagaaaaagaaaagaaagaaagaaggaaagaaaaagaaagaaagaaagaaagaaagaaagaaagaaagaaagaaagaaagaaagaaagaaagaaagaaggagagggagagagagagagagtgataagaaagaaagaaagaaagaaagaaagagagggagagagagagaaagagtgataagaaagaaagaaagaaagaaagaaagaaagacccaccccacttgtaactgctgctaataggagtgcatattcagggcagcttgaatcagtattgctgggtggccatcctcaagctttgggctcaattaaactctacatttaacataaaaaaaactgggatgatcaatttctacgtttattcaaagaaactataaacatcagttctatgggacaattgggccagtttcagtcccccccccccgaccattttatctatcagctcctcaatcattgggaatctggttattgatctttctggctgcttcatggtaaggaggggcattatagacaacttcacaccaagggtgaccacttagccactcaggaatcaacggttaatctaatactacaattttcttcaggaatacaatatttctctcttcagtttcctacttccaccaaagataaatcacagcagaaccatctcttattaatattacctaaaaatgttttaaaaagagaaaactaaattttactattgtatggtgtattattgttaaaactaattttaataaatccttataaacaactgtatctaattttaattggtttgaccataatatttccataaacttttaatgaccttttacaattgctgttgaagagcagattggggggatggagccaagatggctgactagaagcagtggtgattggaggctcccatcagaaagatccaaaacagcatgcgaatcctgcaccagcaaccaaagtatccaggttttgtcattagggctgactaggtgcctggcatgatccacggaaaggaaggaagagcagtgtggtgcaatggcccacctgagagccacacagggcaggggaacccctacccccagccaagggaggtggtgagtgagcatgttatccagcctggaaaactgcttttttcacaaaactgtgcaacccatggattggaagattccactcatgagcccacaccaccagggccttgagtcccaacaaggagccatgcagaatctcaacagccagtcagctagaatcagcctaagcctgcagagtttatggtggctgaactctgaactctccatatttctcagaggttttgttcattccttttcaatcttttctctctaaccttgtctgcctgcctatgtcagcaagatagtcttcaaactctgatattctctcttccacttgattgattcaggtattaatacatgcgtatgcctcacaaagttcttgtgctcatttttcaactccatctggtcatttatgttcctctctaaactggttattctagttagcagctcctctaactttttatcaacgttcttagcttctttgcattgggttagaacatgctcctttagctcagtcaactttgttattaccatagccactgctgtggctgcctcctgtgtaatccagctgagctccttgggggaggggtggcagtcaacactgtggctttggggcctccctgcaggaactccaactctagccagggactcagggacagaactctaatctcccggggcctgagtccctaaggggaggtatggctgtagtctatgcagaccagcagacttagtctttcctccgttagctctgaggaatcggggcagtctagatgagtaggattcccccaagtgaagaacacctcctccaccagaggacagccaaaagtgcttcattaaatgggtcctgatttccatgccacccaactgggtgagaacccccaacaagtgttgtcagatatctatacaagaatgtttctactgacatcaggtcagtgccccttgagatcagaaatcccaggccccccaaaaggggttgtcagacatcttatacagaaatgttcctactggcaagagatcagtgccccttgaggtcagatatctcaagaaggaggaggcacccatctttgctgttctccagcctcctcaagtgacatctcccggcacaagaacaaaccagatgaatatagtctgaagtgaagccccagcaaaccataggtgtcccacaaaagaggtacctgattactgaaagaaaaacaaacagaaagcaacaacaatatcaataaaaaagtttccacaaaaacctcatccaagaatcagcagcctcaaagatcaaaactagacaaattcatgaagatgagaaagaatcaatgaaaaaatgctgaaaaccgaaaaggactgtgtgcctcttcacttccaaatgattgcaacacctctccagaaagggcgcagacctggacagaggatgaaatggatgaattgacaaaagtaggcttcagaaagtgggtaataaaaaacttgactgaggtaaaggagcatgttctaactcaatgcaaagaagctaagaaccttgataaaaagttagaggagctgctaactagaataaccagtttagagaggaacataatgaccagatggagctgaaaaatgcaacacaagaactttgtgagtcatacacatgtattaatacctgaatcaatcaagtggaagagggaatatgagagtctgaagactatcttgctgaaataggcaggcagacaaggttagacaaaaaagattgaaaaggaatgaacaaaacctctgagaaataaggaactatataaaaagactgaaactatgattgattggcatgcctgaaagagattggaagaatggaaccaagttggaaaacaaacttcagcatattatacaggagaattttcccaacctatcaagagaagcccactaagatactccatgagaagatcaatcccaagacacataataacagattctccaaggtcaaaatgaaggaaaaaatgttaatggcagccagagaaaaaggccaggttacctacaaaggaaagcccatcccgtcagactaatagtagatctctcagcagaaaccttacaagccagaagagagggagggccaatattcaacattcttaaaaaaaagaattttcaacccagaatttcatatattgccaaaccaagatttataagcaaagcagaaatgaaatccttttcagataagcacatgctgagggaatttatcaccactaggcctgtcttgtaagagctcctgaaggaagcaataaatacgaaaaggaaaacctggtaccagccacagcgaaagacaagaaaatataaagaccaatgacattataaagaatgtcatcaactagtgtgcaaaataaccagctagcatcgtgatgacacgatcaaattcacacataacaatattaacctttaatgtaagtaggctaaatgccccaattaaaaggcacagactggctaattggatagagtcaagaaccatcagtgtactgtattcaagagacccatctcatgtgcaaagacacacatagactcaaaataaagagtgcaggaaaaatttaccaagaaaagctaactttcctaaatatatatgcatccaatacaggagcacccagattcataaagcaggttcttagaaacctacaaagagacttagactcccacacaataatagtggaacactttaacaccccactgtcaatatcagaaagatcaatgaaacaggaaattaataataatattcaggactttaactcaactctggatcaggtggacctaatagatatctacagaactctccacccaaaaccaacagaatatacattcttatcagtgccacatggcaattactctaaaatcaaccacataattggaagtaaaacactcctcagcaaatataaaagaactgaaaacgtaaaaaaccttctctcaggttacagtgcaatcaaattagacctcagggttaagaaactcattcaaaaccacacaactcatggaaattgaacaacttgcttctgaatgactcctgggtaaaaaagaaattaaggcataactcaagaagttctttgaaaccaatgagaacaaagagacaatgtaccaaatctctgggatgcagttaagcagtattaagagggaaatttatagcactaaatgcccacaccagaaagctggaaagatctcaaatagacactctaacatcacaatgaaaagaactagagaaacaagagcaaacaaagtcaaaagctaggaggagacaagaaataactaagatcagagcagaaccgaaggagatagagacatgaaaaacccttcaaaaatcaataaatcccagagctggttctttgaaaaaattaacaaaatagatacaacactaggtagactaataaagtagaacagagaagatgtaaataaacacaataaaaatgatgaaggggctatcaccactgaccccattgaaatacaaacaaccatcagagaatactataaacacctctatgaaaataaactagaaattcagaagaaatgggcaaattcctggacacatgcaccctcccaagactaaaccaggaagaaattgaatccctgaattgaccaataatgagttctgatattgaggcagtaataaatagtctagcaacaataacaacaacaaaaaagccaaggaccagacagatttacagccaaattctaccagaggtacaaagaggagctggtaccattctttctgaaactattgtaaacaatagaaaaagaggggatcctccctaactcattttatgaggccagcatcatcctgataccagaccttggcaagacacaacaaaaaaagaaaatttcaggccaatatccatgatgaaccttaatgtggaaatcctcaacaaaacactggcaaaccaaatccagcagaacatcaaaaagcttattcaccatgatcaaactggctttgtccctgggatacaagactggtttaacatacacaaatcaataaatgtaatccatcacataaacagaaccaatggcaaaaaccacatgattatctcaatagaggcagaaaagagcatcaataaaattcaacatcccttcttgttaaaatcattcaatatactaggtatttatggaacacctctcaaaataataacagatatgtatgacaaacccacagccaatatcatactgaatgggcaaaagttggaagcattccctttgaaaaccagcacaagacaaggaggccctttttcaccactcctattcaatgtagtataggaagttctggtcaagacaattgggcaagagaaagaaataaagagtattcaaataggaagagaggaagtcaaattgtctctctttgcagatgacataatcctacatttagaaaaccccattgtctcaccccaaaaacaacttaaactaataaggaatgttagcaaagtctcaggatacaaaatcaatgtgcaaaaatcacaagcatttctatacacaaaaaatagacaagcagagagccaaatcgtaaatgaactcccattcacaattgctacaaagagaataaaatacttaggaatgcagctaacaagggacgtgaaggacattttcaaggagaactacaaaccacttctcaaggaaataagaggggacacaaacaaatgggaaagtattccagcctcatggatagaaagaatcgatattgcgaaaatggccgtacttcccaaaataatttatagaataaatactgctccaaactactattgacattcttcacagcagtagaaaaaactactttaaaaattacatggaaccagaaaaagcccatataagcaagacaattctaagcaaaaagaacaaaactagaggcatcacgctatttgacttcaaactatactacaaggctacaataaccaaaacagcacagtactggtacaaaaacagacatatagaccaatggaacagaatagagacctcagaaataaggccacacatatacaactgtctgatctttgacaaacctgacaaaaacaagcaatggggaaaggattccctacttgataattggtactgggaaaactggctagccatatgcagaaaactgaaactggaccacttccttacaccttatacaaaagttaactcaagatggattaaagactttaatataaaacccagaaccataaaaaccctagaagaaaacctaggtgatatcattcaggacaaaggcatgggcaaagacttcatgattaaaacaccaaaagcaatagaaacaaaagccaaaattgacaaatgggatcaaattaaactaaagagcttctgcacagcaaaagaaactaccatcagagcaaacaggcaacctagagaatgggagaaaatttttgcaactacccacctgacaaaggtctaatatctaggatatacaaggagcttaaacaaacttacaagaaaaaaccaaacaaccctatgaaaaagtgggtaaaggatataaatggatgcttcaaaaaagaagatatttatgtggccaaaaacatatgataaaaagctcaacattaatgatcattagaaaaatgcaaatgaaaaccacaattagatatcatctcatgccagacagaatgatgattattaaaaaggcaagaaacaacagatgctggtgaggctgtggagaactaagaatgcttttacactcttggtgagaatgtaaattagttcacccattgtggaagacagtttggtgatttatcaaggatctagaaccagaaatgccatttgacccagcaatgtcattacttggtatatgcccaaaggaatataaatcactctacaataaagacacatgcacccatttgtttattgtggcactattcacaatagcaaagacatgtaaccaacccaaatgcccatcaatgatagactggataaagaaaatgtgtacatatactgcatagaatactatgcagccataaaaaggaatgagttcatgtcctttgcagggacatggatgaagctgaaagccattatcctcagcaaactaacactggaacagagaaccaaatactgtatattctcactcataagtgggagttgaacaatgagaacacatggacacaaggaggggaacaatgcgaaccagggcctgtcagagagggtcaaggggaggccgaacatcaggacaaatagttaatgcatgcagggattaaaacctagatatcaggttgataggtgcagcaaatcaccatggcacatgtgtacctatgtaacaaacatgcgtgctcggcacatgtatcccagaacttaaagaaaataaataaacaaataaataaaatttgtgcccttaatcaccatgatatcctggctcttggggccacaaccccacctcttccacatcttcatctagcagctcatttggatccatttttctaactaaatcctgtaatttcttcctggttgaagtctaaagcaggagcagatttttcagccaagtgttaaggaaacaaaataactcattatctcataatgaagaaagactgtcaaagtgttatgttttgtttgtacttcctcaagagttccgtctaccctggctgatagtattgccacaagatgacactgtcaagacagaagtgcctgaggaaaggtagagacaacaatttaggaaaagaggccagcctgaaaccatctgatagtttatatctcagcttcatggcttttctcttattgtacctcaccttccccctgccaccaacccacattctggctgcattaaacaattttcagttctctgaccaccacaaattttggtgcctctggggcctttggatgagcttgttctcccttcttcccacatgcttagctcatggcatctccttgatgatgcattttctggcccacccaggtaaaaatgaccactcctcctttggcatctactctatcctgtacattcttctatcaacagactataacactttattgcacatatttataaacttgcatgtttctgacttagcaagctacagactccctaacagtagagaacatttgttcatctctctgtcactaaatgtttgtgtgtgtacaactatgatccttcattcctaaaggaaatgtcatgccacatatatataccattaaaaatgatcaaacaatgtgctaaccatggttttctttgggtggcagaattatatgatattcattctttctgtatttctagagtttctgtgataaacacatataacttcgcaaacaagaagaccaaaaaaaaaactgacattaaagcaaaagatgaataagctttacaataaaaatttaaaaataaaagaacagatcaatgcaccatgaaaaccttgctaaactgatacaggggcccagatgctggccttgcataagtgtgcttttgatgttcctgtttaatttatagaaaaactctgaagtaattttatcactcagtattgacccttataatctcacatgcccacatcttccatgatagtgcctgggcctagagggattgagtagttttaatttctggccctgtgtctcttgagaaccattcatttttttttcttatgttgccaactattattttattataaattagatattctaataatggacactattaacatataaataaaaatgtgactttataaagtaccaatagaaataccaatacatatgagcttgtcaaggggtcttactgaattaagaaactttctgctcaatatatattctatcataaaaataaggagacatcctttgagaatgcactgttcatttttttatactttaaccacatttatttatttatttaatttctttttattatactttaagttttagggtacatgtgcacaacgtgcaggtttcttacatatgtatacatatgccatgttggtgtgctgcacccattaacttgtcatttacattaggcatatctcctaatgctatccttccccttccccacaccccacaacaggccccggtgtgtgatgttcccctcctgtgtccatgtgttctcattgttcagttcccacctataagtgagaacatgcagtgtttggttttttgtccttgcgatagtttgctgagaatgatggtttccagcttcatccatgtccctacaaaggacatgaactcatcatttttatggctgtgtagtattccatggtgtatatgtgccacattttcataacccagtctatcattgttgcacacttgggttggttccaagtctttgctattgtgaatagtgccacaataaacatacgtgtgcatgtgtctttatagcagcatgttttataatcctttgggtatatacccagtaatgggatggctgggtcaaatggtagttccagttctagatgcctgaggaatcgccacactgacttccacaatggttgaactagtttacagtcccaccaacagtgtaaaagtgttcctatttctccatatcctctgcagcacctgttgtttcctgactttttaatgatcgccattctaactggtgtgagatggtatggcattgtgattttgatttgcatttctctgatggccagtgatgatgagcatttttctatgtgtctgttggctgcataaatgtcttcttttgagaagtgtctgttcatatccttcgcccacgtgttgatgggtttgattgtttttttcttgtaaatttgtttgagttctttgtagattctggatattagccctttgtcagatgagtagattgcaaaaattttctcccattctgtaggttgcctgttcactctgatggtagtttcttttgctgtgcagaagctctttagtttaattaaatcccatttgtcaattttggcttttgttgccattgcttttggtgttttagatatgaagtccttgcccatgcgtatgtcctgaatggtattgcctaggttttcttctagggtttttatggttttaggtctaacatttaagtctttaatccatcttgaattaatttttgtataaggtataaggaagagatccagtttcagctttctgcatatggctagccagttttcccagcaccatttattaaatagggaatcctttccccatttcctatttttgtcaggtttgtcaaagatcagatatttgtacatgtgtggcattatttctgagggctctgttctgttccattggtctatatctctgttttggtagcagtaccaaaactgttttggtgactgtagccttgtagtatagtttgaagtcaggtagcgtgattcctccagctttgttcttttggcttaggattgacttggcaatgtgggctcttttttggttccatgcgaactttaaagaagttttttccaattctgtggagaaagtcattggtagcttgatggggatggcattgaatctataaatgaccttgggcaatatggccgttttcacgatattgattcttcctacccatgagcatggaatgttcttccatttgtttgtatcctcttttatttccttgagcagtggtttgtagttctcattgacgaggtccttcacatcccttggaagttggattcctaggtattttactctctttgaagcaattgtgaatgggagttcactcatgatttggctgtttgtctgttattggtgtataagaatacttgtgatttttgcacattgattttgtatcctgagactttgctgaagttgtttatcagcttaaggagatttggggctgagacgatgaggttttctagatatacaatcatgtcatctgcaaagagggacaatttgacttcctctttttctaattgaataccctttatttccttctcctgcctgattgccctggccggaacttccaacactatgttgaataggagtggtgagagaaggcatccctgtcttgtgccagttttcaaagggaatgcttccagtttttgcccattcatacgatattggctgtgggtttgtcatagatagctcttattattttgagatatgtcccatcaatacctaatttattgagtttttagcatgaagggctgttgaattttgtcaaaggccttttctgcatctattgagataatcatgtggtttttgtcattggttctgcttatatgctggattatgtttattgatttgcgtgtgttgaaccagccttgcatcccagggatgaagcccatttgatcatggtggataagttttttgatgtgttgctggattcggtttgccagtattttattgaggatttttgcactgatattcatcagggatattggtcaaaaattctcttttttgttgtgtctctgccagtctttggcatcaggatgatgctggcctcataaaatgagttagggaggattcccactttttctattgactggaatagtttcacaaggaatggtaccagctcttctttgtacctctggtagaattcggctgtgaatccatctggtcctggactttttttggttggtaagctattaattatagcctcaatttcagagcctgttattggtctattcagagactcaacttcttcctggtttagtcttgggagggtatatgtgtccaggaatttatccatttcttctagattttctagtttatttgcatagaggtgtttatagtattctctgatagtactttgtatttctgtgggatcggtggtgttatcccctttatcattttttattgcgtctatttgattcttctctcttttcttctttattagtcttgctagcggtctatcaattttgttgatcttttcaaaaaaccagctcctggattcattgattttttgaagggttttttgtgtctctacatccttcagttctgctctgaacttagttatttcttgccttctgctagcttttgaatgtgttttttcttgcttctctggttcttttaattgtgatgctagggtgtcaattttagatctttcctgctttctcttgtgggcatttagtgctataaatttccctctacacacttctttgaatgtgtcccagagattctggtatgttgtgtctttgttctcattgctttcaaagaacatctttatttctgccttcatttcattatgtacccagtagtcattcaggagcaggttgttcattttccatgtagatgagcagttttgagtgagtttcttaatcctgagttctagtttgattgcactgtggtctgagagactgttataatttctgttcttttacatttgctgaggagtgctttacttccaactatgtggtcaattttggaataagtgcagtgtggtgctgagaagaatgtatattctgttgatttggggtggagagttctgtagatgtctattagatccacttggtgcagagctgagttcaattcctgggtatccttgttgattttctgtctcgttgatctgtctaatgttgacagttgggtgttaaagtctcccattattattgtgtgggagtctaagtctctttctaggtctgtaaggacttgctttatgaatctgggtgctccggtattgggtgcatatatatttagaatagttagctcttcttgttgaattgatccctttaccaatatgtaatggccttctttgtctcttttgatctttgttggtttaaagtctgttttatcagagactaggattgcaacccctgcctttttttgttttccatttgcttggtagatcttcctccatgtctttattttaagcctatatgtgtctctgcatatgagatgggtttcctgaatacagcacacttatgcttcttgactctttatccaatttgccagtctgtgacttttaattggaacatttagcccatttacatttaaggttaatattgttatgtgtgaatttgatcctgtctttatgatgttagctggttattttgctcattagttaatgcagtttcttcctagccttgacggtctttacaatttggcatctttgcagggtctggtaccagtttttcctttccatgctcaatgcttccttcagttcttgtagggcaggcatggtggtaacaaaatctctcagcatttgcttttctgtaaaggattttatttctccttcacttatgaagcttagtttggctggatatgaaattctgggttgaaaattcttttcttgaagaatgttgaatattggcccccactctcttctggcttgtagagtttctgccgagagatctgctgttagtctgatgggcttccctttgtgggtaacccgacctttctctctggctgcccttaacattttttccttcatttcaactttgatgattctgacaattatgtgtcttggagttgctcttctcaaggagtatctttgtggtgttctctgtatttcctgaatctcaatgttgacctgacttgctagattggggaagttctcctggataatatcctgcagagtgttttccaagttggttccattgtccccgtgactttcaggtacaccaatcagacgtagatttggtcttttcacatagtcccatatttctcagagaatttattcatttcttttcattctttttttttaattttattattattatactttaagttttagggtacatgtgcacaacgtgcaggtttgttctcttctcacttcatttcattcttttgatcttccatcactgataccctttcttccagttgattgaatcggctactgaggcttgtgcatttgtcacgtagttgtcgtgccatggttttcagctccatcaggtcctttaaggacttctctgcattgattattctagttagccattcacctaatcttttttcaaggtttttagcttctttgcaatgggatcgaacttcgtcctttagctcagagaagtttgatcatttgaagctttcttctctcaacttgtcaaagtcactctccatccagctttgttctgttgctggcaaggagctgctttcctttggaggggaagaggtgctctgattttcagagtttccagtttttctctctgtcttttccccatctttgtggctttatctacctttggtctttgatgatggtgacatacagatggggttttggtgtggatgtcctttctgtttgttagttttccttctagcagtcagggccctcagctgcaggtctgttggagtttgctggaggtccactccagaacctgattgcctgggtttcagcagcagaggctgcagaacagcggatattggtgaacagcaaatgttgctgcctgatcattcctctgcaagttttgtctcagaggagtacccagccgtgtgaggtgtcagtctgcccctactgggggatgcctcccagttaggctacttggggctcagggacccacttgaggaggcagtctctctgttctcagatctcaggctgcatgctgggagaaccactactctcttccaagctgttagacagggacatttaagtctgcagaggtttctgctgccttctgtttggctatgccctgcccccagaggtggagtctacagaggcaggcaggcctcattgagctgcggtgggctccacagagttcgagcttcccagctgctttggttacctactcaagcctcagcaatggcaggcacccctcccccagtcttgctgccgccttgcagtttgatctgagactgctgtgctaacaataagggaggcttcattggtgtaggaccctctgagccatgtgtgggatacaatctcctggtgtcccatttgctaagaccatcagaaaagcccagtattagggtgggagtgacctgattttccaggtgccatctgtcacccctgtttttggcttggaaagggaattccctgactccctgtgcatcctggttgaggcgatgccttgctctgctttggctcaccctcggtgcactacacccactatcctgcacccaatgtctgataatccccactgagatgcacccagtacctcagttggaaatgcagaaatcactcgtcttctgtgttgctcaggctgggagctgtagactggagctgttcctatttggccatcttggctccaccctccaattcactgatttttgaaggggttttcatgtctctatctctttcagttctgctctgatcttagttatttcttgtattcccctagctcttggctttgtttgctcttgcttctcttgttcttttaattgtgatgttaggatgttgatttcaggtatttctagctttctgatgtgggcatttagtgccataaattttcctcatgacactgctttagctgtgtcccagagattctggtacattgtctctttgttgttgttgttggtttcatagaacttcttgatttctgctttaatttcatttttaacccagcagtcattcaggagcctgttgttcaatttccatgtacttgtgtggttttgagtgagttttttaatcttgagttccaatttgattccactgtgatctgaaagaccgtttgttatgatttcagttattttgcatttgctgaggagtgttttacttcctattatgtggtcgattttagagtaagttccatgtagcactgagaagaatgtatattctgttgtttttgggtggagagttctgtagatatctcttaggtcctcttgctccagagctgagttcaagtcctgaatatccttgttaattttctgtctcagtgatctgtctaatattcataatggggtgttaaaatctcccacttttattgtgtatgagtctaagtctgtaggtctctgagaacttgttttgtaaatctgggtgctcctgtattaggtgcatatatttagtatattaactaactatttaggatagttagttcttcttgctgaattgatccctttgccattatgtaacgttctggttttatcagaaattaggattgcaatccctgcttttttctgctttccatttgcttggtaaattttcctcaatctgtttattttgagcctgtgtgtctttgcatgtaagatgggtcttttgaatacaacacaccgatgagtcttgactccttatccaatttgctagtctgtgtcttttaattggggcatttagtccatttacatttatggttaatattgtaatgtttgaatttgatcttgtcatcatgatgctagttggttattttgcatgctagttgatgtcatttcttcataacgtcattggtctgtatatttttatgtcttttgcagtggctggtaccagtttttccttttcatatttagtgcttccttcaggagctcttgcaaggcaggcctggtggtgatgaattccctcagcatttgcttacctgaaaaggattttatttctcctttgctcatgaagcttagtttgttagcatatgagattctgtgttgaaaattcttttttaaagaatgttgaatattgcccactctgcccccaacacacacactctcttctggcttgtagggtttctgctgagagatccactcttagcctgatgtgctttcctttgtaggtaacctggcctttctctctggctgcctttagtgttttttccttcatttcaacttgggagaatctgatgattatgtgtcttggggttgatcttcttgtggagtatcttagtggggttctctgtgtttcctgaatttgaaagttggtctgtcttgctaggttggggaagttctcctggatgatatcctgaagtgtgttctccaattttgtcccattcttcccgtctctttcaggtactccagtcagttgtaggttccgtcttttcacatagtttcataattcttgcaggttttgttcattctttttggttcttttttctctaatcttgtctgctgccttattttataatgatggtcttcaaactcttatattattccttccacttgattgattcagccattgattcttgtttatacttcatgaagttcttgtgctgtgtttttcagctccatcaggtcatttatgttcctttctaaactagttattctagttagcagatcctgtaacctattatcctggttcttagcttttttgcattgggttagaacatgctactttacctcaggaaagtctgttattagccaccgtctgaagcctacatctgtcagttcatccgaggactttttatcataaaggaatgttgaattttatcatatgcttttctagcagcagtggaaatgatcatatggtttttgcccttcattctcttggtatgatgtatcacattgattgatttgcatatgttaaaccattcttgcgtccctttgataaatcccacttggtcatgatgaaaattcaccctcagccagagtgccctcccaagaatctcagtcaactcaaacctgaggccagagaagtgtcatcacttcatccatcccatggcagctctttcacctgaatgggacatttctcaacataggtgagacagacacggaatcatgtgtaaatggctgggtgtatgacagaagctcctttcccttctccaacatgactgaggtaagaggccttgttttcctttcatgagcactgccctgggtttttataaatagcacacgtaataaccatgcttccagcctttggtcacatgtagatacttattcttcattctttcagcaaatattaagtgctactctattaaatgccagacacatacatattttatgaggctaatgaattcaaaagtagaaatgcaccctgttataatagtgcttttattcttgggcagacaaaagtttaagcaagtaattcatgcctctgttataaatgttatgctaggtcagtaagtctcagcctgtggtcgcaaattaaaaacatctggaaggttgatcaaaacctccatgcctagactgtacccgcagagcagtcataggagaaggagtgcagtgaattcaggattcagtaaacttttacaagatcacaaatgtttacagtccatggccaagtttgagaaccacacttactatggagtaagagtggttattaatattacctacaggtctaggggaagcctcttagggaaagttatgtttaagctgagacctgagtgataaaggtcaggtaatgacaaaaatggaaactagagaggaagttagaagcctgctataatgaaacaaatcaggtcatgttaaggagctttgatcaggttctactgaggggtggtaagctgctgtgaaactctaatattctgtggggggtgcatggcaacatattcaagcttacgtacacggcattttaggtcggggcatggaaaaatgctgaggcaccgtgtgtatgttatttgtgcataagaatgaaaattcttgaccttaaaaacaggacagggagtggaatgtgtagtatgataaggaacgctgaaaacagcctcctgagaatgcagtttgagtgcttttataaggccacaggtgtctcactactcgatgtcaaaaaagccatctagtagatgtttgttgtttaacaagccctttcaataaatacttggcagaggtatgctggggcggactctcttagaaaagctgctagccatatgtagaaagctgaaactggatcccttccttacaccttatacaaaaattaattcaagatggattaaagacttacatattagacctaaaaccataaaaaccctagaagaaaacctaggcattaccattcaggaaataggcatgggcaaggacttcatgtctaaaacaccaaaagcaatggcaacaaaagccaaaattgacaaatgggatctaattaaactaaagagcttctgcacagcaaaagaaactaccagtagagtgaacaggcaacctacaaaatgggagaaaatttttgcaacctactcatctgacaaaggactaatatccagaatctacaaagaactcaaacaaatttacaagaaaaaaacaaacaacaccatcaaaaagtgggtgaaggacatgaacagacacttctcaaaagaagagatttatgcagccaaaagacacatgaaaaaaggttcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggtgattcctcagggatctagaactagaactaccatttgacccagccatcccattactgggtatatacccaaaggactataaaacatgctgctataaagacacatgcacacatatgtttattgcggcactattcacaatagcaaagacttggaaccaacccaaatgtccaacaatgatagactggattaagaaaatgtgccacatatacaccatggaatactaagcagccataaaaaatgatgatttcttgtcctttgtagggacatggatgaaattgtaaatcatcattctcagtaaactatcacaaggacaaaaaaccaaacaccgcatgttctcactcatagatgggaattgaacaatgagaacacatggacacaggaaggggaacatcacactctggggactgttgtggggtgaggggagtggggagggatagcattaggagatatacctaatgctaaatgatgagttaatgggtgcagcacaccagcatggcacatgtatacatatgtaactaacctgcacattgtgcacatgtaccctaaaacttaaagcataaaaataaaataatgataataataataataataataataatctttaagtaaaaaaagctcttaaatagaatctggcataaaggaaaaaaaaaaaaaagctgctcctcgccctttgtcagatgagaagattgtaaaaattttctcccattctgtaggttgcctgttcactctgatggtagtttcttttgctgtacagaagttctttagtttaatcagatcctgtttgtcaattttggcttttcttaccattgcttttggtgttttagacatgaagtccttgcccatgcctatgtcctgaatggtattgcctaggttttcttctagggtttttatggttttaggtctaaggtttaagtctttaatccatcttgaattaatttttgtataaggtgtaaggaagggatccagtttcagctttctacatatggctagccagttttcccagcaccatttattaaatagggaatcctttccccattccttgttttgctcaggtttttcaaagatcagatagttgtagatatgtggcattatttctgagggctctgttctgttccattggtctatatctctgttttggtagcagtatcatgctgttttggtgactgtagccttgtagtagagtttgaagtcaggtagcgtgatgcctccagctttgttcttttggcttagaattgacttggcaatacgggctcttggttggttccatatgaactttaaagtagttttttccaattctgtgaagaaagtcattggtagcttgatggggatggcattgaatctataaatgaccttgggcagtatggccattttcacgatattgattcttcgtacctatgagcatggaaggttcttccatttgtttgtatcctctttgatttcattgagcagtggtttgtagttctccttgaagaggtccttcacatcccttgtaagttggattcctaggtattttattctctttgaagcagttgtgaatgggagttcactcatgattttgctctctgtttgtctgttattggtgtataagaatgcttgtgatttttgcacattgattttgtatcctgaaactttgctgaagttgcttatcaggttaaggagattttgggctgagacaatgggattttctagatatacaatcatgtcatctgcaaacagggacaatttgacttcctctttttctaattgaatacgctttatttccttctcctgcctgattgccctggccagaacttccaacactatgttgaataggagtggtgagagaaggcatccctgtcttgtgccagttttcaaagggaatgcttccagtttttgcccattcagtatgatattggctgtgggtatgtcatacacagctcttattattttgagatacgtctcatcaatacctgatttattgagagtttttagcatgaagggctgttgaattttgtcaaagatcttttctgcatctattgagataatcatgtggtttttttcattggttctgtttatatgctggattatgtttattgatttgcgtgtgttgaaccagccttgcatcccagggatgaagcacacttgatcgtggcggataagctgtttgatgtgttgatggattcagtttgccagtattttcttgaggatttttgcatcaatgctcatcagggatattggtctaaaattctccttttttgttgtgtctctgccaggctttggtatcaggatgatgctggcctcataaaatgaattagggaggattccctctttttctattgatgggaatagtttcagaaggaatggtaccagctcctccttgtacctctggtagaatttggctgtgaatccatctggtcctggactttttttggctggtaagctattaattattgcctcaatttcagagcctgttattgatctattcagacaatgaacacaaacaaatttacaagaaaaaaacaaataaccccatcaaaaagtgggcaaaggatatgaacacacttctcaaaagaagacatttatgcagccaacagacacatgaaaaaatgctcaccaccactggccatcagagaaatgcaaatcaaaaccacaatgagataccatctcacaccagttagaatggagatcattaaaaagtcaggaaacaacaggtgctggagaggatgtggagaaataggaacacttttacactgttggtgggactgtaaactagttcaaccattgtggaagtcagtgtggtgattcctcagggatctagaactagaactaccatttgacccagccatcccattactgggtatatagccaaaggattataaatcatgctgccataaagacacatgcacacgtttgtttattgcggcactattcacaataggaaagacttggaaccaacccaaatgtccaacaatgatagactggattaagaaaatgtggcacatatacaccatggaatactatgcagccataaaaagtgatgagttcgtgtcctttgtagggacatggatgaagctggaaaccatcattctcagcaaattatcgcaagtacaaaaaaccaaacaccacatgttctcactcataggtgggaattgaacaatgagaacacttggacacaggaaggggaacatcacacactggggcctgttgtggggtggggggttggaggagggatagcattaggagatatacctaatattaaatgacgagttaatgggtgcagcacaccaacatggcacatgtatagatatgtaacaaatctgcacgttgtgcacatgtaccctaaaacttaaaatataattaaaaagaaaaaagctgctactcaccccactcagctgaaattgatcattcttggcattcactgcaagctataagctctgcaaatggtgaccttgacatgatagccttaaagtaacacctgaaagaggaaatccccatgctattctagtttctatttcttcttgtggaacctggtatgtggatctcagtcactgaatttagtggctaaattcctattcatggctggaatgactgtgggaggcatcctatatggccatttatcagacaggtgtgcatctctgtttcacatatctctttattagtgcatatttccattagcttatgaatcattcattaatttaaaaatatttattgtaaatcacactgttctaaggatactctggtcctcagggatctagaattacaagtggagaattacaatctgtagggtcagggctattttgtcagcactgaatgctatgtacaagacacagaaatggcatctccattagacctggaagcatttcaggccagggtttggaaatgcactaccacaacatgtggtttagaaagataggaattgttactgtcttagtctattttctacccctataacagaaggtcacagactgggtaatttattaaaataatagaagtttatttggctaatggttctggaggctgaaaggtccaagagcatggcgccagcatctggtgagggactttgtgttgtatcatccctggaagaaggtggaagggcgagcaatggcacaagacagagaaaggatgggggctcaacttcgttctcttgttaggagcccctcccatgattactaacccactttcaggataactctattaatttattcacgaggtcctacctcttaaaggtccttactcttaaaggtcctacctcttaatacaatcacaatagtaactatatttcaacatgagtctggagggtatatccaaaccatagcatttacctataggaactgagaagatgtttcatgacataggattcagcctgtttgaagatgcagatatggaaaacagtgttgtagacctttgccagatgtaccatgtttagtctttccttaaccctgtgaactgaaggcttgtgggtgccagagaatgaccatcacattatagttgcccaagtgtgatgggtagacattactgcaaaaccagtaggatcatagcaatgtgtcatttatgatatgttaaaaattgatgctaatattcttaatttttgtttctgaaagagtaactttttaaagttaagttttataatatgtagggtaatcaatatgaaaactactgtcacagttgtgttagaaatttggagtatcctgtggctagcaatgtctctttggaaataggcagccaacgattaccattatccaagcatataatccccgagcaacatgggagaattaaggtgcttatcatctgctagcctcacattatctgttgcctcagccataaactgtgatctccacaggtgtgacagtaaatgtaatttataagagttcagagtcatagtgttcatttctagcaattcagtaacttagcactctgtgggagcgttataagaaaatgctgataggtcaattttgatggatcataaggtaatagaaatgaaggattagggcaggagatggcagcagagaactaaattaatctgagtggttaagataatctaaggattttgaacttcattggaaaactgaaggtaaacatggaatgagagggccacaatcaaattgatatttttaagtaacatacttaactattcacaatattctaaagctaacagcagtctagaattccattaattatagaatggataaaaaagatacagattattcacataatggatttttatacacaaaaggtaataaataagctctctgtgcattaacatagttgagtataaaaatcatttttttaagcagcataagaacaacaaaaatgattgtatactataccattccacttatggtcaaaaataaggaactacgttatggtgttcggcgttagaaaaggagttctctttaggatttttattaaaattacattaaatgtatacagcagtttaggtaaaattgccattttttaaatgttgaattttctgatctttgaatatgatagagctgttcctaaatttaaattttctttaatttaccatgcaatgttttctatttgttaaaaagaaagtcatgtgttttccattaaatttattcctaataaatctagttgaggctctgaagttggtttttgtaattttaatttttgattagccattgctactacatacaaatagcaattgacttttacatattaatcttacattctgccaccgtgatgaattcacttatcagttctagtacattattgtggattccttaaagtcttcaattacacaattatatcatctgcaagtatggatagttttgcttattattttcctatcttttgcctctgttactttttctaaaagcacctaggacttttagtaaaatgttaattttaagtagtgagatctgatatcctgaccttgttttctgatcttaggttagaagtgaagctttaatgattacatatgatgttaagtatagtattatttttagatgcccttaataatggttgagaagtttccttatatttatagctttctgagagtttttgttgtgaagtaattttgacataaaataaacactaattttttttattattatacttaaagatttagggtacatgtgcacaacgtgcaggttagttacatatgtatacatgtgccatgctggtgcgctgcacccactaactcgtcatctagcattaggtatatctcccaatgctatccctcccccttccccccaccccacaacagtccccagagtgtgatgttccccttcctgtgtccatgtgttctcattgttcaattcccatctgtgagtgagaatatgcggtgtttggttttttgttcttgtgatagtttactgagaatgatgatttccaatttcatccatgtccctacagaggacatgaactcatcattttttatggctgcatagtattccatggtgtatatgtgccacattttctcaatccagtctatcgttgttggacatttgggttggttccaagtctttgctattgtgaataatgccgcaataaacatacgtgtgcgtgtgtctttatagcagcatgatttatagtcctttgggtatatacccagtaatgggatggctgggtcaattggtatttctagttctagatccctgaggaatcaccacactgacttccacaatggttgaactagtttacagtcccaccaacagtgaaaagtgttcctattcctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttttttcttgtaaatttgtttgagttcattgtagattctggatattagccctttgtcagatgagtagattgcaaacattttctcccattttgtaggttgcctgttcactctgatggtagtttcttttgctgtgcagaggctctttagtttaattagatcccatttgtcaattttggcttttgttgccattgcttttgctcttttagacatgaagtccttgcccatgcctatgtcctgaatggtaatacctaggttttcttctagggtttttatgcttttaggtctaacatttaagtctttaatccatcttgaattgatttttgtataaggtgtaaggaagggatccagtttcagctttctacatatggctagccagttttcccagcaccgtttattaaatagggaatcctttccccattgcttgtttttctcaagtttctcaaagatcagatagttgtagatatgcggcattatttctgagggctctgttctgttccattgatctatatctctgttttggtaccagtaccatgctgttttggtgactgtagccttgtagtagagtttgaagtcaggtagcatgatgcctccagctttgttcttttggttcaggattgacttggcgatgtgggctcttttttggttccaaatgaactttaaagtagtttttccaattctgtgaagaaagtcattggtagctagatggggatggcattgaatctataaatgaccttgggcagtatggccattttcacaatattgattcttcctacccatgagcatggaatgttcttccatttctttgtatcgtcttttatttcattgagcattggtttgtagttctccttgaagaggtccttcacatcccttgtaagttggattcctaggtattttattctctttgaagcaattgtgaatgggagttcactcatgatttggctctctgtttgtctgtataagaatccttgtgatttttgcacattgattttgtatcctgagactttgctgaagttgcttatcagcttaaggagatttggggctgagacaatggggttttctagatatacaatcatgtcatctgcaaacagggacaatttgacttcctcttttcctaattgaataccctttatttccttctcctgcctgattgacctggcctgaacttccaacactatgttcaataggagtggtgagagagggcatccctgcctcgtgccagttttcaaagggaatgcttccagtttttgcccattcagtatgatattggctgtgggtttgtcatagatagctcttattattttgagatacctcccatcaatacctaatttattaagattttttagcatgaagagttgttgaattttctcaaaggtcttttctgcatctattgagataatcatgtggtttttgtcattggttctgcttatatgctggattacgtttattgatttgcatacatggaaccagccttgcatcccagggatgaagcccacttgatcatggtggataagctttttcatgtgctgctggattcggtttgccagtattttcttgaggatttttgcatcaatgttcatcagggatattggtctaaaattctcttttttggttgtgtctctgcctgactttggtatcaggatgatgctggcctcataaaataagttagggatgattccctctttttctattgatgggaatagtttcagaaggaatggtaccatttcctccttgtacctctggtagaattcggctgtgaatccatctggtcctggactctttttcgttggtaagctattgattattgccacaatttcagctcctgttattggtctattcagagattcaacttcttcctggtttagtcttgggagagtgtatgtgtcaaggaatttatccatttcttgtagattttctagtttacttgcatagaggtgtttgtagtattctctgatggtagtttgtatttctgtgggatcggtggtgatatcccctttatccttttttattgcatctatttgattcttctctcttttcttctttattagtcttgctagcggtctatcaattttgttgattctttcaaaaaaccagctcctggattcgttaattttttgaagggttttttgtgtctctatctccttcagttctgttctgattttagttatttcttgccttctgctagcttttgaatgtgtttgctcttgcttttctagttcttttaattgtgatgttagggtgtcaattttggatgtttcctgctttctcttgtgggcatttagtgctataaatttccctctacacactgctttgaatgcgtcccagagattctggtatgttgtgtctttgttctcattggtttcaaagaacatcttcatttctgccttcattttgttatgtacccagtagtcattcaggagcaggttgttcagtttccatgtagttgagcggttttgagtgagtttcttaatcctgaattctactttgattgcactgtggtctgagagatagtttgttataatttctgttcttttacatttgctgaggagagctttacttccaagtatgtggtcaattttggaataggtgtggtgtggtgctgaaaagaatgtatattctgttgatttggggtggagagttctgtagatgtctattaggtccgcttggtgcagagctgagttcaattcctgggtattcttgttgactttctgtcttgttgatctgtctaatgttgacagtggggtgttaaagtctcccattattaatgtgtgggagtctaagtctctctgtaggtcactcaggacttgctttatgaatctgggtgctcctgtatggggtgcatatatatttaggatagttagctcttcttgttgaattgatccctttaccattaagtaatggccttctttgtctcttttgatctttgttggcttaaagtctgttttatcagagactaggattgcaacccctgcctttttttgttttccatttgcttggtagatcttcctccatccttttattttgagcctatgtgtgtctctgcccatgagatggctttcctgaatacagcacactgatgggtcttgaatttttatccaatttgccactctgtgtcttttaattggagcatttagtccatttacatttaaagttaatattgttatgtgtgaatttgatcctgtcattatgatgttagctggttattttgctcattagttgatgcagtttcttcctagtctcgatggtctttacattttggcttgattttgtagtggctggtaccggttgttcctttccatgtttagcgcttccttcaggagctcttttagggcaggcctggtggtgacaaaatctctcagcatttgcttgtctgtaatgtattttatttctccttcacttatgaagcttagtttggctggatatgcaattctgggttgaaaattcttttctttaagaatgttgaatattggctcccactctcttctggcttgtagagtttctgccgagagatctgctgttagtctgatgggcttccctttgtgggtaacccgacctttctctctggctgcccttaacattttttccttcatttcagctttggtgaatctgacaattatgtgtcttggtgttgctcttctcgaggagtatctttgtggcattctctgtatttcctgaatctgaatgttggcctgccttgctagattggggaagttctcctggataatatcctgcagagtgttttccaacttggttccattctccccgtcactttcaggtacaccagtcagacgtagatttggtcttttcacatagtgccatatttcttggagactttgctcatttctttttattcttttttctctaaacttcccttctcacttcatttcattcatttcatcttccatcactgataccctttcttgcagttgatcgcatcagctcctgaggcttctgcattcttcacgtagttctcgagccttggctttcagctccatcagctcctttaagcacttctctgtattggtttttctagttatacattcttctaaatgtttttcaaagttttcaacttctttgcctttggtttgaatgtcctcccgtagctcggagtaatttgatcgtctgaagacttcttctctcagcttgtcaaagtcattctccgtccagctttgttccattgctggtgaggaactgcgttcctttggaggaggagaggcgctctgctttttagagtttccagtttttctgctctgcttttccccatctttgtggttttatctacttttggtctttgatgatggtgatatacagatgggtttttggtgtggatgtcctttctgtttgtcagttttccttctaacagacaggaccctcagctgcaggtctgttggagtacctggccgtgtgaggtgtcagtctgcccctgctggggggtgcctcccagttaggctgctcagggggtcaggggtcagggacccacttgaggaggcagtctgcccattctcagatctccagctgtgtgctgggagaaccactgctctcttcaaagctgtcagacagggacatttaagtctgcagaggttactgctgtctttttgtttgtctgtgccctgcccccagaggtggagcctgcagaggcaggcaggcctccttgagctgtggtgggctccacccagttcgagcttcctggctgctttctttacataagcaagcctgggcaatggcgggcgcccctcccccagccttgctgccaccttgcagtttgatctcagactgctgtgctagcaatctgcgagactccatgggcataggaccctccgagccaggtgtgggatataatctcctggtgtgccattttttaagcccatcggaaaagcgcagtattcgggtgggagtgacccaattttccaggtgccgtctgtcacccctttctttgactaggaaagggaactccctgaccccttgcacttcccgagtgaggcaatgcctcaccctgcttcggctcatgcacggtgtatgcacccactgacctgcacccactgtctggcactccctagtgagatgaacctggtacctcagatggaaatgcagaaatcacccatcttctgcatcactcacgctgggagctgtagaccggagctgttcctatttggccatcttggctcctccctccaacactaatttttataataccatatttttactgtaccttttctgtatttacatatacctagatacacaaatgccattgtgtttcggtagcctatagtattccttacactagcatgctgtatgggttcataacacaggagcaatatgctataccatttagcttaggtgtgtagtaggctatactatctgggtttgtgtaagtatattctattatgttcatacaacaaaaatttacctaacaatgcatttcttagaacatatccctgttaagtgatgcatgatcatatgagactaggacatataggtcttccttacattcagaaaaaaggaaatcaatggtgattatcaaaccagactgcacaacagttaatgattaatgaaacaatagtctttacacttagcggaatacaaatttctcttctttgggacattaagcaagtacaacccaattatcatactccttattgtatgaaagagtgtcctcattaatttggctatgaattccctttatgtatgtatggctctgtttctctttttcttcatgccttaatatgattttctacttcataacataggaatcagtatatagtattaactgcctgtatttctttaaatttatatatattttttacaaaattagtgacactgtttacatatcttttaatttttatgtcatgtaaatgttttatctcattatttttcttttatggacactctattctgtttttaagatacacatacatgcctctgtgtgcttctggttcatttttctaactgctacactttgctccacagtggagatccattatggtcttcctaatatctttctcaggaatggacaaccaggttgccatcaaaggtttgccactccgaaatatcaccacatttaacaaccttacacacacacacgcacacacgcacacatatggccacagatgtgcatatggaattacatctagcatagctcagatacttaatttttcaaatgttgaatatatatctgctttgtggagtcctaaaaatctcccatgattattgtgtgggagtctgaccacataatttttgactgaccaggctttccaataattcctatttcattattttattaattgtaacactttttacatagattctattccattatgaagtacacatttagaaattgagcatatattgtgtaaacatccagaatatatgacttaatagtcatattataatgtaaacatgctgtgagagtagcaaagattgcagagcatctgcccaatcccagtattttcccagtggtatacattattggtcatatagaatcaccacacatcgttttgtctccccaaaatctttgaaacagaaaattcctttttgttcgctttttaaaccctctgattctgattctctgtttcctcagcttatcttatctaatgctttcctcttcaaactatgtataagttcccctgtctgagttgtgactccctggtatcctgttgtagaaaacatacattatgcaaggcctacaatcaaactaggcagagaggcgcttttatgaaatccattagcagcttgatatattcttctatggattgtcctttcaaatcagtttagccttggcctgcatggtcctaggatgccaaatgcagatttagatcctgtattaattagctggggctaccataacaaaaatttgtgtttttgcgtagcttaaacaaaagaaatttactttctcacagttgtggatgctgggaagttcaagatcaaaggactagctaattctcttcctggtctgcagtcagccactttctgctgtctttccatagaggtaagagagaaagagagagagagagcaaaagcatgcacaagcaagttctctcgagtatcttcccattagggaacgtatcccattatgaaggccccaccctcatgacatcatctaaagctaatgacttctgaaaagccccatctccatacagaatctcactggaggttagggatcaacatacaaatttgcagcggacacagttttgtccatagcagagcacctgtattctgcacactaaacagagtctttcttcactctactaaatacacgtgttagtacaagggacatttatgatgcgtaaaactgagtctctttatgctaagtgcatgtgttagtacaagggacatttatgatgtgtaaaattttccaacattgtagcctgtcttacatggtttcaattaatatcaaagatcaatttgtaacagattaaagaagaatctttgatgcactcaatatctagttaaaaacagggaacatgacctctgagtagaattgctattgattatctgttgatgctttaaggttttaaatgcaaagtttcacttgttaaagcatcccttaaatttcaaagtgtgcttttctacccttgacttttattttagatatggggggggtaatgtgcaggtttgttacgtgggtatattggactcaggtagtgagcatatacccaagagatgcttttatgacccatgccccactcccttgaccctatagtagtttgccatggctattgttcccatgtttaagtctatgggtgctcaagtttagctcccagttataagtgagaacatgaggtatttagttttctgtttctgcattaattcacttaggattttggactccagttccatctatattcctgcaaaggacatgatttcaatattttttaaggcttacatagtattccatggtgtacagcaccacattttctttatcccatccaacattgatgggaacctacattgattctatgtctttgttattgtgaatactgtggcaatgaacatatgagtgcatgtattgtcttatataatgatctattttcctttggatatatatccagtaatggaattgctgggtcaaatgctaactctgttttaagttctcaattaatctccaatctgctttccacagtggctgaactaatttacattagtacattttaccctattatatttttctctgaagccttgtcagcatctgttacaattcaccttgtaaacagaattaaaaacaaaaaccatatgatcatctcaatagatgcagacaaagccttcaataaaatccaacatcacttcataatataaaaaaccctcaacaaactagacattaaatgaacatacctccaaattaataagagccacgtatgacaaacccacagccaacatcataggcaaaagccaaaagaatttcccttgaaaaccagagcaagacaaggatgcccattctcaccactcccattcaacttagcactggaagtcctgccagatccatcaggcaagagaaagaaataaaagacatccaaataggaaaagaacaagtcaaactatctcttcactgacaatatgattctatgcctagaaaaccctgaagactctgccaagtggctactagaactgacaaacgattttagtgaggcttcagaataccaaatcactgtacaaaaattagtagcatttatatacaccaataatggccaggctgagattcaaagtatgctttctcctttctgagtttcacaagtggttgttgttgccattatctaacctgtctctgtttctcaggtttgggaggaggttaatgttcagatggtgttagctccagctcaccatttctgacacctgtgcagccttttctcccactttcctcatttactgctccttacgtttcttggctgggatttctaccatgaccatcccagcaaataatgtgtgctgagtaagtcaatgctttggatcttgacttttccaatccctgactttggcattgaaattccaccttcatttgaagtcaaaatcctgtttgcattttttgtcagttgcacagtaaacagcatgccaattcagagtcatgtgaatgacactgacatttggcattgtttcttttaatttttttttaagttcaggggtacacgtgcaggtttttcttttcttttcttttcttttcttttctgagacggagtctcgctctgtccccaggctggagtgcagtggcgcgatctggactcaccgcaagcttcgcctcctgggttcacgccattctcctgcctcagcctcccaagtagctgggactacaggcacccgccaccgcgcccggctaattttttgcatttttggcagagatggggtttcaccgtgttagccaggatggtctcgatctcctgaactcgtgatccgcccgcctcggcctcccaaagtactgggattacaggcgtgagccaccgcgcccggccgacgtgcaggtttgtaatataggcaaacccctgtcatgaaggtttgtcgtacagattatttcatcacccaggtattaaacctagtacattatttttcctgattctctccttcctccaatcctttacccttccagcccgagtctgttgctcctctctatgtgttcatgtgttctcatcatttagctcccacttgtaagtgagaacatgtggtatttggttttctattcttgcagtagtttgcgaagggcaatggcctccaattccgttcatgatccttcaaaggacgtgatctccttcttttttatggctgcataatattccataatgtatatgtatcgcattttcttttttaaaaaaatgtgtttcattttaagttctgggatacatgtgtaggacgtgcaggtttgttacacaggtaaacgtgtgccatggatatgtatcacatcttctgtatccattgatgggcatttaggttgatttcatgtctttgctattgtgaatagtgctacagtgaacatcaacattcacgtgtctttatgatagaatgatttacattcctttggatatatttggatacccaataatgggattgctgggttgaatgataatcctgttttaagttctttaagagattgccacgctgtgttccacaatggctaaagtaatttacattcccacaagcagtgaataagcattcccttttcttaacaatcttactagtatctgttatttttttacttttaaatattaataacagccattctgacaggtgtaagatggtatcttattgtggttttgatttgcttttatctagtgattagtgaggttgagcattttttcatgtgcttgttggccacatgtatgtcttcttttgaaaagttcctatttatgtcctttgcccaatttttaatggggttgttttttgcttgttaattttttaagttccttaaagattctggatgttagacctttactggatgcacagtttgcaaatatttctcccattctgtaggttgtatgtatattctggtgatagtttcttttgcagtgcagaagctctttagtttaattaggttccattagtcaatttttgtttttattacaattgcttttggggacttagccataaattctttgccaaaacctctgtcaataaaggtatttcttaggttttcttctagaatttttatagtttgaggtcttacatttaattctttaatctatcttgagttggttttttcatacagtgaaaagttgtggtccagtttcattcttctgcatatagctagctagtaatcttagctacatttattgaatagggagtgctgtctccattgcttatttttgttgattttgtcaaagatcacataattgtaggtgtttgagtttatttctgggttgtttattttgtttcactgatttatgtgtctgtttttataccggtattatgctgttttgattattgtaaccttatagtgtagtttgaagtcaggcaatgtgatgcctccagctttgctctttttgcatagggttgctttggttattcaagttctttttgttctaaatgaatttcagaatagatttttctaattttgtgaaaaatgatgttggtatttttgatagtgatagtattgaatctgtaaaccgttaagggcagtatggccattttaactacattgattcttccaatctgtgaacagagagtatattccacttatttacatcatctctgatttttttcagcagtgttttgtaactctccttgtaaagattgttcacctccttggctaagtaaatcctagatatttcattttctttgtggctattgtaaatgagactgtgttcttgatttgattgtcagtcagaatgttattagtgtatacaaaggctactcatttttatacctttattttgtatcctgaaactttactgaattcatttatcagctccaggagctttttgttaaaatatttagggatttctaggtatagaatcacatcactggaaaagagagctagtttgacttattttcctacttaggtgtctttatttctttctcttgtctgatggctctggctaggacattcagtactaagttgagtagatgtgctgggtgtgggcatccttgtcttgctccagttgttaaggggaatggtttgagttttgcccacttagagtaagtttggctgtgtgtttatcatagatggctcttattattttgaagtatgttgcttcaatccgtagtatgttggttttaatcatagaaggattggattttatgaaaggatttttctgtgtctattgagatgatcatacgggtttttaattccttttgtgtgaattatataattgatttgcatatattgaaccaaatttgcatcccagaaataaagcctacttgatcgtggtgaattagctttttgatgtgctgctggattcagtttgctagtattttattgaagatttttgcatcaaggttcatcaaggatacaggcttgatgttttcttttaccattgttctctgctggattttagtatcaggatgctgctgcctccatagaatgagttagacagaagcctcttcttaatttttttgaaaagtttcagtaggattggtagcaattcttctttgtacatctggtagaatttggctgagaatccatgaggtcccggacacttttttttggtaggattttttattactgatttaatttccaaacttattgctggtttgttaaggttttccctctcttcatgattcagtcttgagaggttgtgtgtttctagtaatttatccatttcctctagattttctaatatgtgtgtacagaggtattcataatagtctctgatgatcttttgtatttctgagggatcagtaatctttccatttctaattacgcttatttggatcttctctctttcttttctttgttaacctgctaatgccctatgaatcttgtttattcttttgaagaaccaactcttggtttcattagtcttttgtatggacttttggggctcaatttctttcagttcttctctaattttagttatttctttttttctactagctttagtatgggagtattctttttctctagttcctctgattgccatgttaggtcattaatttgagatctttttaatctcttaatgaaggtgtttagtgctataaatcttaacactgctttagctgcatcccaaaggttttggaaaattgtgtctctattttcattaatttcaaagcattttttaaatttctgtcttagctttgttgtttacccaagatttattcagaagcaagttgtttaatttccatttttttaatagttttgagatatctttttggtattgatttatatttttagtgcactatcgtccaagagtgtgttttgtatgatttcaactttttaaaatttatggagacttgctttatggttgagcatgtgggcaatcttaaaatatgttctgtgtgcttataagaagaatgtatattctgtgattattgggtggagttctttgcagatgactattaggtgcaatttggtcaagtgtcaagttttagtccagaatttctttgttagttttctgccttgatgacttgtctaacactgtcggtggggtgttgaagtcccctactattattgtgtggctgcctaaatatttttgtagggcaagaaaaacctgtctcatgaatcttgatgctccttttttggatttttataaatttaggatacttaagtcttctttttgcattgaactctttatcattatgtactgcctgccctcctttgtcctttctaattactgttggtttaaaatctgctttatctgatataagaatagagattcttaatcttttttgttttccatttgcctggatctttctccattcctttactttgagcctgtggttatcattacacatgagatgcatctcttgaggacaaatgacagttgtgtcttgtctttttatcccacttgccactctatgccttttaggtggggcatttaaaccattcatatttaaggctagtattgatatatgggattgtgatcctgttatcacattgctggctgtttgctttgtagacttgattgtgtgattgttttatgtagtctgtacactatgttcttgagtgtatttttgaggtagtaagtttcaatcttttgtttccatggttagcaccaccttaaggacatcttgtaagggtggtctactggtaatgaattccctttatgcttgcttgtctgagagggattttgtttctcctttgcttatgaagcttggcttggtagaatatgatattcttggttagaatttcttttctttaaaaatgctgaaaataatccctcaatctcttctggcttgtaagtttttttctgagaggtctgctgctagcctgatgggtttctctttgtaggtgacctgacctttctgtctagctgcctaaatttaagatttttttcttttgcattgacagtgaatctgatgactatgtttcttggagatggtcatcttatgtcatatctccaaagagttctctgtatttcctgaaactgtatgtcctcttctctagcaagagtgaggaaatttatggactatatcatcactatgttttccaagttgcttactctctatcctctttcaggaatgccaatgagttgtagattcgttgtctttacataatctcatatttcttagagattttattcctttttaaaaaatctttttcttcatttttttggtctcactgagatgattcgatgaaccaatcttctaactctgagattctttcttcaacttaatgtattctgctgttgctccctctgtttttattgtaaaattattgaagtgaattcttcaattacagaagttcagtttggttctttcttaaaatggctatttcatctttcagctcctggattattttactatactccctcgattccttggtttaggtttcaactttctgctcaatcccagtgaacttccttgccatccagattttgaattatatgtctgtcatttcagtcatctcaatctggctaagaaccatccctgggagccttgtgtgtttctttggaggtaagggagcacactggctttttgagttgccagagttcttacattgattctgtctcatgtctgagggttggtgtgcctttaattgtgatgtaagttgagtatagtcagttggcttcatttctaggtgttgtcagaaggccaggactctgtgcagaatctttatttgtgactggatctttgcattagttttgcaggtgctatatactggcacaatattttggtgttgtattttggactgcaatccagttggtggcacttaagagtgttgactagcagataagctcttagtcagacagcttttttgtattttggtgcagttggcagtagtgctctgtggtgtgggggacagggataacgccctcacctgatctactcctgggtcttggaggagccctctacattcactggctgcatgtctgcatttcctttgttagacttcctggtccacagggctccctcaggcagaggccatggttggcagagagaccatacccttctgggttttttaaattattattatactttaggttctagggtacatgtgcacaacgtgcagatttgttacatatgtatgtatgtgccatgttggtttgctgcacccatcaagtcgtcatttacattaggtatttctcctgatgctatccctcccccatccctccactgcatgacaggccctagtgtgtgacgttccccgccctgtgtccaagtgttttcattgttcaattcccacctatgagtgagaacatgcagtgtttggttttctgtccttgtgatagtttgctcagaatggtggtttccagctttatccatgtccctacaaagtacatgaactcatcccttttttatggctgcatagtattccatggtgcatatgtgccacattttcttaatccagtctatcactgatggacatttgggtgggttccaagtctttgctattgtgaatagtgccacaataaacatacgtgtgcaaatgtctttatagtagcatgatttataatcctttgggtatatatccagtaatgggatcgctgggagagaccatacctttctcagtccagccctatggagggagtcacacccttctcctcccaagtggctcacctctctcagtgttctgagagtgagggctcctcactgcttgggtcctgcctaagctgatatgtcctgcttggctagagcagtgggagtgggtgtagttgcccaatccactgtccaggtgcttcccataggaacacagagctgcacctactggcagagttcaggcagaggtgggtcctctgtgttggaatccccaactggtgcatcctgcccaggtaggaggagggggggttggcatggtggcccaatccattgtctgggtgcttccctagggaattcagggctgcacttgccagcagagttcaggcagaagaaggtctgctgtgctagaagccccagcaagcatggcctgtctggctgtgagcaagcagtgaagtcacctaccctgcatccagatatttcctgggggaaaacagggctgcaaccgcccacagagttcaggagaagcaggtctgctgtgctggaagtctgtctagttacaagcaagcagaaggagtgggtggagtagcccactctgccagccagatgtttcccaggggaacatggggctgctcctgcctgcagagttcaggcagaagtgaagccactgtgctggaagatgtgcaggggatgatggggcggtcttactgctcctgggcactgcatctgtggtgcctactggggctatggcagtactctactgtttcagggtccaaggctttatagaggtcgctataaacttgagtttgcctctgcaaaacctgtgaacttgagtgttgcctctgcaaaacctctggatgtttctctctaacagtctagaggccttagggggtaggaggattttcccatttcaaagctttcaaaggtccctgtggaaggtgtgaatcttccaggggttctcactcaccctttccccatggtgggaaacttgtcctggctccacaccaatccaagatgggctgctgcccattttctctcttctctattctctgtgtccccttgctaccatgatggatcctgttgtggattcctagtttatagacttgcagggtcagtattcactacgctcttggtctcctctccatgaaagcagcacacactagccacttttagtctgcctcttttgatcccctccctcaacaaataatttttatatacatatgttcaaaatattccatgggatatagtttactaaagaattatttactatttgtttgaattcaaatttaactagacacactctattgttatttgctaaaaccagtaacctcccctgagccaatatgactcctagtctgcattccctgcagtgaaggtatactgcatggaaagtcatcttcatattgacccagtaatggcacaagaggatgtaaatttatatttccaggtataactgaacaagtgctgggcattagatgagagaggaaaggcatcacagtataaaggttatgtgaaaaatgagtaagtgagagttgactggaccttcgtcctcttctttaatcaggtgactggaagcacctgctcaatgtctgctcatcaacaacaaaccagaggagggcttaaaagaactcagaaaagctgcatgctggaatagaatgaagaatgctggagacaccctaaccatggaggtgagcaggatgggagctggatataggatgtgaggaagacataacttgcattcatactatctagtgtccaaggtgcataaagcatgggaacacaggtctgatatggctcttcttatctcacctcattgtcctggttctcaaggggtgttgcaattgtttggcttagtgttgaaagagaatatgttgttactgaaagaaatggacacagatactttacttagtagagacagagggcacttagtattccttctggcttaatattctttgggcttttttccagggcataagccagcagaaggaagggttagtgaccatgcagaatagaacaccaagaggttcacttatttgtttattcactcacacactcattcattcatgtatattttctgagtgcccatgtgtgtcaggttctggtctatccctggaaataccacaacaatcataaaggtcaaaatccctgttgtatggagtgtaaattctattattacaagatttaagggcatgactaagtggaaatacctcagagaaagatttctcttttttttacatacagatagaaaacacagatattccaacttacaagggacgtgaaggacctcttcaaggagaactacaaaccactgctcaatgaaatcaaagaggatataaacaaatggaagaacattccatgctcatgggtaggaaaaatcaatatcatgaaaatggccatactgcccaaggtaatttatagattcaatgccatccccatcaagctaccaatgactttcttcatacaattggaaaaaactacttcaaagttcacatggcaccaaaaaagggcccgcatcaccaagtcaatcctaaggcaaaagaacaaagctgggggcatcacgctacctgacttcaaactatactacaaggctacagtaaccaaaacagcatggtactggtatcaaaacagagatatagctgaatggaacagaacagagccctcagaaataatgccacatacctacaactatctgatctttgaaaaacctgataaaaacaagcaatggggaaaggattccctatttaataaatggtgctaggaaaactggctagccatatgtagaaagctgaaactggatcccttcctcacaccttatacaaaaattaattcaagatggattaaagacttaaataaactggattaagaaaatgtggcacatatacaccatggaatactatgcagccataaaaaatgatgagttcatgtcctttgtagggacatggatgaaattggaaatcatcattctcagtaaactatcacaagaacagaaaaccaaacaccgcatattctcactcataggtgggaattgaacaatgagaacacatggacacaggaaggggaacatcacactctggggactgttgtggggtggtgggaggggggagggatagcattaggagatatacctaatgctagatgacgagttagtgggtgcagtgcaccagcatggcacatgtatacatatgtaactaacgtgtacattgtgcacatgtaccctaaaacttaaagtataataataataaattaaaataaaaaaagattaagggatttggtgaagtaaatggaaaaaaaaagagaaaacacagatattgctgtggatcataaagtaaaccatttatcatattatgcacatattaaactgtgttgaaaaattatagtaggctaggcatgaagcttgatcatgaataacagtataaatcagggtcccaggttttaaggagcttttatcttaataagagaaagtaaaagtaatagcttctttaaatgttttattctgatctaaatcagttaaaatgacacctgctctcttaacaaatgtttaagtgcacaatacaatattgttaactataagtacaaggttgtacagaaggtctctacaatttttatcctgtatcactgaaactctatacccattgaacagcaatttcccatttccccctacctccagcttctgaaaaccaccattagggatattggtctaaaattctctttttttgttgtgtctctgccaggctttggtatcaggatgatgctggcctcataaaatgagttagggagaattccctctttttctattcattggaatagtttcagaaggaatggtaccagctcctccttgtacctctggtagaattcagctgtgaatccatctggtcctggactttttttggttggtaagctgttaattatagcctcaatttcagagcctgtgtttcgtctattcagagattcaacttcttcctggtttagtctggggagggtgtatgtgtcgaggaatttatccatttcttctagattttctagtttatttgtgtacaggtgtttatagtattctctgatggtagtttgtatttctgtgggattggtggtgatatcccctttatcattctttattgtgtctatttgattcttctcttttttcttctttattagtcttgctagtggtctatcaattttgttgatcttttcaaaaaaccagctcctggattcattgatttttttgaagggttttttgtgtctctatctccttcagttctgctctgatcttagttatttcttgccttctgctagcttttgaatgtgtttgctcttgcttttctagttcttttaattgtgaagttagggtataaattttagatctttcctgctttctcttgtgggcatttagtgctataaatttccctctacacactgctttcaatgtgtcccacagattctggtatgttgtgtctttgttcttgttggtttcaaagaccatctttatttctgccttcattttgttatgtacccagtagttattcaggagcaggttgttccgtttccatgtagttgagtggttttgagtgagtttcttaatcctgagttctagtttgattgaactgtggcctgagagacagtttgttataatttctgttcttttacatttgctgaggagtgctttacttccaactatgtggtcaattttggaataagtgcggtgtgctgctgagaagaatgtatattctgttgatttggggtggagagttctgtagatgtctattaggtccacttggtgcagagctgagttcaattcctggatatccttgttaactttctgtctcattgatgtgtctagtgttgacagtggggtgttaaagtctcccattattattgtgtgggagtctaagtctctttctaggtctgtaaggacttgctttatgaatctgggtcctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcatgtgagatgggtttcctgaatacagcacgctgatgggtcttgactctcttgcaaaaatcctcaataaaatactggcaaaccgaatccagcagcacatcaaaaagcttgtccaccatgatcaagtgggcttcatccctgggatgcaaggctggttcaacatacgcaaatcaataaacataatccagcatataaacagaaccaaagacaaaaaccacatgattatctcaatagatgcagaaaaggcatttgacaaaattcaacagccctacatgctaaaaactctcaataaattacgtgttgatgggacatgtctcaaaataataagagctatctgtgacagacccacagccaatatcatactgaatgggcaaaaactggaagcattctctttgaaaactgacacacgacagggatgccctctctcaccactcctattcaacatagtgttggaagttctggccagggcaatcaggcaggagaaggaaataaagggtattcaattaggaaaagaggaagtcaaattgccctgtttgcagatgacatgattttatatctagaaaaccccatcacctcagcccaaaatcttctgaagctgataagcaacttcagcaaagtctcaggatacaaaatcaatgtgcaaaaatcacaaggattcttatacaccaataacagacaaacagagagccaaatcatgagtgaacccccattcacaattgcttcaaagagaataaaatactaggaatccaacttacaagggatgtggaggacctcttcaaggagaactacaaaccactgctcaatgaaatcaaagaggatacaaagaaatggaagaacattccatgctcatgggtaggaaaaatcaacatcgtgaaaatggccatactgcccaaggtaatttacagattccatgccatccccatcaggctaccaatgcctttcttcacacaattggaaaaaactactttaaagttcatatggaaccaaaaaggagcccgcattgccaagtcaatcctaagccaaaagaacaaagctggaggcaacacgttacctgacttcaaactatactacaaggctacagtaaccaaaacagcatggtactggtaccaaaacagagatatagaccaatggaacagaacagagccctcagaaataatgccacatatctacaactatccgatctttgacaaacctgacaaaaacaagaaatggggaaaggattccctatttaataaacggtgctaggaaaactggctagccatatgtagaaagctgaaactggatcccttccttacaccttatacaaaaatcaattcaagatggattaaagacttacatgtcagacctaaaaccttaaaaaccctagaagaaaacctaggcaataccattcaggacatacgcatgggcaaggacttcatgtctaaaacaccaaaagcaatggcaacaaaagccaaaattgacaaatgggatctaattaaactaaagagcttctgcacagcaaaagaaattaccatcagagtgaacaggcaacctacagaatgggagaaaattttcacaacctactcatctgacaaagggttaatatccagaatctacaatgaactcaaacaaatttacaagaaaaaaacaaataaccccatcaacaagtgggtgaaggatatgaacagacacttctcaaaagaagacatttatgcagccaaaagacacatgaaaaaaatgctcatcatcactggccgtcagagaaatgcaaatcaaaaccacagtgagataccatctcacaccagttagaatggccatcattaagaagtcaggaaacaataggtgctggagaggatgtggagaaataggaacacttttacactgttggtgggactgtaaactagttcaaccactgtggaagtcagtgtggtgattcctcagggatctagaactagaaataccatttgtcccagccatcccattactgaatatatacccaaaggattataaatcatgttgctataaaaacacatgcacatgtatgcttattgcagcactatttacaatagcaaagacttggaaccaacccaaatgtccaacaatgatagactggattaagaaaatgtggcacatatacaccatggaatactatgcagccataaaaaaggatgagttcgtgtcatttgtagggacatggatgaagctggaaaccattattctcagcaaactattgcaaggacaaaaaaccaaacaccgcatgttctcactcataggttggaattgaacaatgagaacacatggacacaggaaggggaacatcacacaccggggccagttgtggggtggggagacaggggagggatagcattaggagatatacctaatgttaaatgacgaattaatgggtgcagcacaccaacatggcacatgtatacatatgtaactaatctgcacgttgtgcacatgtaccctaaaacttaaagtataattttaaaaaaaagaaaatgtggcacatatataccatggaatactatgcagccataaaaaatgatgagttcacatcctttgtagggacatggatgaagctggaaaccatcattctcagcaacctatcgcaaggacaaaaaaccaaacaccacatgttctcactcataggtgggaattgaacaatgagaacacatggacacaggaaggggaacatcacacaccagggactgttgttaggtgggggtaggggggagggatagcattaggagatatacctaatgctaaatgatgagttaatgggtgcagcacaccaatatggcacatgtatacatatgtaacaaacctgcacgttgtgtacatgtaccctaaaacttgaagtataatttaaaaaaaagaaaaagaaacattatgttaaatgaattaagccagatatacaaagtcaagtattttatgattcaatgtataaatcaaatgtccacaataggcaaatccttagaatcagaaagtaaattagcggttgctaagtgggatgtgtgaataaaaatggagagttactgctaatgggtatggtttcctatgtggtgattaaaatgctctgtaacgatatagtagtgatgattgcacaactctttgaatgatcaaaacacattcaattgtatactttaaaagggtaaattgtatggtaaatgaattatacttcaaggaggtttaaattttaatagaaattttagtcctaatcaaggtgacattttctcccatattttgcctccaattcttccacagcacatagtgcatctcacataatatttataatgttggagtgcaattgtttatgtactctctcttacttactcaactataagatccttgaacttgtcacacacgttactttaggaactagcatggaaaaggtcttcacaaatactatctgaaaaatcaataagccagtaaaagtaaacctccatatgagcttactcctctgcttttcatcaccatctattctgtccacatttcaagcaatgtatttccagcatgaatttgtggtgtgatttgacatgaaggagaacatcagtcaccaaaatgaaaggattgtaccacagtacccttattttagtttaacttcgacttttttagattaactcttaatcaaaaattggtacttaacaaggaaaaacttgccttctgttgttttcagagaagtaaaaaaagcacctcacctttgagtcgccaaaattatgcttcctggaatgaccgcataccatgtagcaggtttattttagtttgtttacagaaaagtgtagaccaaagtccagtgctgactttgggagctactaaagacatgaaaaagtagaattttaaacacatttcattgtaaacgactgggagtatctgagcaaattatttcttacgtgactttagagaaaacggctacctatctgaccccaaaacgacttgaggaaactgtttccacggtcctgctgcagaggggaagcacagtcgtcaagaagagagtggggtcaggatcaaaacacatttagtgtgacttagggaaagaaaacattttccctctttgaacctctctggatacagtcattttgcctctacttgaggatcaactgttcaacctcaatggcctttcaggacctcctgggtcacgctggtgacctgtggagattccagatccttcagactgtttttctctcaatctttgctgttgctacataccttcattttatgctggagaacttcactgcattcatacctggccatcgctgctgggtccacatcctggacaatgacactgtctctgacaatgacactggggccctcagccaagatgcactcttgagaatctccatcccactggactcaaacatgaggccagagaagtgtcgtcgctttgttcatcctcagtggcagctccttcacctgaatgggaccttccccaacacaagtgacgcagacatggagccctgtgtggatggctgggtgtatgacagaatctccttctcatccaccatcgtgactgaggtaagaggctctgttctcgtctcatgagtatgtgacctgggtgtttagaataacacaagtaataatcatgcttccagccttcagtcacatgtaggtccttagtcttcattctttcagcaaatactaattgcttctttattaaatgtctgacacctacacattttgagtaatgaattccaaagtagaaggcatcctgctattataatgctttaagtcacagggagaccaaagtttaaacaagcatttatatataatatgttaaaatgttctgctaggtcagtgatgctcagcctgtcattgcaaattagaaatatctgggaaattgagaaaagcctccatgcccagagtataccctaaaacaatcatatgagaaggtctaagagggaaatttaggtttctaaaagtttttaaaggtcttcaagtgattgcaccatgtggtcatgtttgagaaccatttagtatgaaataaaaacctataggtttaggaaagtcttccaagagaaagttatgtttaagttgagacctgaataacaaaggtcaggtaatgctgagaaaggaagccacagaggaagttagagacttaatattaggaaacttgcagatcatgctaagaagttttgatcaagttacactgaggggtaataagcattgatgtgctggcttccttctcttccagtgggatctggtatgtgactctcaatcactgacttcagtggctaaatttgtattcatggctggaatgatggtgggaggcatcctaggcggtcatttatcagacaggtgagtgtgtatggaacacagctctctttaagggcattttttatcaacttatgaaacattatttcatctagaattacttactgcaaattacattctcctgaggctgccctgatccccaaacagaaaaggaaatttttagtccgtgttttgagtgctatttttaaaatttgagctctgtatgcaggacacagaaatgatatctccatgtgaactgggggtgtttcaagacaggttttagagagaaggtaccacaacatgtggtttagaaatatgagaaagagttaactaagggaatagaaaggaagacgtttcatcacataggattcagccttggccaggagtaccaggtccagtcctacctggacactgtgagctgatagcttgtgcccagagaattgtcattacatcatagttccaagtgtgatgaacacgcattcctctaaaacctgtagggtatatttgaaggtatcattggtggtgtgttgaaaaattatgtgtagaaacttgattattgtctttgcaaaaacagctttttagaaccatgtgaggtaagtaatccaaggataatactatctcagtctgtggtgtgagaagtttggggtattcaccttgctgtatgtctcctgacatggcagggaacaattaccttcacccaaccatgtctcccctgatggcgatgagggacttgaagtgccacttgccatccaccaacatcatgtcttctggtgtctcacctgaaaatttgaaccttgaatgtacgacaggaaatggaatgtagaatgagctaagagtcagagggttaatttccaatagttagtcacccagtcctctgtgatactgtcctgggaaaatgcagatagaccaattttaatagatcacagggtggtaaaagaaggggtaggagatgccaggcaggagatgacagtggagaatcagctaaagacgaagggacaagataacctaaggattttggtatttctcacaaacctaagaggaaatattatgtgattatatgcagagtaggctatgatcaaactgattgttttggaataactcactcaactgtttatgatatcttaaaatcggaaataatctataatttcattaataataggttaataaataagcagatattcacataatgaatttttacagcaaagggaatgaataaagtactgtctgcaataaggtgaattaacatcaaaaccatttggttaggtaccacaagaccaacaaaaagattacatactatagtgttccaccaatgtaaaagtcaaaaacaaggaactacattatgatgtgagaaaagggagaaatctaatttcctttagatttctattggaattgcattaaatctaaacagcagtttgggtaagactgacattttttaaatactgaattttctgatctataaatataatattgcttttaattaaggtagacttttgtttaatttccctttgcaatattttatagtttatgataaaagtcatgtactttttattaatttatttctaattcatatgtaaagataatttacatgtaaattatgtacatatatgtaaagataattaactttttcatagtaaacttacatcctgccaacaggataaatttattagttctagtagctatttatggattccttaaaatttcccaacttgatcatatcatctgcaaggtggaatagttcaaatcactaatgttctactttttccttttaatctctttctagcagtagctaaaacctttgatacaatgccaatgacattggtgagagctgaaatcctgcctcaccacaggctatattgttccagttgtctacagagaggactcctttcccagaaaacagtaaaacactaaattccctttttcttttttttcctttttttttttctttttttttttgccctcccctgcaacacttcaacaactttgatgtattgttctatggatgttcctttcacatcagtatacccatagcctgcactgtcctagacttctacatctagatttagatgtcttataggctatgccctgctcaggctctctactatgctaaagtacatgggagacacattgtgttattagtacgctgtgtgttagtacaagggacttctgatactttaaaatgtccaatattccaccctgtcttatgtggtttcaattggtgtcaaaaatatactgctaagagattggaaaataagctttgatctacttggtatttatttagaaacagggaacattgtgtctgagatctgccattgattactgattctttaaggcttcaaatgcaaagtttcacttgttaaacatcttttaagtttcaaagtgtgccttctctttgctaagtttttccacttgttgttattgttcccattatctaacctgtttctgtttctcaggtttgggagaaggttcgtgctcagatggtgttacctccaggttgccattgttggcacctgtgcagccttggctcccaccttcctcatttactgctcactacgcttcttgtctgggattgctgcaatgagcctcataacaaatactattatgttaagtaagccaacactttggatccacattttccaaactgtgactttgaaattgaaactccacctttgaagtcaaagccttatctgttttttcttccagtagccgagtgggcaacacacagattccaggccatgggaattacattgggaatgtgcccttctggtattgcatttatgaccctggcaggcctggcttttgccattcgagactggcatatcctccagctggtggtgtctgtaccatactttgtgatctttctgacctcaaggtatgagtttgtttcttcttttgtcttaatgagatattggaatgagaatgtatgtggaactaggacacctgaatttctttttgttctttgtgtaaacctgagagcacgtcctctcataatctgtgcttgatgtgcaatacaagaagcagaacacatagagtttcctgataaaactgagggcaatcaatgaaatttcaacataaggtaaccaacaaatatttctctaaaattatatctcaaatattgtaagagacataatttactcaagatcatttattgtttatatgaaatttcattcacctgagagttcttttatttaaatgaataaaacataggaagtcccattaaattcaaatttcagataagggatgaataatttttaatataattatgtccaaaatattgcatgagacatgcttatactaaaacattttcctgcttaatagaaattcaaatgcatccatgccactgtgttttcatttgctaaaaccagcaacccatgacatggggaatagcaatgaatcattgcctgagacttcttagtgtccttggatatcctcgccttaacaagtattatggaaacagaattattacaaaaatgttttccccaatacaggaaaacatttgaggagctatcttccatggtagtctatgtttttatatatatccttggaaaaaaatacatgatggagaagtttgggattttttttcttaattattataggtgatattggatgaaaagaaggtgtagcaaatttactttcataactatctaaagaaagagctgcatggtttcttcaattaaaatattaaggcaaaatggataatttacctcatttgtcagtattccatcttccttctatcagctttgcaaatacttatagtcggttaactatactctccccttaaaaaagccagttcagtgaaagacatctatttggactttaccttagagagatgattacagatttaatacagagagaagagttcagatagaaaagtaagcaaactccctgtcaggctcatccattcatttatcttatctccataacagccctacaaggtaatattctctccattacatagatgagaacactgaggaatatttaggtaagtaacttgttaatatgtccagtttattcacagatgatatgaccaggagtgattctagttgtatgaggccttaagcatgcataaattatttgagggactttattttagggaaaagaacacattaagaatagacataagtcatgacctcactaggaccttggcagggatctatctgtacaagtgacggtccttcatgctgcagtgtcaggagctccaaggtaaatttgccaagtaagagaggagccagtatgattccaagtctgcattcccaacagtgaatatgtactggatggaggagtcatctcacatttttctagttatagtcaaagagaatgtgagtttacatttcctggtaaaaccaaacaagtggtggatattagcttggagggagaagacatcttaagaaaaaactaatgtaagaaatgaggaagtgaaagtcgactgcccctctgttctcttccttggtcagttggctgctagagtctgctcggtggctcattatcaacaataaaccagaggaaggcttaaaggaacttagaaaagctgcacacaggagtggaatgaagaatgccagagacaccctaaccctggaggtgagctggatgggagctagatatgggatgtagggaagacataacttgtcatcaatacttagcagtagcagtgtccataaggtaaaaaaaggaaagaaacacaggtatggttatgggctgtatcacctcactatcatttttaatgggcttcaatattgtttgggttaacattgaaggggaatatgctgttgccaaaaggatgagacacagatattttactcaatggaggcagaggcacaaagtattaactattgtaaagattttgcattgaactcattctaactgtgtaataggagtaaccaaaactagttcattccttcccatttattattctgtgggtctctttcagggtagtaaagccagaggaagggttagtgagcaaatagaatacaacataaagagttcacttatttgttcattcaatcatacattcttccatttatgatacatttagtgaggcactacctatgccagattccattcttccctggaaatactgcagtgcccatatcaatccaaatccctatttgtctggagtttcattatacttacttactataagttcctaaagcatgactaagtggaaatgcctgtgagaagtctttctcattttaatccaccccagatcttaaagataaatgttgtcatggatctttaagttaaatattatccatgttatacacatatataaagtattaatcttaaaatgtggtatgcacaaatgatactagatcatgaataacagaataagtcaaggtaactacctgaatgaagcttttgctatgacagagaatatcaatggacagatttaaatccaaatattggaaatgatatgggaaaggaaagaatgctacttggaacaataaaaatacattttctcccattttattgaaaaaggagaggattaagagcaagcctcttaatatccttacatattaatattaaccttaaatgtaaaacatcacacttaaaagacacagagtgacaagttggattaaaaaaaaaaatacacccaattgtatactgacttccagagacactcacatgcagtgacacctataggctcaaagtgaaaggataaagaaaaatctaacaagcaaatggaaaacaaaaaaagagcaagggatgcaattctaatttcagataaaacagatgttaaaccaacagtgatcaaaaaaggcaaaaggagaattacataatgatccagggttcaattcaataagatttaactatcttaaatatatatgcacccaacactggagcacgaagattcatacaacgagttcttagaaatctacaaagagacttagataaatcatacaatgatagttggagaattcaacaccccactggcagtgttagacagattatagacacagaaaactaacaaagatgttcaggaactaaactcaacacttgaccaaatggacctaacagatatctaaggaacactccacccaacaacagcagaatatacgttattctcctctgcacatgacacatgctctcaaattgaccacacatcagccataaaacaatcctcagcaaattcaaaaagaaagaaagaaagaaagtaaaccaaccacactcctggaccacaacacaataaaagagagatcaatatgaagaagatctcccaaaatcataaaattacatggaaattaaacaaccttctcttgaatgacttccggataaataaagaaattaaggcagaaatcaagaaaacctttcaaactagtgaaaacaaagatataacataccagaatctctgggacacagctaaacacatgttaagaaggaaacttatagcactaaatccccacatcacaaagtttgagagatctcaaattaacaacctaacctcaaacctattggaactagaaaaagaagagcaaacaaaacccaaagctagcagaaaagaagaagtaaccaattcaaagctgaactgagtgaaattgagatgtaaaaaagatacatatcaacaaaaccaaagattggtaatttgaaagaacacattagatggatagactttcttaaactaataaagaaaaaaagagagcggattcaaataaatgcaattagaaatgacaaaggtgacattaccaccaacaacacagaaatacaaaaaacactcagagactattacaaacgcctctatgcgcagaaactagaaaacctggaagaaatagataattcttgtaaacattcaaactcccaatattgaatcagaaataaattgaaaccctgtataaaccaataacaagtttccaaactgaatcagtaataaaaagccagtcaactagaaaaatccctgggccacatggattcacagctaaattctaccagacatgtaaagaagagcttgtaccaatcctactgaaattattccagaaaattgaggcagggagactcctaactcattctacaagactagattcattctaataccaaaacctggcagagaaaaaaattttaaaaaaagaaaaaccagactaaaaacaaaaaacacattatcaacccaatagacagagaaaaggcttttaataaaattcaacatcgttcatattacaaaccctcaacaaactaggcatcgaaggagcatacctcaaaataatgagagctatctattgacaaacccaagccaagatcatactgaatacacaaaacctggaagcagtccccttgagaaccaggcaagacaaggatgtccacactcaccaattctattaagcatagtactcaaagtcctagccagagtaattagacaaaagaaagaaaaggccacaaaataggaagagaggaagtcaaaatatctctcttcacatacaatatgatcttatacatacaaatccctgtagttgtagcccaaaagctccttgatctggtaaacaattttagcaaagtttcaggatacaaaatcaatgtacaaaaatcagtagcatttctatacgctgacatcgttaaagctgagagccaaatcaagaatgtaatctcattcgcaataaacacaaaataataaaatacctaagaatatagctagctagggaggcaagagttctacaatgagaactacaaagcaatgatgaaagaaagcagagatgaccacaaacaaatgcaaaaacattccatgctcatggatatgaagaatcaatattgtttaaatggccatacacccaaagcaatttacagactgaatcctgttcctatcaaactaccaaagacattttttatagaattagagaaaactattctaaaattcatatggaacaaaaaaaaagagtttgaataaccaaagcaatccaaagcaaaatgaacaaagctgtaggcatcacactatctgactttgaaccatactacgagaacacagtaaccaaaacagcatggtactggtacaaagacagaaaggtagaccaatagaataggctagagcactgagaaataatgccatacctctacaaccatctgttcatcaatgaagtcgacaaaaacaagcaatggggaaaggattccctattcagtcaatggtgtgataactgactatccatatgcagaagattgaaactgaaccccttcctttcaccatatacaaaactcaagtcaagataaagacttaagtttaagacctaaaactataaaaatcctagaagaaaacatagaagataccattctggacaaaggccctgacaaaggtctcatgacaaagactccaaaagcaattgccacaaaaacaaaagttgacaaatgggaccaaataaactaaagagcttttccacaaaagttttcaacagagtaaataaagaagagtgtaaacagaaaacctatagaatgggagaaaatatttgcaaactgttcatccaacaaaggcctaatattcacaatctataaggcacatgaacaaattaaaaaagaacagacagcccataaaaaatggccaaagcacatgaacaaacagttgtttttgttttgttttgttttgtttttgagatggagtctcactctgtcacccaggctggagtgcagtggcatgatcttggctcactgcagcctccacctccagggttcaagcgattctcctgcctcagccttctgaagagctgggattacaggcttgagacatcatacctgactaatttttgtatttttagtacagatggggtttcaccatgttggccaggctggtctcaaactcctgacctcaagtgatccacctgccttggcctcccaaagtgctgggattacaagcgtaagccatcgtgcccggccaaacaaacacttctcaaaaaaagacatacacacagccaacaagcatatgaaaaaaatgctcaacatcactaatcattagataaatcaaatcaaaaccacgataagataccatctcacacctgtcagaatagcaattatttaaaagtcaaaaaataacagatgctggtgagactgcagaaaaaagggaacacttaaaaacttttgatggaaatgtaaattagttcagacactgtggaaagcagtgtggagatttctcaaataactgaaaataaaattaccattcgacccagcaatctactactgggtgtatacccctcaaaatgcaaatttttctgtcataaaggcacatgcatatgtaggttcatcacagcatttttcataataacaaagacatggaatcaacctaaatgcccatcaacagtggactggataaaggaaatgtaatgcatatacaccatggaatactaagcagccaaaaaaagaggtcatgtcctttgcagcaacatggatagagatggagttcattatcctaagccaattaatgcaggaaaagaaaactaaataccacatgttctcacttatatataggagctaaacattggtccaaatggagatttgtatacatacacacaaacaagagaacaatagacaccagagcctacttgggggtggaagatgtaaggaggtaagaaggtgaggatcaaaaaaactacttattgggtactgtgcttattaacttggtgatgaaatcatctacacaccaaacccccatgaaacacaatttatccatgtaacaaacctgcacatgtgccccgagcctaaaagttggaaagtaaaaaacaaaaaacaaataaaagagcattggaatcaaaaaagaatgatgcattattaaactaaatggcaactgatgatcccatcagtttcccagggaaaaaaagagagcattgcttatgaaatgcaattgaagcttggtatggaaaatggattttatacatgactggatacctaatgttgcctaaatttgaatttattattttataatgattattcataaaggtctggtcttagtcctgttttaacctccatctcacaggtttcctaatgtacctgttctagacaaccctctaacctaaagctgctccacattatgtcaatatcaatccattaattactccagtcttatgggtctgggagtccagtaaataacatacatctcctctgcccagatcacatataacccagagatatttaaagtggttaggaccatgaagataaaaaattttaggtgttttactactgtgaggactggaatagaggatgtgactttcaatacctaccatcaacattatttctaatgcttcattccataactgaacttacctgtcccagtttttttaacaggtacaaaacctaacctggtaaatatagggtgcagcccagaaagcaggcctgaatatgatctctttctaaaagtgttctgggcacttgagaatgcctatggcattctcccacactcaccaatcaagtaactcagttctttatgggtagctgagggtatgtacagaagggccaggattgtctcttttgagagttattcctcatggaagcatgagattagggagaaagcagcccctccttccccaaccttcagtatttctgagccaagaaccaaaatgagttctctcaggaaattttgctcctttctgaggcaagctgtttttcaccaggggcagtgagctgagaaccaatgtccacgtcctttggggaccatgtggtccaaatggagctttggactataatccaatatggccttcatttggactgtaatctttattcggtccccatcatggtctgattctctaacatacatacccttttcaatgctctgtagccacttggatctcttgtctaaaatatccttgaaacataatttcctggaggctgctttaacgtcctaattcacttttcacatcatttttacacatatcattgcattttaaggcttatattttccaccagacagaaagtgcagtcaactcacttctcatctgtgggttgaccagtgcgcctacagtgcctactcttttctgacaactgtacagtttattgtttctgctattgttgaagattttgaaatccaccatgaaaaaagaactggaggcagcacaaaaaaaaaaaccttctctgtgtgaaatgctccacatgcccaacatatgtaaaaggatctccctcctgtcctttacgaggtaagcttcatgcagtgtttgagggtaagttacagtactggagacatgaatcttgtcctcatttcaagtagtacagcatgtttaggaaacagatttgcacataaaagatgagaaagccgtaaagagaattgctgtgtttgaatgtagtaaaagagttgtgaaaagactgacacggaattaatttatgcaatagtttttgtttatcgcaacaccctatcaggctcttcactggacaccaacgcagagaacttcaattacagtatatgctttggcttgaagtttcttaacgtgtttgtttccagttttaatgaggtaaattacaaagagaattttgtacacaaatatatacagctcaatgattatttccatattttgatatgtaatttagatcaaggtacataaaaacctctaaaatactaggacatgatcgcaagcatagaaaaaacataaataggaagtcctacctattaatccccccacagaaacattgatttaacaatgattggatccaaatacctctatgagatttccaaaatagaggtaagatgttgtaaaacaatagatgagcacaaacccaagaacagttgcactgaaatgggtaagaagagtaatttcacctgacccatgacaaccccttcccaaagttgtttcagctcagtgccaagagagaacaccctggcctatgaccgctccctcatagaaaaggaaggagtggagcaatacacatctgggccttttgacacactgtgtgaggaactggtatttgtctcacctcactcagagcacttatggaacttgcatatttggatgtttgggtcactgaatagaaggtgagcacaaagaaaatctgtgactggtacagctcagtgcaataaaaataagatgggcaattttaggtttctccctcaggagggagggaagggagtgcagtatgtgtccaacattctaatttttcagggagatgcccaagaaatgtgtttttgtctttcccacccgggatgccaatgggactccagatactctggatatcttaagaataaaacatgataaaaaaaatctgactgtcatcctgctgcatcagagaactcatagtacagcagacagacaccacgggcagccagattacaagatattttaaaacagaaaccagtagatctctctgatcagaaatatgcacacacaaatacagataagacactttacagagaatgtttgacaagcccctagaatctctatttgggttgattggtgaaggtctttccctataaaagctagtctgggaagataggaagagggagctgtttcttcaaatgtgcatacaccaatgcaaagcttcaaagaacatgaagaaacagagaaacatgactcaaaagggaacaaaaaaatccccagaaactgaccataaagagaggtatatgaataaagtgataacaaattagaaacagctaccataacaatgcacacataagtcaagataaaaatggatgaacaggtcgggcgcagtggctctcacctgtaatcccagcactttgagaggctgaggcaggtagatcacgaggtcaagagatagagatcattctggccaacatagtgaaaccctgtctctactaaaaatacaaaaattagttgggcgtggtggtgcacgcctgtagtcccagctacttgggaggctgaggtaggagaatcacttcaacccgggaggtggagattgcagtgagctgagatcgtgccactgcactccagcctggtgacagagcgagactccatctaagaaaaaaaaaaaaaaagaggaacaaagtgagaaattcaacaaagaaatattgtaaatatttcaaatgaccaaaataaatcagggagtagatgaagacaatgactgtgctggggtgcatgtacaggatgtgcaggtttgttacataggtaaacatgttccatggtgatttgctgcacctatcaactcatcacctaggtattaagcccagtatgcattagctatttttcttaatgttctctcttcctgcacccaacccccaacaggtcccagtgtgtgttgtttctctccctgtgtctatgtgttctcattgttcagctcccacttataagtgagaacatgcagtgtttggttttctgttcctgcattagtttgctgaggataatggcttccagcttcatccatgtccctgcagaggacatgatcgcattttttttatggctgcatagtagttcgtggtgtacatgtaccacattttctttatccagtctatcattgatgggcatttgggttgattccatgtctttgctgttatgaatagtgctgcaatgaatgtacgtgtgcaagtatctttgtaatagaatgatgtatattcctttgcgtatatactcagtaatggaattgctgggtcaaatggtatttccgttctagatctttgagaaatcaccacaccatcttccacagtagtcagactgatttaccttcccaccaacagtgtaaaagcattactgtttctcctcaaccttgccagcatgttatttcttgactttttaatatttgccattctgattggtgtgagacggtatgttattgtggttttgatttgcatttctctagtgatcagtgatgttgagctttttttcatatgtttgttagccacatgaacgtatgcttttgagaagtgtctcttcatgtcctttgcccacttttcaatggagtttttttgttttttccttgtaaatttaagttccttatagactggatattacatctttgtcagatggataggatgcaaaaatttttcccactctgtagcttgcctgttcactctgatgatacagtttttttttttttttttttttgctgtgcagaagctctttagtttaattagatcctatggccaattttttttttgttgcagttgcttttggtgatttcatcatgaaatctttgcccatccctatgtcctgaatactgttgcctagatttaggattgtcccagctatatgagctcttttttcattccatataaattttaaaacagatttttctaattctttgaagaatgtcaatggtagtttaatggaaatagtattgaatctataaattgctttgggcagtatggccattttcacgatattgattcttcctatccatgaagatggaatgtttttccatctgcttgtgtcctttctgatttccttgagcagtggtttgtagttcaccttgaagaggtccttcattttccttgttagctgtattcctaggtattttattctctttgcagcaattgtgaatgggagtttattcatgatttggctatctgcttgtctgttgttggtgtatagaaatgcttgtgatttctgcatattgattttgtatcctgagactttgctgaagttgcttatcagcttaagaagcttttgggatgagtcaatagggctttctagatataagatcatgtcatctgcaaatgaagacaacttgacttcctctcttccgattcaaataccctttatttctttctctttcctgatcgccctggccagaacttccaatgctatgttgaataggaatggtgaaagagggcatctttgtcttgtgccagttttcaaggggaatgcttccagcttttgcccattcagaatgatattgtctgtgggtctgtcataaatggctcttataattttaaggtatgttccttcaagacctagtttattgagagttttaacatgaaggatgttgaattttattgaaggccttttctgtgtctattgagataatcatgtggtttttgtctttagttctgtttatgtgataaattacatttactgatttgcttatgttgaacaagctttgcatctagggatgaagccgacttcatcggggttaataagcttttttgtgtgctgctggattcagtttgccagtattttgttgagtatttttgcaccaatgttcatcaaggatataggcctgaagtattcttttattgttgtattcctgccaggtttttatccctaccaggttagcatgatgctggcctcatacaataaattagggaggagtccttccttttcaattgtttggaatagtttcagaagaaatggtaccagctcccctttgtacctctggtagaattcagctataaatccacgtggacctggacttttttttttttttttttttttttttttttttttggtaagtaggctattaattactgcctcagtttagaacgtattggtctattcagggattcaacttcttcctggttcagtcttaggagggtgtatgtgtccaggaatttatctatttcttctaaattttctagtttatttacatagaggtgtttattgtatcctctgatggtagtttgtatttctatggggccagtggtgatatccactttgccattttttattgtgtctatttgagtcttgtctcttttcttctttattagtctagctagcagtctatatattttattaattttttcaaaaatctagcctctagattcatcagttttttgaagggttttgtgttgttgttgttgatgattttgtttttttgttttgttttgttttttgttttgttttgttttttgttttttgtatcgctgtctccttcagttgcactctgatcttggttatatcttgtcttctgctagctttggggtttgtttgctcttggttctccagttcttttagttgtgatgttagggtgttgatttgagatctttctagctttttgatgtgggcacttagtgctataaatttccctcttaacactgctttagctgcaacccacagattctggtatgttgtctctttgttctccttggtttcaaagaatttgcagaaggatttttttaacttaatataatcccatttgttcacttttgctttggttgcctgtgcgtctggggtattactaaagaaatccttgcccagtccaatatcctggagaattttcccaattttttcttgtagcagtttcatagtttgaggtcttagatttaagaatttaatccattttgattttatttttgtatatggtaagagataaggatctagtttcattcttctgcatatggatattccatttcccaagcaccatgtattgaaaagactgtcctttccccaatgcacattcttgacacctttctcaaaaagaagtagactatagatgtttggatttacctctgggttctctattctgttacactgacctaagcatacactgatctatgtttttatgtctgtaccatgctgttttggctactatagctctgtagtataatttgaagtcacgtaatgtggttcctccagttttgttctttttactccagatagtttcgactattcttggtcttttttggttccacttaaatgttaggattgttttttctatttctgcggaaaatgtcattggtattttgatagggattgtattgaatcggtagattgctttgggtagtatggacatttcaacaatattgatttgtccaatccatgaacatggaatatctttccatttttaatcctcttcaatttcttacattaatgttttaaagttttcatcagagggttttttcactttttattaacttaatttctaggtattttattttatttgtaactattgtaagcatgttgactttcttggtcttttttagatggttccttattggcatatagaaatgctattgattttatttgttgattttgtatcctgcagcttcactgaatttgtatcctgcaactttactgaatttatttcttgtttctaatagctttgtggtggggtctttagatttttccaaatataagattatatcatctgcaaacaagaataatttgacttcgagttttccaatttgaatgtccttgatttctttctcttctctgattactccagctaggacttcaagggctatgttgaataacagagatgacagtgggcatcttttgtgtttcagatcttagatgaaaactttccattttttctccattctgtatgataccagctatgagtctgttgtttatggcttttatcatgttgaggtatgttcttctatgcccagtttttcgagaggttttttttttttatcagaaatggatgttgaagtttatcatatgctttttcagcatcagtggatatgatcacatggtattgtcctttatttggtcaatatgatatatcatgctaaccaatatgcatatgtttgactatccttgcatctgtgggataaattccccttagtaataattaatcattgttttaatgtgttgttgaattcagttttctagtattttgttgaagatttttgcatcaatgttcaacagggatattagcctgtaggtttctttttttaatgtgcctttgtctgattttggtatcagggtaattttagcctcatagaatgagtttggaagtattccctccacctgtattttttttttgaataatatgataaaaatggcattagttcttccttaaattttgataaaattcagcagtgaagctatcaggtccagagcttgtctttgctgaaagaccttttattatagctttgatcccattattttttattactctgttcaggttttaaatttcttcatggttcaaccttggtatgctattcgtgtctagtaattaatctatttcttctaagttttcaaacttattggcatatagttgttaatggtagcctctaatgacattttgaatttctgtggtatcagttacaatgtctcctttttaatctctgatttatttggatcttctctgtttagttaggctaaatgtttgtcagttttgtttatcttttcaaaaactaacttttaattttattgatcatctgtattgtgttatttattttattttaatttatttctgctctaattttttttttattttaagttctgggatacatgtgcagaacatgcaggtttgtttcataggtatacatgtgccacagtggtttgctgcacctatcaacccgtcatctaggttttaagccccacatgcattaggtatttgtcttaatgctatccctcccccttcccccaacccccgacaggccccagtgtgtgatgttcccctccctgtgtccatgtgttctcattgttcaactcccgcttatgagcgagaacatgcagtgtttggttttctgttcctgtgttagtttgctaagaatgatggcttccagcttcatccatgtccctgcaaagaacatgaactcatccatttttatggctgcatggtattccatggtgtatgtgtgccacattttctttatccagtctatcactgatgggcatttgggttggttccaagtctctactactgtaaatagtgctgcgataaacatacgtgtgcatgtgtctttatagtagaatgatttataatcctttgggtacatacccagtaatgggattgctgggtcaaatggtatttctggttccagatccttgaggaattgccacactgtcttccacaatggttgaactaatttacactcccactaacagtataaaagttttcctatttctccccatcctcatcagcatctgttgtttccagactttttaatgatcaccattctaactggcatgagatggtatctcattgtggttttgatttacatttgtctaatgaccagtgatgataagctttttttcatgtttgctggccacataaatgttgtcttttgagaagcgtctgttgatatcctttgcccactttttgatggggttgttttttctggtaaatttgtttaagttccttgtacattctggatattaggcctttgtcagatgggtagcttgcaaaaattttctcccattctgtagattgactgttcactctgatgatagtttcttttgatgtgcagaagctcttgagtttgattagatcccatttgtcaattttggcttttgttgcaattgcttttggtgttttagtcatgaagtccttgcccatgcctatgtcctcaatggtattgcctaggttttcttctagggtttttatggtttttggttttacatttatgtcttttatccatcttgagttaatttttgtataaggtgtaaggaaggggttcagtttctgttttctgcatgtggctagccagtttttccagcaccatttattagattgggaatcctttccccattgcttgtttttgccaggtttgtcaaagatcagatggttgtagatgtgtggtattatttctgaggtctctgttcttttccattggcctatatatctgctttggtaccagtgccatgctgttttggggtctgtaaccttaagttactgtaacttttggttatcgtctgaagccaggtagcatgatgtctccagctttgttctttttgcttaagattgtcctagctatacgggctcttttttggttccatatgaaatttaaagtagttttttctaattctatgaagacagccactggtagcttgatgggaatagcattgaatctatgaattactttgggcagtatggctattttcacaatattgattcttcctatccacacctgctctaatctttattatttattttcttctgctgatttggggtttggtttgctcttgcttttctagttctttaagatgtgtcatgaggttgtttctttcagtttattctatttttttgatgtagacacttatagctaaaaatatacctcttagtacttcttttgctgtatcccgtaggttttgatatgttgtgtttccattatcatttgtttcaagaaacttttaaacttccttcttaatttatttattgatccacttgcactcaggagcatattgtttaatttccatgtgttgatatgattttcaaaattcctcttgttattgatttctagttgtatttcatgtggccagataagacacttaatataatttcaattattttgacttttttcagacttgttttgtggcttaacatatggtctatccttaagaaatacccatgagctgaggagaaaagtgcatattcttcagccattggatgaaatgtttcataagtatctattaggtcgatttgttctacaatgcagattaagtccaatgtttctttgttgattttctgtctggatgatctgtccattgcagaaagtgggaagttgaagtctccagttattaatataattgtattggggtatatctctctctttaactctattaatatttgctttatatacctgggtgtgtatatatttacaattgttatattctcttgctgaattagctcttaatcattatataattaccttctttgtctctttttagacttttgccttaaaatctgttttctctgatgagtgtatctactcctgctctttcttggtttcctttggcatagaatatcatttccatccctttattttcagtctgtatatctttttaaatacagtggatgtcttgtaagcaacagatcattgagtcctgttcttaatccattcaggaactctctgtcttttgattggacagtttagttcatttaccttatatgttattattgattttaaaaaaaagacttacttctgtcattttgttatttgttttctggttgttttgtggtagtatcttccttctctccttccttcctgtattcctttaggtgaagatgactgtcattggtgatatgttttaatctcctacttttcattctttgtgtacctgttgcatgtttttcaatttgaggttaccatgaggcttgcaaataatatctttaacccataattttaaaccaatcacaatgtaacagtaattgcataaacaaacaaataaggaaagagaaaactaataaaatgtctacactgtaactttgtctcctggctttttaaccttttcttgtttttaaatcttactgtattttccatgtctgaaatttattcattattttttattgtttcatcttttaatcttcctactcaaaatacaagtagtctagccaccacaattacagtgttatactattctgtgtttttctgtgtacttacttttgccattgagttttgtacattcagatgatatattcctgctcatcaatgtcattgtctttcagatggaagaaatctctttgacatttcttgtaggacaggtctggtgttgatgaaatccctcagtatttgtttttctaggaaagtctttatttctccttcatgtttgaggctattttttggctggatatactactctgggataaaaggtttttttttcccccttcagctcttaaaatatatcatgcttgtctctcctggtctttaaaatttccactgcaaagtctgttaccagatgtataggagctccactgcatgttacttgttccttttctcttctgcttttagaattttttctttatcattggcttttgggagtctgactattaaaggccttgaggaagtctctttttttgcaacacttactgatatattgtagtttaataaaaacatagcttatacagttcattgaaaaagtattttaatgcaaacaccacttttacacaaaaccaaatgttgatattctcattttttaaaattcttggtttctctaaaacactaagatgatacctcaataagggttgcttcacattttccaatttcttgatctgtgcatgtcacaagtaaagatccagatttgttctttttgcatagtcttgctttggccatgcatgctctcttttggtttcatatgaattatagaattgttttttctaattctgtgaaaaatgatggttttattttcatgggaatcgcattgaatttgtagattgcttttggcagtatggtcattttcacaatactgattctacccatccattaacatgggatgtgtttccatttgtttgtgtcatccatgatttctttcagcagtgttttgtagctttccttgtaggggtcttttgtctccttggttaggtttattcctaagtattttaatttttttgcagctacgataaaaagggttgggttcttgatttgattcttcacttggtctctgttggtgtatagaagagcaactgattagtgtacattaattttgtatctggaaactttgctgaattcttttatcagttctaggaactttctggaggagtctctagtgttttcaaggtaaacaatcatatcatcagcaaacagtgacagtttgactatcagtaatatgctgaagaggagtggtgagagtgggcatccttgtcttgttccagttctcagagggaatgctttcaacttttccccattcagtattatgttggccgtgggtttgtcatagatggcttttattacattgatgtatgtcctttgtatgccagttttgctgagagttttaattataatgagatgctggattttgtcaagtgcttttcctgctgttagtctgatggggttccctttgtgggtaacccgaactttctctctggctgcccttaacattttttccttcatttcaaccttggtgaatatgatgattatgtgtcttggggttactcttcttgaggagtgtctttgtggtgttctctgtagttcctgaatttgaatgttggcctgtcttgttagattggggaagttctcctggataatattctgaagagtgttttccaacttgtttccatcctccccatcactttcaggtacaccaagcaaatgtgggtttggtcttttagtcccatatttcttggggattttgttcattccttttcattcttttttctctaatcttgtcttcatgctttatttcattaagttgatcttcaatctctgatatcctttcttccgtttgatcaattcagctattgatacttgtgtatgcttcacgaagttctcgtgttgtgtttttcagctccatcaggtcatttatgttattctctaaactggttattctagttagcaattcctctaaccttttttcaacgttcttagcttgagatgtgaggtatcattccagtcatcatgctatttgtcacatttataccttggttttttggtttttctttttttttaattctatttttgttttataggtcctgtgagatttaggctttaaagaggttctattttaatgtgtttccaggatttgtttcaagatttagaggtccttttagcaattcttgtaggggtggcttagtaatggtgaattctctcagcatttgtttatctgaaaaagacaatctttccttcatatgggatgtttagtttcactggatacaaaattcttggctgataattgttttgtttgaggaggctgaagataggaccccaatcccttctagcttgtagggtttcttctgagaaatcttctgttaatctgataggttttcccttttaggttacctggtgcttttgtctcacagcgcttaagcttctttcctttgtcttaactttagataacctgacgacaatgtgcctaggcgattatctatttgagatgaatttcacaggagttctttgtgcttcttatattcgcgtgtctagttctctagcaaggctggggaagttttcctcaatttttcccccaaatatgttttccaaacttttagatttctcttcttactcaggaacaccaaatattcttaggtttggtcgtttagcataatcccagactttttggaggctttgttcatattttcttgttcttttttcatttatttatttttttgtctttgttagattgggttaatttgaagatcttgtcttcgagctctgaatttctttcttctgcttgttcaattctattgctgaggctttccagagcattttgcatttctataagtgtatccaatatttcctgaagtttcttttgctttttctttatgctatctatttccttgaatatttctcccttcacttcttgtatcattttttacttccctgccctgagctttgcctttctctggtgcctccctgattagcttaataactaacctcttgaattctttttcaggtaaatcaagaatttcttcttggtttggatccattgctggtgagctagtgtaatgttggggggttgtttaagagccttgttttgtcattttaccagagttggttttctggttccttctcatttgggtaggtctagggctaaaggctgttgttcaggttattttgtcccatggtgttcccttgatggagtactctccctttttctagggatgtggcttcctgagagctgagctgcactgattgttatcttgcttctggatctagccatccaacaagtctaccaggctctgggctggtactggggattgtctgcagagtcctgtgatttgaactgtctattggtctctcggccatggataccagcacctgttctggtggaggtggctagtgggtgaaattgactctatgcaggttcttagctttggtggtttaatgttctatttttgtgctggttggcctcctggctgggggtggcactttccagagaacatcagctgtggagagaaaccagcagtgaatggggccctagaactcccaagaatatatgccttttgtcttcagaagttgggtaggaaaaggctatcaggtgggggcaggactaggcatgtctgagctcagactctccttgggtgggtcttactacagctgctgttgaggataggggtgaggttcccaggtcaaaggagttgtgtatttaggagtattatggctgcctctgctgagtaatgcaggttgtcagggaagtgggggaaagcccacagtcacaggcctcacccagctcccatgcaatccaaagagctggtctcactcccattgtgtcccactaacagcaccgagtctgttttccaggcagtgagtgagcagggctttagaaccttccccaggctacccacctcccagctgcaagagaaaagggctttagttctttctctgcctgtggagtctgcaggccaaattcgcactctctcccaagttctggccaggaggcttcacatccagttcaaattattacaaagttcagctgcagatatccttcttcctgtgacatttttctgcctctctccacagccccccacaaagtgccaggcaggaatggctggcatgggggcctagcaagctcccagggcctttcctgctgcttcctctgcccctgtatttctcttggctctctaaattaactcagctccaggtaaggtcagaaacttcctgcaaagtagaccttcagtttccccagtgggggtgcgtgttcaggggtggaggatctctcttttctacttctgcagtttgggcactcatcgtatttgggatatctcctggctcctgcaggagcagtcggcttcctccaaagggtctgtgggtcctttcaggaatcccgttttgtttctgcagtcattctggagctaaaattcacgatgcaagcctccaaacactgcacttcaattgcattttcaactccaaaatttctgcttcattatttttaattatttcaatttctttgtcaaatttatctgataaaattctgatttttttctctgtgttatctttaatttcatagattttcctcaaaagagccattctgaattctctgtgtgaaaggtcacatatctctgtctctccaggattggtccctagtgccttatttagtttacttggtgaggtaatgtttcctggatggtgctgatgcttgtggatgttcatcagtgtctgggcactgaaaacttaggtatttattgtagtcttcacagtctgagtttgtttgtacacatctttcttgggaaagttttccatgtatgcaaagggactttggtgatttgatctgtttttcatcactgcagacatatgttcattaggagggaccccaaggccagtaatgctgcagttcttgcagacccacagatatactgacatcatggtcatggataacatccagaagaattatctggattaccaggcagatacttttgttctcttcccttactttctctgaaacaaatgggcattttgtctctatactgagctgcctcgagctgggggaggggtaacacaagcacctctgtggccaccaccactggaactgcactgtatcagacctgaagccagtatagcactgggtatcacccaaggcccatagtaatcactgcctggctactgcctaggtttgcccaaggccctagggctctacagtcagcagttgtcaaagctggctaggttcatgttattcccttcacggtcacaagttccctacaaccacagatgggtctatagatgccatccagcaaccagggcttagagtcagaaacctttgaaatctatctggtgttttattctactgtggctgagctggcacccaaggcacaaaagaaagtcttttccattcttcccacccttttccacaagcagaggagtcatctcatggccaccaccaccccacgtttatggtaagtactacctgtttattgccaatgtgcactcaaggtctaagtgttcttcagtcagcttgtgtgaatgctgcttccaggcctgagaattacctttcagggaaatgggcttccctctggcccagagcaggtcccaaactgccatccaagagcccaggcttggatttatggaccccaagaccccacttggtgttctatcctatggtggctgagttggtacctaagctgcaagacgaagcctcctttaatcttggctcttcttttctcaagtagaaggagtgtctccccttaattaccacagctggaaatatgccaggtcccacctgaagccagcacaaggcagagtctcacccaaggccaatcgagtgaactacctggccaccactgatgattattcaggacccaaggttttttagtcagcaggtgatgaatcctgtcaggcctgcgtccttcccttcaaggcagtacgtttccttctgcccctggagatgtctggagatgtcatctgggagctacatcctagaatgcaggccccaggaccctattctactgtggctgaaatagtatccatgttgcaagacaaagtcctcttcattcttccctctcctctcctcaagtcaaagggagaattctctcctggagctgcaagctgctggggtctcactagatcacaggtcccccgagttcactgatcccaggcccagcacagcaccagggtttgcctaggaatagcagtccttgtagccaagactgtcttttaagtttatttaagaccccatagacctttagtccatgatggtgaggcttgtcagaacccagattctgaccactgggatgggcgattcccctctggctagggctggtctaaatgctccctccatggttgctggctgagttctgtctggtgctgctttcctctgtgacagggcagcactgattcccaatgcaaagtcccacaatcactgtgctctctatcccccaagcacacaaagatgccctgcaccaggcagccactgctgggagatgggcagggttggcactggcaattcaaggaagtctttcctaccctcttcagtgtctctttcagtgatatgaaattaaaaccaagtactgtgatctcccactttatttttggctcttatgaagctgccttttgtgtgtcgataattgttaaattttctgtttctgtgggaaagatgaccttagaggcttctactcagccatcttgctcctcttcgttgttctgtattattattccttcaaagaaactttctacttcagtgtatgcatccttattaaggcaaataactcagacttaaaaataatttatcatcaggtatttttgcaggcctcatattaaccacaaagcaaatagtctctaatagatacataaaaatgaaaagcaagaagttaaaacatactaccacacaaagtccttatacacaaaaaagaaaggaagaaggtatatagaggacttacaaagtaaccacaaaacaaataacaaaacggcagttataaattcttacctattaattgcattgaatgtacatggactaaattctccaattaaaagacatgaaatagctgaatgggttaaaaaacaaggcccaactctaagttcctacaagtaatgtacttcacctgtaaaattacacctgcactagaaatgaatggagagaaaaaggtattccatgcaaacagagggcaaaaaagagcaggagctgctatggtgatatccaataaaatagatttcacatcaatactgtaaaaacagacaaaggagatcattatataatgataaaggggtcaaatcagtaagaagatataaaaactgcaaatatatgtgttatcaacatgggagcacctagatatataaagtaaatactactagaactaaagagatagaccccagtacaaaaatagttgagaatttcaacaaccaacattctgcattgataagttcctctagatggaaaatcaaaaaagaaacattggactttattttcatgatagatgaaatagacttaataaatttttacagaacattttactcagcaaatgcaggatgtacattcttcccatcagcacatgcagcattctttagatagaccatgttagaacacaaaaacttctcaggaaattttaaaatttcagtcatatcaagttatcttttctgatcacattggaataaaacaataacaaaaggaactttgaaaaatatacaaatacctgaaaattaaacaatatgctcctaaatgacaaatgggtcaatcaaggaattaagaagaaaattaaaaatttcttgaaccaaatgaaaatggaaacacaatataccaaacctttgagatatggcaaaagaagcactaacaggtatgtttatagcaataaacacctacctcaaaacagtagaaagacttcaaatagcctaggatgtaccttaaagaagtagaaatgcaacaacaaatgaaacccaaaattagcagcaggaaagaaataataaagatcagagcaagaaataaacgaaattgatacaaaaaatacaagtcaaaagttgttttgtgaaaaataaacaacatcaacaaggctttatgcaaactaagaaaaaaatagagaaaacaaaaataaatcaaattgaagataaaaaagagatattacaactgacatcacagaaatccaatggatcattagagactattatgagcaactttatgccaataaattgaaaaccctagaagaggtggataaatttttttgacacatagaatattgattgaaccaagttgacacattaagaaatacaaaccatgaacagagcaataaccagcagcaagacaccagcagtaataaaaagtcctccatcaaagaacaatctagaacctgatagcttcagaacaactgaattctaccaaacatttaaagaactcatacctattgtacacaaactatttgagaaaataaaggaggtgggaatacttccaaactcatttcacaaggccagcattaccctgatgccaaaaccagaaacgaacacacacaaaaaagaaaacatcactgatgaacatagatgtaaaaattctcaacaaaatagtagcaaacaaaattttaaaacacattaaagagatcattcatcacgaccaagtgtgattcatcccaaggatgcaagaatggttctgcataggcaagtcaataaacataaaacataacattagtaggatcaaggacaaaaatatataatcatttcaacagacgccaaaagcatatgataaaattcgaattctctctttatgataaaagctctcaacaaactgagcataaaaggaaaatacctcaaaacaataagatcatatgtaacaaacccacagctaacaccatagagaatggggaaaaaaatgaaagctcttcttctaagatcatgtagaagacaagtatgcccactttcaccacttttactcaatacagtagtggacgtcctacccagagcaactaggcaagagaaaaaaataaaaggaatccatattggaaaggaagaaatcaaaatgtcctcatttgcatatgatataattttatatttacaaaaacccaaagaccctctcaaaaatctatctgaataaacaaaaaattcagtaaagtcgcaggatacaaaatcaacataaaacataattaccataactatatttcaataaacagcaatctgaaaaggaaattaagaaagcaatctcatttgcaattcgttacaaaaagtaaaatacctagtaataaactacaccaaagaactgaaagatttctacaatgaaaacaataagctgatacaaaaaatagaaagacatcccatgtgcatggattagaagaaccaatattgttaaaatgtccctattacccaaggcaatctacagattcaatgcaatctctatcaaaataccaatgacattcttcacagaattttttttagtcctaaaagttacacaaaatcaaaaaagacccataaagcgaaagaaatcctaagcaaaaagaacaaagctggagtggctgagctaatttgcattcccacccgcagtctactagtgttcccttttctccacaacctcaccagcatgttgatttttgactttttaataacagccattctgactggtgtaagatgctatctcattattgctttcatttgtatttctcaaatgattagtgatgttataagtttttttatatgcttgttggccatgtgtatgtcttctctggagaactgtcagttcatgtcctttgcccatttttaatgggtttgtttgtttgtttgttttattgttgctttatttgagtcccacatagagtccaaacattagacctttgtcaaatgcataacctgcaaatattttttcccattctataggttgtctgtttactctggtgttagcttcctttgctgttcagaagctccttggtttaattagttcctgcttttcaatttttggttttgttgcaattgctttttggagtctttatcataaaatctttgccagggctgatgttcagcgtggtatttcctcttttcttctgtgtttttaacacttttacatcttacattcaagcctttcatccatcttgggttgaattttgtatatggtcaaaggaaggggtctagtttcaaaattttgcatattgctagccagttatccaagcactatctattgaatagggagtctttccccattgcttgcttttgtcagctttgtcaaagatcaggcagttgtagatatgtggctttatttctgggttatctaatgactgtgttgcattggtctatgtatctgctcttatgccagtatcatgctgttttcattactgtagccttgttgtgtagtttgaaatcaggtagtgtgatgcctctcactctgttccttttgtttaggattgatttggctatttgagctccactgtgacatttacccatgtaacaaacctacatgtgtacccctaacctaaaatgaaagttgaaaaaaaaaaaggtttttaactaaatgtaaaattatgttttaaaagatcacataattagtaaatggtacaatcagaacttgaacactaatctgacattaaatcttgcacttctagccattataccatattactttccttttacactatactgtcttcactcaatatgtaattattttggaaattaaggacactaaaattcccataaacactaacatttttagaatatttgtatgtttgctcacctttcaccattttttgaagttcacacatatacatgctcatcaacttttgcttcagcttccctgaaggaagatctaaggagaagaaaaacactttccaaaatatatcaatacaaaagattgttataaaaagtcaatgacatataattgacaattggataaatggacagattctaagaatttcagactattaagtgaaattaatatagtcagaagactaaaaaccaaatatataaaagtaaaaaagaattccatattaatccattttctgattaaattatcaaagaaaagagagaattttgaaagcagcaagataaagtgactgacttgttacatactaagagaatgtcctccataagacgattgggggatggcagatttctgcagaaaccttgtaggccaacagagagtgggatgatatgttcagagagatgaaaaaataaaaggctaacaaaaattactgtatcttgcataccatccctcaataatgaaaagaaatactttcccacacaaacaaaagttgagtgagtctgtcagcaccccacctccattattattatttccaaagggaaaccttgaactttaaaaaatggcactaaagagcagcatgagagcatatgaacatataaagctcactgataaatgactaatgtgaaaagtccagtattaatattatactcaacaataaaaaactgaaaactcttcctttaagatcaagaacaagataaggattctactctcaccacttctattcaatatagtccttgaaattctaacaagagcaattagggaagaaaaagagataaaaaggtaagaaaaggagataaaatatgaagtgttttatggaggattaaacacgtaaaaaatgaaatagcatcctatacctattaggattatcattatcaaaaataaataaataaatcaatcaatcaatcaataaataaacaagaaataataagtgttcaaaggatatggagaaattggaacccttgtatattgttggtggccatataaaatgctacactcaccatgaagacactatggaggttagaactaccatatgattctgtattttcagttatgggatctcaattcttcagaaaagaattgaaatcagtatttggaagagatatttgcactcccatatgttcattgcagcattattcacaattgccaagatatggaagcaacttaactattcatttacatatgaatgaataagcaaaatatgttatatacctataatggaatattagcctcaaaaaagaaagaaaaaggtcatacccaacatgtatgaaccttgggctagcacagaagaacaaacactgtctgatttcacttatatgagatatctaaaaaaaagtcaactcatagaagcagaaagtaggatagtggttttcagggacagcggacagaggggaatagggagttgtcatttaagggcataaagtatcagttatgcaagatgcaaatgtcttggaaatctgctgtacaacattatgcttacagtaaatactgtactgtatctaaaaatttgttaagtaggtaaatctctcagcttaaggagattttgggctgagacgatggggttttctaggtaaatctcatcttatgtatttttatcacaatattttaaaaatgaataagtgttttgagagcccccaactaaatttggatttcagtaccagagtggttaaaaaccctgccctaaaaagaaaatgaatgggagctggatgtaggggtttacagtgttcacgcaatacttttccttcagtggatggcctgatgcctagttgtttgacccttgaccaggggaaccttcacacaggaagcttgtttatactggcagatgcccttggggctcttatccgacccatgtacagtttatgtctgcctgaccattgctctggcactggttgcctaacattgtgttctcactgcagtcctagggaaaacccagcctgaaacagcccctagtttttcagacagaaagcgtaaattcagtacaccaccacaagaagaagcaaattcaaagatgtctacttacagatcctgggaaaggagagaataatgaattgggagggcagtgttctgtccccatgtcagatgaggcagaaatgaagcaactggctgagaaaccaaaatctcagaaatcaccactacaggacttatctatgtaaccaaacaccacctgttccccaaaagctattgaaataataacaataataataataataataataaaaggaatacatggcaactagcagtttatataaagaaatcaggtgtgggtcacttaaagtttgcaggtaaatgcctgaatagttcatttaaaggaagcaacaggaaagcagggaacccagtcagctaaacaggagagatgactcaaagttatctctggcttctggtttgagcaatttggaagtggtgtgagaactagaaactgtgtcaagggcgactaagccctgctgtgctgtgagaaagttaaacttgtaatcaaaatgaacgatgagacaacataaaattgtaggaattccctctaacaagatacatatgtattctgaaaacgtaataaaaactattgactcctttctatgctaataaacaaaaccatcacgaggttatatgccattaaacataagtaatataaaaataggtttccttgttgcattctggatttactacacaggaccaactacacagtgaatgctgtggatatacaatctgtcactcaataagttgtacattttagtgacatttctgattgtaatggaggtaaatggacatttcagctcctgaggtactcactgggagtttgactaatatctgtaaatttttacttttaattttgtggccctcaggatagtgaattgtcttgcagtggtttttgttgtcatgtgagcaaattggctttagaatactaataaaagcaattacttataataaataaataaacctcaggccccatagtttaatcctccataaaacacttgctgtcttccaaaaaattaatgacaattatgaccatcatcgtcttaccatcattttacgataatttaaaaatcaacatattgtggtatcttcagttctctttgtcacttactttagctttgagagacaggacttggtggttgaaatatgagtttgagacttggtttgcttttgtggaggaaggtggcagcattttcaaatggaactgtcttcttttcccacacttttagtcatcatctttgtaggtagtattatacttttgtctcatttttatcaaatagaagctaccaaagatacctttgaaaagtcttcagaaattatcctgcttcataagacacagtctgtatctctttctgaacatatttaagcatctaacttccagcctcttctctagtattaataacttcttcacaaatagttccataatgttatcattatcacttaatagatttctttaaatcacgttgcaagaaaatattccatgaaatagacccagcctttatactttaacaatccctagctgcctgggccaatattattctcatttgtaggatgtaggctccacagattataatatgtttctttcctttttaatcatcacagatttgcaaactttatggcctattttggccttaatctccatgtccagcatctggggaacaatgttttcctgttgcagactctctttggtgcagtcatcctcctggccaactgtgttgcaccttgggcactgaaatacatgaaccgtcgagcaagccagatgcttctcatgttcctactggcaatctgccttctggccatcatatttgtgccacaaggtgagaaaagatcacaggtggaagagagaaatgcctttgcctcttttctcagggattgtacttgtcacacctatctgaagccaagaaggaaagggagaattgggttcttaggatttcctgacaccaatctggggatttgggacagattctgccacaagttgctggaaaacgagtcaaagatgagtaaaggttggctctattatatggttgtcctcatcatattcaacaaatactaagaaactgaagccatttatttctgacagtttctctacaacagcaatcaattacttactctttggccaatcaaactttaaatgagtattgaggtataggccttgtcattgtttcccaacatgaggacataatactgctacttcctctgtctgggctctttcttattactacagcttcagtgacaatgtactccctaattcccatgtatctacttgtgtgccttgtatttggtcaccataactgcaatctggtttaggggagtcatcttgacttcaagggaacaaaagtgccccatctttatgtaaagaactgtacagtagaaatgaagaaattgtcagttaatagcctcttgtagattctattttaagaaattaactgatcatatgtaataagtaagggaacccaggtggccaccagtcttcacctaactcttagtgtagtaatgtatctaacaggatctcagattggtgtgctccactccccctcttgaatgccagcaatgatccaagtgtgctacaaagcaacagcaccctccaatgtcatgaggctatgacaggatttcttcagttggatagaaacaagcctctgaaacttcccttcagtgctttccaaagtctgactttttttcctcttttcgaggtccttattcctaatccttaaaacattaatactctctagcttctctcctaacatagacctcctgatcttttatgactctcttctgcaaccctagccccatgtcaatactgtgtatgtacctaggttttaacggccaggagaacatggatgggtcttatactcccaagtattgcccacatgacagtcctatgttctaccaggtaggcagaggagtccctggacggaataaatgaaaaaacattcagctcaacttacacgcctctctcttgctatggcatatctctgatatatagtgagaagtgaagtaatagctcagatcctttttatgcattatttaagccacaaggcgaagacaaatcatgtttctcagctatcagccactgcacattctttgcctctatgcagtttccctacagtacatttaacccttgcaaacacctccaatacagtccttttcacttctaccttggggatgctgattccttcagctcagatttcctgaggccttgtgttcttcctttctccagaaatgcagacgctgcgtgaggttttggcaacactgggcttaggagcgtctgctcttgccaatacccttgcttttgcccatggaaatgaagtaattcccaccataatcaggtacagaaccttaagtatgccctgtcaggttcaaaatggacctttctcagataattgacactttttgcgggaagaaatctaagactggttcattaagaaaataaatcataacagtcataaacacaaataattatagaccaactttatctcaagctgactttttgccactgtattaagtcctttgatgtattatagtatcccacataaccttctgagccacctgagaggttggtgctaaggatagcagtatttcctaaatgatgaaaatgcatctaatgcacttgtgaactgaaaaattaattgctagcaaataaaagtgaaaatttcaaacacaggagtatttcatcacctctgtgtgtctaaatgttcccccataattagagcaaaatgataaatcacaaattgcctgtgtggatttttaacagatattcttgtattgctgtttccactcaaagggcaagagctatggggatcaatgcaacctttgctaatatagcaggagccctggctcccctcatgatgatcctaagtgtgtattctccacccctgccctggatcatctatggagtcttccccttcatctctggctttgctttcctcctccttcctgaaaccaggaacaagcctctgtttgacaccatccaggatgagaaaaatgagtgagtaaatagcccggttgcccctcagaggatctgtgtgctataggtctgtgctgaggaaggcaaaataccatttagggccactgtcctctcaaaaggcttagacttaggattttcccatgtaatcagtgccttaggtctaggtacagccacatgccttcccacagtgacctcagacaccctctgaggctctccagatcacacagaccagctctgcccagcttgtcaaaggaggcttcatagtgaagaagccaaaattaggtctcctcttccctccctgccctagtgtgatatgcacactgttgaaggtattttacaaatatgcagagatccaaacaccagattttcatccctgggaaaccctcaaacaagtgggtacctgtaagctgtctgagattgccagtgcttacaggcctgactactaggccactgaagaatttgtggaagagtatgcagatgcaggggtatccaatcttttggcttccctggtctacagtggaataagaattgtcttgggccacacataaaatacactaacactaataatatctgatgagctaaaaaaaaaaaaaatcacaaaaatatctcataacattttaagaaagtttacaaatttgtgttgggccacattcaaagccatcctgggccacaggcagcctgtgggccataggctggacaagcttgcaccaaggcgtccaaggatgacaagtagaaagtatccaagctgccttcccagatcctagtctgggagcttcatcttttacttcacaaggtttactcaatcccttgggggcagagatatggtttttaccaaactaatggacaaagaatcaacattccttaaagaatgcgggacttacatgtttagtccatgtcttttcatttttgtgattttttgttggtttctttgtatttgttctaggagaaaagaccccagagaaccaaagcaagaggatccgagagtggaagtgacgcagttttaaggaattccaggagctgactgccgatcaatgagccagatgaagggaacaatcaggactattcctagacactagcaaaatctagaaaataaataacaaggctgggtgcggtggctcacgcctgtaatcccagcaccttgggaggctgaggcgggcagatcatgaggtcagaagataaagaccaccctggccaacatggtgaaaccctgtctctactaaaacaaatacaaaacttcgctgggcacagtggcacaggcctttaattccagctacttgggaggctgaggcaggagaattacttgaacccaggaggtggaaattgcaatgagccaagattgggccactgcattccagcctggtgacagagcgagactgtctcaaaaaaaaaaaaaaaaaaaaaagaaagaaggaaagaaagaaagaaaagaaaagaaataacaagatatagtgagtcagtagattcacttcacaattgtggtactaaataactaaatataagctatctacatataatagtaagaaaaagtttgaagaaaattatataacactttaaaatcaatcataatagactatttatgtagttataggtccctagcaagtttctggataggaagattgagtactattaaacacaatgtgtcttcttcaattatttgatagagtaactggtgggataattacaatgaaaaatctgctacttttacaaaaactttaaaataaattcaaatttatctaggaattaatagtagacatttggttcagaaaaaagaagatcagggagtgaaaaatgtagctgtcaggtaagtggggtagcatgcacagaattttatcataagttgtaatattcataacattattagcagatgcatttacaaaacaaagaaattcaaaagtagactttagtatgtataacatttaatgtgtaacaatttcagtattgtacattcttagaggaaacacctaattatggaataaatagcattagccaactaatcagaaataaatgactaacaattcaactttatatcctgtattagtcagggttctctaaagcaagagaaataatagtatatatgtgtatataaaagtgagtttattaggagaattgactcacacggtcacaggatgaagttccacactaggccatttgcaagctgaggagccaggaagccagtccaagtcccaaaaccccaaaagtagggaagctgaccatatagccttcagtctgtggccaaaagcctgagagcccctgacaaatcactggtgtgagtccaagagttcaaaagctaaggaacctgaagtcggatgtttgagggcagaaagtatccagcatgggagaaagatgaaggctgaaagactcagcaagtctgccctttccatcttcttctgcctgctttattctagctgcactggcagctgactagatggtgcccacccagattgagggtgggtctgcctctcccagtccactgactcaaatgttaatctcctttggcaacaccctcacagacacacccaggaactatactttgcatccttcaatccaatcaagttgacactcaatattaaccatcacatttcctaaaccaatataccaattattgattatgattatgacaatcatttcacattgtatacatacatgtatcatcacactgtacatctcaaatatatgcaagttttatttgtcaatcatacttcagtatagctgagaacaagttaaatggaacaaataaaccatgctttcaaaggagccttggctaccaaaattcaaaaaagaaaaacatgttattaataggaaagtaaattccaaataaacatatatatacttgactactcatttaagccttctgtgaagaaaacccaagaaattatgggagaaagctataaaaatatacaacaaaatgattaaaaacattaaattttcatggtagacctcaaagttatttaactttcttctttgtaagtgtattctaagttgaagcaaggaatatgcaacagcttaaaattttataaattatataattttttcacagaattaggaaaaacaatttttaaaatcacatggaaccaaaaaaaaaaagagcctgcatagccaaagtaatactaagcaaaaggaataaattggaggcatcacattatccaacttcaagttataccacaaggctatagtaaccaaaacagcatggtacttgtataaaagtagacacatagaccaaaggaacagaatagagaacccagaaatagagccccatacttacaacaaacctatcttcaacaaagcatacaaaaacataaataggggaaagaacatcctgttcaataaatggtgcagggaaaactggatagccacatatagaagaataaaactgaatccctatctcttgccatctacaaaaatcaactcaagatggatcaaagacttaaatttaagtcctaaaaattctagaagaaaatctagcaaaaacatttctggacattggtctgggcaaagaatttatgtctgagaccccaaaagcaaatgcaacaaaaacaaaaataaataaataggatctaattaaattttaaaaattcttcacaacaaaagaaataatcagaagagtaaacagacaacccacagtgtaggagacaatattcacaaatcatcatcttacaaaggactaatatccagaatctacaaggaactcaaatcagcaagaaaaaaacaatctcctccaaaagtgggtaggacatgaatagataattctcaaaagaagatgtacaaacagccaacaaacatatgaaaaaatgcttaagtgcaagaagggcgattaaaatgtcaaaaaaaatagatgttggcatgtatgtgttgaaacgggaatacttatacactgttgtatcctctctggaacacagtatgaagatttttcaaagaattaagagtagtagagaaaatagcagatgtaccattcaatcccgcaatcccactgctcggtatctacctgtattagtctgttctcacactgctataaagaactgcccgagactgaataatttataaaggaaagaggtttaattgactcacagttctgcatgactggggaggcctcaggaaacttacaatcatggcagaaggggaaccaaatacttccttcttcaaatgatggcaggaaggagaagaatgagtgctgagcaaaggaggataccccttatgaaatcatcagatctcgtgagaacttagtcactatcacagaaaccgcagcacaggagtaactgcccccatgattcagttacctcccaccgggtccctcccatgatacatggtgattatgggaactacaattcaagatgagatttgggtggggacacagccaaaccatatcactacccaaaggaaaagaagccattatataaaaaaaaaaaaacctgcatgcatgtttattgcagcacaattcacaattgcaaaaatatggaaccaacctaagtgccccgccaccaatcagtggataaataaaatgtggtacatatacatcatggaatactactcagccataaaaagaaacaaaataatgtcttttgcagcaacttagattggctggaggccattattctaagtgaagtaactcaggaatggaaaaccaaatattgtacgttctcacttataagtgggagctaagctacaggtatacaaaacatatggagtggtataatggacattagatactcagaaggggaggggaaaaaaccctacatattgggtacaatatacactacttaggtgatggatgcactaaaacctccaactttaccagtatacaattcatccatataaccaaaaactacttgtaccccaaaagctattgaaataaaaaatatacatatatttaaaattcagatgacatccactcagaaaaaaattataaattattgttatattttaaattacaaaatacaagataaactttagaagacatacatatttagatttcttatgtctatgaaaaaagaatacatgattcaatatactattggggaacaccaagaacatataattttcaaaggactaaagtcacatgactaaacatttatgaaaaagtgtgcaagcctattggaaatagaatagcataaaaggtccagaaataaatccaagcatatatggccaactaattttggacagggacaccagaaagacacaattgaaaaagggtaccctcttcaataaacggtgctagaaaaaaattgtatttccacatgtaaaggaataaaatcgaatccttatcttacaccatatacaaaaatcaacttaaaatgaataaaagacctacatgtaagaccataaaactcttggaataaaacataggagaaagaagagaacatagctccttgacattggccttggcaacaattccattccttggataatacactaaaaggtcacgctacaaaggcaaatataaatagataggactacattaagccaaaatgtttctgcacagcaaaggaaacaacaaaatcaaaaggcaacctatggattggaaatatttgcaaactatatatctgataagaggttaatatccaaaatttatgtaaaaacttacacaactcattagtaagaaaatatataattcaataataaatggacaaaatgcctgaatagatatttctccaaagttgacataaaaatggccaacaagtataggacaaggtgctcaacatcactattcatgaggacagaataatgcaaatcaaaactactatgagatgtcaccttatattccttaaaatagctattatttaaaaggtgagttaacaagtatcgtcaagagcatgtactttggcattgttggtggaatgtaaattgctgcagccattagggaaaacattataaaggtaccatgtaagaaaacttcacaagtatcacctgaacctaaaataaaagttaaaaagaaaagattccaccccaaaattaaagacagaactaccatgtgatccagcaacccctcttctgggtatatacccaaaagaaatgaaagtaccaccttgtaaaaaacatctgcactcccattttcattgaagcattatgcacaattaccaagatacagaaacaatctaggtgtccatcaacagatgaatgaaaaaggaaactgtaatatttacacacacacacacacacgagtaatattattcagcctttaaaaaggagatattcaattgtacctaaatctcagcatcacacaatatatccaggtaacaaatctgcacatgtgccccctaaatgtaaaagttggaattataaaaaaaaaaaaataagaggagattctgccatttgccactacacggatgtacctggaaaacattaggctaaataaaataagccagacacaaaaaggaaaacattgcatgacctcacttatatgtgggaaaaaggtcaaataaatggagatagagaataaaatagcagttaccagagacaagatgggaaggaggaaatggggagatgtaggtcaaagtacaagatatgtaggataaacaaggctaaagagctcacgtacaacatgaagactatagttgataatagagtatagaattcagaatttttgctaaatgactagattatagatgttcttgccacagagtgaaaactaagttaactatatgaggtgatagatacgttaatttgcttcaccatggtgactattttatacacacacacacacacacacacacacacacacacatataactctcatagcattatgttgtataccttaaatatacataattaaatttatttttaaaaagaagagaaaactcataacatgaaaaaaattattaggtcatcatgtaatagcaactaagcagtatgctagaagctctgaatgcacagaagaaatgaaaaaaagacatcacacggatttaatagatatgagtatttgtctgcaaatatagatgtaacattgcattttagttgttaccagtaacaaaatttcaatttaaattccaccttgcctctgggttggcaaaaaaaaaaaaatgcaaataagttattttcaggaattatttccacaaatctttcacatcaaagctatctagactccacaggcacatgcagagtgtgtcaagaaataaagtagtaataatggaagattgcactcattatcagttatccgcttagaggttatcatgtagctactgagcctgcacacactcagtgctgaaaccctaccattcccatcacaatgaggcattgaaatggggattctggtgtggccacttacctccatttgcaaccactctgttaggagttctctgattccatggagtatcctaaaggtgaataccgggttctggttcccccaggacccagagacactcctccaccctcacccttcccaaatactccacttattttgataaactctttagcttttgcacagaccctctagttacactgccaatttagcttttgaaaaaaatagtcttcaagacttcttttgcttatcagcttcaaaacaccttccgagggatcaaaaagtaaagacatgacaacccgcaggaatgtgggaaagaggatattccaggaaatcatccataatggatatcatgagtttatccagtctcattcttgtgcctaatgaaatgtttgatagcccattatgatgaagactacatggcatccgtttctgtgcatcaccccagaagatagtggtcagttcataaacatgatgtttcatggaagagaatttcccacaggtcttcatgagtctttaaagctagagaccagtgcttgtggcccaacagataatatttttactggagaagtctagtgagcacaactgtaaaaaaaatctactatggtggggtgagtgaacgggtttcctttccatttgacttggagtaacagaagcattcttcaaagacctagttaatattttgcagtgattatcattttgaaataggattatcagtgaacatctgtaactcactctttgttgtccagtgtttcttgaacggaattttgtaaaaagaaaaaaaatcagagaacgaatgaatacatttgaaatcgttgaggaaatgctggaaattagggctaattatctctcctaattgtggtaaaggagcttcttcctggacatggatattcatagcctgttatccaaaccctcctgagccatgtagctatagatattttttgaaactcatgtgctataaatcatgattctaatagttagctggatataataccatggaatccagtcttaattttgtaaagaacagtacataaaacaagtgcagctaaagaaacacaaataccacaagatctaacttatttgtggaatctaaaaacttcaaactcagaagtgtgctgccagtaaggtggcagaataagaagtcatccactcgtatcccccaaaaacaacaagaattctgtacctgtcaacagagaaaaagcctctttacatgagctggagactgaggttgaagtctgtgaaaccccagtggagcccaagactttgaaaagtcattttaagagtgcaggcccacacccagatggcaggcctaccaatcatgctcctgcattgaaagtttgaaagagcctcatttcccaaagggcttagctacagccttgtatggccttgaccctggaaccaaaactatctgccaaagcctccaggaggaatcacaacagtatcttggcaaaaaggtttgactgcccaccaacattggtctcagcagtggactggaaagttaccctataaaagctacagttcccctcaactgtggtcacagattgacactgcttgcacaaggcctcagaaagagctctcatgtgtgacaccaggacaggcttgaaagcctctgttccacagcacagtctaaatgggctctatctttcagcccggcattatcttgcccaagcagagaatggctgggagtcacccatctgagcctccataacaggcttactaggttccatctcattgcagagcctgaaggagccaatctcagctcaaatccattggtgccacagccagggaattatctgacctgtacaaggaacagctgggagacatgcccatctgaacaactgggacaggcttgccagcatctgttccatagcaggtcctcaaggggcctggtcttagacccagcccctcttgctgcaatgagggaataatcccaaaggcacagggatctgctgggaaactcaccccatctgagcctctttgacagacttatcagactgtgtctcacagaaattcttgaaggggcacagtctcagcttcagcctcttactgccatagccagaaaactatcccacctatgcagggaactgctgggaaatgcacctatctgaagtaacaggacagggtttctaacttccatcccatagcagatcctaaaagggtcaaatgtcagctccagcacctgtcactgcagtcaggtaactatcctacctgtgctgggaactgcttagatatgtgcccatctgagccaccagaagaggcttgcgatgcatcctctttctcacagaagattctaaaaaggcccagtctcagctccagcccttttctgcaacagcctggaaactatcctacctgtgcagtgaacttctgggagatgctgtcatccaagacaccagcacaggcttgccatcctctgtcccacagtaggacatgaagaggccttagtgctacactagatcaagcacttatgaatctagtgaccatgacaaacagcatgctcagagttgctggatagacgtcttgtacaagaactgtcacagagaaatccagactatgaacactaaaataaatacctatttcttcaatgaatagacattgatgcacaaccacaaggatcaaaaacaatcaaagataaatgatgtcagaagatggcagaataggaacagctccgatctacagctcccagcatgagggacgcagaagacgggtgatttctgcatttccatctcaggtactgggttcatctcactagggagtgccagagagtgggtgcaggacaatgggtgcaacacaccatgtgggagccaaagcagggcgaggcattgcctcactcgggaagcacaaggggtcagggagttccctttcctagtcaaagaaaagggtgacagacggcacctggagaatcaggtcactcccaccctaatactgcacatttccagtgggcttaaggaacagcacaccaggagattgtatcccgcatctggctcggagggacctgagcccatggagtatcgctgattgctagcacagtagtctgagatcaaactgcaaggcagcagtgaggctgggggaagggcacctgccattgcccaggcttgcttaggtaaacaaagcagccaggaagctcgaactgggtggagcccaccacagctcaaggaggcctgcctgcctctgtaggctccacttctgggggcagggcacagacaaacaaaaagacagcagtaacctctgcagacttaaacatccctgtctgacagctttgaagagagtagtggttctcccatcacgcacctggagatctgagaatgggcagactgcctcctcaagtgggtccctgacccccgagcagcctaactgggaggcaccccccagtaggggcagactgacacctcgcacggccggatactcttctgagacaaaacttccagaggaccgatcaggcagcagcatttgcggttcatgaaaatccagttctgcagccaccactgctgatacccaggcaaacagggtctggagtggacctctagcaaactccaacagacctgcagctgagggtcctgtctgttagaaggaaaactaacaaacagaaaggacatccacaccaaaaacccatctgtatgtcaccatcatcaaagaccaaaagtagataaaaccacaaagatggggaaaaaacagaacagaaaaactggaaactctaaaaagcagagcacctctcctcctccaaaggttcgcagttcctcaccagcaacagaacaaagcaggatggagaatgactttgacgagttgagagaagaaggcttcagacaatcaaactactccgagctacaggaggaaattcaaaccaacggcaaagaagttaaaaactttgaaaaaaaattagacgaatgtataactagaataaccaatgtagagaagtgcttaaaggggctgatggagctgaaagccaaggcaagagaactacataaagaatgcagaagcctcaggagctgatgcaatcaactggaagaaatggtatcagtgatggaagatgaaatgaatgaaatgaagtgagaagggaagtttagagaaaaaagaataaaaagaaatgagcaaaacctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccatcaaagggaagcccatcagactaacagcggatctctcggcagaaaccctacaagccagaagagagtgggggcaaatattcaacattcttaaagaaaagaattttcaacccaaaattgcatatccagccaaaataagcttcataagtgaaggagaaataaaatactttacagacaagcaaatgctgagagattttgtcaccaccaggcctgccctaaaagagctcctgatggaagcactaaacatggaaaggaacaaccggtatcagccactgcaaaaacatgccaaattgtaaagaccatcaaggctaggaagaaactgcatcaactaacgagcaaaataaccagctaacatcataatgacaggatcaaattcacacataacaatattaactttaaatgtaaatgggctaaatgctccaattaaaagacacagagtggcaaattggatagagtcaagacccatcagtgtgctgtattcaggaaacccatctcacatgcagagacacacataggctcaaaataaagggatggaggaagatctaccaagcaaatggaaaacaaaaaaaggcaggggttgcaatcctagtctctgataaaacagactttaaaccaacaaagaacaaaagagacaaagaaggccattacataatggtaaagggatcaattcaacaagaagagctaactatcctaaatatatatgcacccaacacaggaggacccagattcataaagcaagtcctgagtgacctacaaagagacttagactcccacacaataataatgggagactttaacaccccactgtcaaccttaggcagatcaatgagacagaaagttaacaaggatacccaggaattgaactcagctctgcaccaagcggacctaatagacatctacaaaactctccaccccaaatcaacagaatatacatttttttcagcaccacaccacacctattccaaaattgaccacatagttggaagtaaagcactattcagcaaatgtaaaagaacagaaattataacaaactgtctctcagaccacagtacaatcaaactagaactcaggattaagaaactcactcaaaaccactcaactacatggaaacggaacaacctgctcctgaatgactactgggtacctaacgaaatgaaggcagaaataaagatgttctttgaaaccaacgagaacaaagacacaacataccagaatctgtgggacacattcaaagcagtgtgctgagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacagaaaaaaacccttcaaaaaattaatgaatccaggagctggttttttgaaaagatcaacaaaattgatagactgctagtaagactaataaagaagaaaagagagaagaatcaaatagatgcaataaaaaatgataaaggagatatcaccgctgatcccacagaaatacaaactaccatcagagaatactacaaacacctctacacaaataagctagaaaatctagaagaaatggataaattccttgacacatacaccctcccaagactaaaccaggaagaagttgaatctctgaatagaccaataacaggctctgaaattgtgcttaccaaccaaaaagagttggtaagccagccagccatttgacccagccatcccattactgggaccacatggattcacagccgaattctaccagaggtacaaggaggaactggtaccattccttctgaaactattccaatcaatagaaaaagagggaatcctccctaactcattttacgacgccagcatcatcctgataccaaagccgggcagagacacaaccaaaaaagagaattttagaccaatatccttaatgaacattgatgcaaaaatcgtcaataaaatactggcaaaccgaatccagcagcacatcaaaaagcttatccaccatgatcaattgggcttcatccctgggatgcaaggctggttcaacatacgcaaatcaataaatgtaatccagcatataaacagaaccaaagacaaaaaccacatcattatctcaatagatgcagaaaaggcctttgacaaaattcaacaatgcttcatgctaaaaactctcaaaaaattaggtattgatgggacgtatctcaaaataagagctatctatgagaaacccacagccaatatcatactgaatgggcaaaaactggaagcattccctttgaaaactggcacaagacagggatgccttctctcaccactcctattcaacatagtgttggaagttctggcagggcaatcaggcaggagaaggaaataaagggtattcaattcagaaaagaggaagtcaaattgtccctgtttgcagatgacatgattgtatatctagaaaaccccatcgtctcagcccaaaatctccttaagctgataaacaacttcagcaaagtctcaggatataaaatcaatgtacaaaaatcacaagcattcttatacaccaataacagacaaacagaaagccaaatcatgagtgaactcccattcacaattgcttcaaagagaataaaatacctaggaatccaacttacaagggatgtgaaggacctcttcaaggagaactacaaaccaatgctcaatgaaatcaaagaggatacaaacaaatggaagaacattccatgcacatgggtaggaagaatcaatatcgtgaaaatgaccgtactgcccaaggtaatttacagattcaatgccatccccatcaagctaccaatggctttcttcacagaattggaaaaaactaccttaaagttcatatggaaccaaaaaagagcccgcatcaccaagtcaatcctaagccaaaagaacaaagctggaggcatcacactacctgacttcaaactctactacaaggctacagtcaccaaaacagcatgatactggtgctacagtcaccaaaacagcatgatactggtaccagaacagagatatagaccaatggaacagaacagagccctcagaattaattacacatatctacaactatctgttctttgacaaacctgacaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcaataccattcaggacataggcatgggcaaggacttcatgtctaaaacaccaaaagcaatggcaacaaaagacaaaattgacaaatgggatttaattaaactaaagagcttctgcacagcaaaagaaactaccatcagagtgaacaggcaacctacaaaatgggagaacattttcataatctactcatctgacaaagggctaatatccagaatctacaatgaactcaaacacatttacaagaaaaaaacaaacaaccattaaaaagtgggtgaggtatatgaacagacccttctcaaaagaagacatttatgcagccaaaaaacacatgaaaaagtgctcatcatcactggccatcagagaaatgcaaatcaaaaccacaatgagataccatctcacaccagttagaatggagatcattaaaaagtcaggaaacaacaggtgctggagaggatgtggagaaataggaacacttttacactgttggtgggactgtaaactatttcaaccattgtggaagtcagtgtggcgattcctcagggatctagaactagaaataacatttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccattaaaaaatgatgagttcatgtcctttgtagggacatggatgaagatggaaaccatcattctcagcaaactatcgcaaagacaaaaaaccaaacaccacatgttctcactcataggtgggaattgaacaatgagaacacatggacacaggaaggggaacatcacactccagggactgttgtggggtggggggagaggggagggatagcattaggagatatacctaatgctaaatgacgagttaatgggtgcagtacaccaacatggcacatgtatacataggtaacaaacctgcacattgtgcacatgtaccctaaaacttaaagtataataataacaaaataaaaaaatatttaaaaaaaagaaaaacgatgtcaccaaacaaacaaaacaacataccagtaattggcactaaacggatgcagacataaaatccacctgacaagaaaatcaagagaactgttctaaagccactaatcaaccaaccaaaaaaatcgtagagaagacccaaacaaacaaaatcagaattgaaaaaggagacaacaactgagaccacagacatacaaagaatcattagtgactattatgaacaactatatgacaatttggaaacctaaaagtaatggataaattaccagacatataaacctaccaagattgaaccaagaaaaaaacataaaacctcaacaaattaataatgagtaacaagagtaaggtcataataaaattctcacttcaaagaaaatcccaggaccagatagactcactgatgaattctaccaaacatcaaaagaacaacaaatatgaattgagtctactaaaatccttcaaaaaaattaaacagcaaggaatgcttccaaactcattctaacatggcagcattaccctgacaccaaaaccaggcaaggacacatgaaaaaagaaaactaaaagccagtattattaacatatatgcaaaatcctcaacaaaatactagcaaaccaaattcatcaacaccttaaaagatcattcaccatgatcaagggggattcctcccaggaatacaaggatagttcaacacgtgcaaatcaataaacatgatacatcacattaacagaaccaagaattaaatagatttaaataaatgatgaaaaaatatttgacaaaactcaacatcctcttatgaaaaatatcctcaacaaactaagtatagaaggaacatacctcaaaataataaaggccatatgtcacaaacccacagctaacattatactgaacagggaaaaatggaaagcctttcttctaaggtcttaaacaaaacaaggatgcccgcttttaccacttttattcaacataatatcaaaagtcccagccagagcaattaggcaagagaaacaaataaagggaatccaaattggaaaggaagaagtcaaattctcttgtttgcataagataacttttttcgtgggagtttaatcttttcactgacaagtaagctttattatatgtcaaatcaacattttagagttttttcattgacacattatatttacatgtttattgggtatatgtgagcgtttgttacatgcatggaatgagtgataatcaagccagggtaatttggggtatccatcaccatgcatgtatgcatgtttatcatttttaggtgttttatcatttctagtcttctagttactttgcaatatacataatagtattgctacatatggtcaccctagtctgctatcaaacattaggatgatttcttcaatctaactgcatgtttgtatccataaacaacctctcttcacctccctttcccagtttctgatatctatcctattcttgatgtccatgagatcaagtttttacatcccacatatgagtgagaacatgtggtatttatctttttgtgcttcccttacgtcacttatcataataaaacccatttccatccatgttgctggaaaaggattccactctttttaatggctgaatagtgtatgtgtatatatgtgtatgggtatttgtgcaggtatgggtacctatgggtgtgggtgtaggtgtgtatccagaaaacaaatagtacatataaacacatacatgtacatgcatgcatgtgcacacacacactcacacacacacaccatttttcttgtccaatcagccattgatgaacacttaggttgattccatatctgttctattgggaatagcattgtgataaacctgtgagtcaaatgtatccctttgagaaaataatttcttttcttttggatagataccctgtagtgagattgctgcatcatgtagtagttctagatttagtttttctgagaaatatctatactgctttccataatggttgcactaatttacattcccaccatgtctaagagtacccttttctctgcaacctcaccagcatctgggtgtgtgtgtgtctgtgtgagtgtgtgcatctgtcaataataaacattctgtggtgagataatatctcattgtggtttttatttacaatccctgataattagtgttgagcatttttcatatactattggtcttttgtaagtcttcttttgaaaaatattgttcatttttagtgggattgtttggttttctatagttgaattgttattcttgtatagaatacatattagtcccctttggatgagcactttgcaaatattttctcccattcaagtgatttgcacttcccttgtaataggtgatgttgagcagattttcatatacctattagccatttgtacatctttttttaggtaagattttatttattatgatgggtgtgcttgcctgttcctaagttcattccagtctggaacataggaagataatgctacctgcatagctgctacaccattcagccatttctttcctttgtttttaactgggttaagatagaaaaccctagttcacacaaactagttgttgtgaatggtagtaatagcaggacactctttctatttaacaatggaaagtcttcctttaccttattccaaaatgctgataagcttaaggtctcataatcattctttaatgtatatgaagaactaaactgcaataattcattctcttcttcaggcaccaagtttagctcaattattgattcagggttttgaaaagcaaatggatattttacccaactgttttcccttaatgtttcaaatttttcttctggaaagaaacggttaaaagtttgagataggtcacttccaagatggcctaataggaacagctccagtctacagctcccagtgagatcgatgcagaagatgggtgatttctgcatttccaactgaggtacctggttcatctcattgggactggttggacagtgggtgcagcccatggagggtgagccaaagcagggcagggcatcacctcacccaggaagtgcaaggggttgggggatttccctttcctagccaaggaaagctgggagtgactgtacctggaggaatggtacactcctgcccaaatactgcacttttcccagggtcatcacaaccagcagaccaggagattccctcccaagcctgactagacaggtcccacacccatggagccttgctcgctgctaatgcagcagtctgagatcaacctgggatgttggagcttggcagggggaggggcatccactactactgaggcttgagtaggcagttctatgcccacagtctaaacaaagcaacagggaacttcaaactgggcggagcccaccacagctcagcaaggcctactgcctctctagattccacctctaggggcagggcatatctgaacaaaaggcaggagacagcttctgcagacttaaacctccctgcctaacagctctgaaaagagcagtggttctcacagcacagagttcaagctctgataatggacagactgcctcctcaagtgggtccatgaccccatgattcctgatggggagacacctcacagtaggggccgacagacacctcatacaggcaggtgtccctctgggacaaagcttccagagaaaggatcaggcagcaatatttgctgttctgcaacctccactggaaatacccaggcaaacctggtaatactccagggtctggagtggacctccagcaaactccaacagacctgcagatgaggggcctgactgttagaaggaaaactaacaaacagaaaggaatagcatcaacatcaacaaaaaggacatccacaacaaaaccccatccataggtcaccaacatcaaagaccaaacgtagacaaaaaccacaaaaatggggagaaaccagagcagaaaggctgaaaattccaaaaccaaaatacctcttctcctccaaaggaacacaactcctcaacagcaagggaataaaactggatggagaatgagtttgacaaattgacaaaagtagtcatcagaaggtcggtaataacaaacttctctgagctaaaggagcatgttctaacccattgcaaggaaactaaactttgaaaaaaggttagacgaatggctaactagaataccagtaaggagaagagcttaaatggcctgatggagctgagaaccacagtatgagaccttcatgaagcatacacaagcttcaatagccgattagatcaagtggaagtaaggatatcagtgattgaagatcaaattaatgaaataaagtgagaagacaagactagagaaacaagggtgaaaagaaacaaataaagcctccaataaacatgagactatatgaagaccaaatctatgtttgattggtgtacctgaaagtgatgggagaatggaaccaagttagaaaacactcttcaggacattatccaggagaacttccccaacgtagcaaggcaggccaacattcaacttcaggaaatagagagaacaccacaaagatactcctggagaagagcaaccccaagaaacataatcatcatattcaccaaggttgaaatgaaggaaaaaatgttaagggcagccagagagaaaagtcaggttacccacaaagggaagcccatcagactaacagcagatctctcagcagaaaccctacaagccagaagagagtgggggctaatattcaacattattaaagaaaaaatttttaacccagaatttcatatccagccaactaagcttcataagtgaaggagaaataaaatcctttacaaacaagcaagtgctgagggattttgtcaccatcaggtgtgccttaaagagctcctgaaggaagcactaaatatggaaaggaaaaagtggtaccagccactgcaaaaacaaaccaaaatgtaaagaccatcgacactatgaagaaaccgcatcaactaatggggaaaataacctgctagcaccataatgacaggatcaaattcacacataacaatattagcattaaaggtaagtgggctaaatgccccaattaataggcacagatgggcaaactggatgaagagtcaagactcatcagtgtgctgtattcaggagacccatctcaagtgcaaagacacacttatgctcaaaataaagggatggagaaatatttaccaagcaaatggaaagaaaaaaaaacagagtttacaatcctagtctctgataaaacagactttataatacaggagcacgcagattcataaagcaagttcttagagacctacaaagagacttagactcccacacaataatagtgggagactttaataccccactgtcaatattagacagaccaatgagacagaaaattaacaaggatattcagcacttgaactcagctctgaaccaggtgggcctaataaacatctacagaactctccacctcaaataaacagaatatacattcttctcagcaccacatagcacttattctaaaatcgaccacatagtggttccaagatggccgaataggaacagctccagtctacagctcccagcatgagtgacgcagaagacaggtgatttctgtatttccaactgaggtaccaggttcatctcactggggtgtgtcagacagtgggtgcaggacagtgggtgcagcccaccaagcaagagccaaggcagggtgaggcatcacctcccctgggaagtgcaaggggtaagggaactcactttcctagccaagggaagccatgacagacagcacctggaaaattgggtcactaccaccctaatagtgcacttttccaatggtcttagcaaacagcacaccaggaaaatatatctcgtgcctggctcagagggtcccatgcccacagagcctcactcattactagcacagcagtctgagatctaactacaaggtggcagtgaggctggggggaggggtgactgccattgctgaggcttgagtaggtaaacaaagcggccaagaatctcaaactgggtggagcccaccacagctcaagaagacctgactgcctctgtagactccacctctgggggcagggcatagctgaacaaaaggaagcagaaacctctgcatatttaaatgtccctgtctgacagctttgaagacagtactgattttcccagcatggagtttgagatctgagaatggacagactgcctcctcaagtgggtccctgacccccaagtagcctaattgggaggcactccctggcaaacagggtctggagtggacctccagcaaactccaacagacctgcagctgagggttctgactgttagaaggaaaacaaacagaaaggacatccacaccaaaaccccatctgtatgtcaccatcatcaaagaccaaaagtagataaagccacaaagatggggaaaagacagagcagaaaaactggaaactctaaaaatcagagcacctctccccctccaaaggaaggcagctccttgccagcaacagaacaaagctggatggagagtgactttgacaagttgagagaagaaagcttcagatgatcaaccttctccgagctaaagggggaagtttgatcccattgcaaacaagataaaaaccttgaaaaaagattaggtgaatggctgactgaataaccagcatagagaagtccctaaacgacctgacggagctgaaaaccatggctcaagaactatgtgatgaatgtgcaagcttcagtaactgattcgatcaactggaagaaagggtatcagtgattgaagatcaaacgaatgaaatgaagtgagaaaaggagtttagagaaaaaagagtaaaaagaaatgaacaaagcctccaagaaatatgggactatgtgaaaagaccaaatctacatctgattggtgtacctgaaagtgacaaggagaatggaaccaagttggaaaacactctgcaggatattatccaggggaacttgcccaacctagcaaggcaggccaacattcaaattcaggaaatacagagaacaccacaaagatactccttgagaacagcaactccaagacacataattttcagattcaacaaagttaaaatgaaggaaaaaatgttaagggcagccagagagaaaggttgggttaccatcaaagggaagcccatcagagtaacagtggatctctcaacagaaactctacaagccagaagagagtgggggcaaatattcaacattcttaaagaaaagaattttcaacccagaattgcatatccagccaaactaagcttcataagtgaaggagaaataaaatactttacagacaagcaaatgctgagagattttgtcactaccaggcctgccctaaaagagctcctgatggaagcactaaacatggaaaggaacaatcggtaccagccactgcaaaaacatgccaaaatgtaaagaccatcaatgccaggaagaagctgcatcaactaacaagcaaaataaccagctaacatcataatgacaggatcaaattcacacacaacaatattaactttaaatgtaagtgggctaaatgctccaattaaaagacacagagtggcaaattggataaaaattcaagacccatcagtgtgctgtactcaggagacccatctcacatgcagagacacacacaggctcaaaataaaggaatggaggaagatctaccaagcaaatggaaaacaaaaaaaggcaggggttgcaatcctagtctctgataaaacagactttaaaccaacaaagatcaaagagacaaagaaggccattacataatggtaaagggatcaattcaacaagaagagctaactatcctaaatatatatgcacccaatacaggagcacccagattcataaagcaagtccttagagacttacaaagagacttagagtcccacacaatactaatgggagacttcaacaccccactatcaacattagacagatcaatgagacagatagttaacaaggatattcaggaattgaactcagctctgcaccaagcagacctaatagacatctacagaaccctccaccccaaatcaacagaaaatacattcttctcagcaccacatcacacttattccaaaactgaccgcatagttggaactaaaacactcctcagcaaatgtaaaagagcagaaattataacaaactctttctcagaccacagtgcaatcaaactagaactcaggattaataaattcacgcaaaaccactcaactacatggaaactgaacaacctgctcctgaatgactactgggtacataacgaaatgaaggcagaaataaagatgttctttgaaaccaacgagaacaaagacacaacataccagaatctctgggacacatttaaagcagtgtgtagagggaaatttataacattaaatgtgcacaagaaaaagaaggaaagatctaaaattgacaccctaacatcacaattaaaagaactagagaagcaagagcaaacacattcaaaagctagcagaaggcaagaaataactaagatcagagcagaactgaaggagatagagacacaaaaaacccttcaaagaatcaatgaatccaggagctggttttttgaaaagatcaacaaaattgatagactacgagcaaaactaataaagaagaaaagagagaagactcaaatagatgcagtaaaaaattataaaggagatatcaccaccgatcccacagaaatacaaactatcatcagagaatactataaacacctctacacagataaactagaaaatctagaagaaatggataaattccttgacacatacaccctcccaagactaaaccaggaagaatttgaatccctgaatagatcaataacagcctctgaaattgaggcaataattaatagcctaccaaccaaaaaaagtccaggaccagatggattcacagctgaattctaccagaggtacaaggaggagcttgtaccactccttctgaaactattccaatcaaaagaaaaagagggagtcctccctaattcattttatgaggccaacatcatcctgataccaaagcctggcagagacacacacacaaaaaaatttcaggccaatattcttgatgaacatccatgtgaaaatcctcaataaaatactggcaaacagaatccagcagcacattaaaaaacttatccaccatgatcaagttggcttcatacctggggtgcaaggctgcttcaacatacacaaatcaataaatgtaatccatcatataaacaaaaccaatgacaaaaaccacatgattatctcaatagatgcagaaaaggccttcaataaaattcaacaccccttcatgctaaaaacactcaataaacttggtattgattaaacacatctcaaaataataagagctatttatgataaactcacagccaatatcatactcaatgggcaaaacctggaagcattccctctgaaaactgacacaagacaaggatgccctctgtcaccactcctattattcaaaatagtattggaagctgtggccaaggcaatcaggcaagagaaataaataaatggtattcaaataggaaaagaggaaatcagattgtctctgtttgcatatgacatgattgtatatttagaaaaccccattgtctcagcccgaaaaactccttaagctgaaaaacaacttcagcaaagtctcaggatacaaaatcaacgtgcaaaactcaaaagcattcctgtacacaaataatagacaagcagagagccaaatcatgagtgaactcccattcacaattgctacaaagaaaataaaatacctaggaatacaacttagaagggatatgaaggacctcttcaaggagaactacaaaccactgctcaaggaaataagagaggacacaaacaaatgaaaaaactttccatgctcatggatggaaagaatcaatattgtgaaaatggtcatactgcccaaataatttataaattcagtgctatcctcatcaaactaccattgacttttttcacagaattagaaaaaactactttaaagttcatgtggtaccaaaaaagagcccatataaccaagacaatcctaaacaaaaagaacgaagctgaaggcatcacgctacctgacttcaaactataatacaaggctacagtcaccagaacaacatggtactggtaatgaaacagatatatagaccaatggaacagaacagaggcctcagaaataccaccacacatctacaaccatctgatctttgacaaacctgacagaaacaagcaatggggaaaggattccctattcaataaatggtgctgggaaaactggctagccatatgcagaaaacagaaactggacccatttacaccttatacaaaaatgagctcaagatggattaaaggagggaggagccaagatggccgaataggaacagctcctgtctacagctcccagcgtgagcgatgcagaagacaggtgatttctgcatttccatctgaggtaccgggttcatctcacttgggagtgccagacagtgggcgcaggtcagtgggtgtgtgcaccgtgcgcgagccaaagcagggcgaggcattgcctcacttgggaagcgcaaggggtcagggagttcactttccgagtcaaagaaaggggtgacagacacacctggaaaatccggtcactcccacccaaatactgcgcttttccgactggcttaaaaaacggcgcaccacgagattatatcctgcacctggctcggagggtcctatgcccacggagtctcgctgattgctagcacagcagtctgagatcaaactgcaaggcggcagcaaggctgggggaggggcgcccgccattgcccaggcttgcttaggtaaacaaagcagctgggaatctccaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaaccggcagactgcctcctcaagtggctccctgaccccgagcagcctaactgggaggcaccccccagcaggggcagactgacacctcacacggcaatgtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagtgcctctcctcctccaaaggaacacagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaagccaaggctcgagaactacgtgaagaacgcagaagcctcaggagccaatgcaatcaactggaagaaagggtatcagtgatggaagatgaaatgaatgaaatgaagtgagaagggaagtttagagaaaaaagaataaaaagaaatgagcaaaacctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccatcaaagggaagcccatcagactaacagcggatctctcggcagaaaccctacaagccagaagagactgggggcaaatattcaacattcttatagaaaagaattttcaacccagaatttcatatccagccaaactaagcttcataagcgaaggagaaataaaatactttacagacaagcaaatgctgagagattttgtcaccaccaggcctgccctaaaagagctcctgaaggaagtgctaaacatggaaaggaacaaccggtaccagccactgcaaattcatgccaaaatgtaaagaccatcgagactaggaagaaactgcatcaactaacgagcaaaataaccagctaacatcataatgacaggatcaaattcacacataacaatattaactttaaatgtaaatggactaaatgctccaattaaaagacacagactggcaaattgcataaagagtcaagacccatcagtgtgctgtattcaggaaacacatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaacacaggaggacccagattcataaagcaagtcctgagtgacctacaaagagacttagactcccacacaataataatgggagactttaacaccccactgtcaacattagacagatcaatgagacagaaagtcaacaaggatacccaggaattgaactcagctctgcaccaagcagacctatagacatctacagaaccctccaccccaaatcaacagaatatacatttttttcagcaccacaccacacctattccaaaattgaccacatacttggaagtaaaggactattcagcaaatgtaaaagaacagaaattataacaaactatctctcagaccacattgcaatcaaactagaactcaggattaagaatctcactcaaaaccactcaactacatggaaactgaacaacctgctcctgaatgactactgggtacctaacgaaatgaaggcagaaataaagatgttctttgaaaccaacgagaataaagacacaacataccagagtctctgggatgcattcaaagcagtgtgctgagggaaatttatagcactaaatgcccacaagagaaagcaggaaagatccaaaattgacaccctaacatcacaattaaaagaactagaaaagcaagagcaaacacattcaaaagctagcagaaggcaaggaataactaaaatcagagcagaactgaaggaaatagagacagaaaaaacccttcaaaaaattaatgaatccaggagctggatttttgaaaggataaacaaaattgatagaccgctagcaagactaataaagaaaaaaagagagaagaatcaaatagacgcaataaaaaatgataaaggggatatcaccaccgatcccacagaaatacaaactaccatcagagaatattacaaacacctctacgcaaataaactagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtataaggaggagctggtaccattccttgtgaaactattccaatcaatagaaaaagagggaatccttcctaactcattttatgaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaacatacgcaaatcaataaatgtaatccagcatataaacagaaccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagagagggatgccctctctcaccattcctattcaacatagtgttggaagttctggccagggcaatcaggcaggagaaggaaataaagggtattcaattaggaaaagaggaagtcaaattgtcccagtttgcagacgacatggttgtatatctagaaaaccccactgtctcagcccaacatctccttaagctgataagcaacttcagcaaagtctcaggatacaaaatcaatgtacaaaaatcacaagcattcttatacaccaacaacagacaaacagaaagtcaaatcatgagtgaactcccattcacaattgcttcaaagagaataaaatacctaggaatccaacttacaagggatgtgaaggacctcttcaaggagaactacaaaccactgctcaatgaaatcaaagaggatacaaacaaatggaagaacattccatgctcatgggtaggaagaatcaatatcgtgaaaatggccatactgcccaaggtaatttacagattcaatgccatccccatcaagctaccaatgactttcttcacacaattggaaaaaactactttaaagttcatatggaaccaaaaaagagcccacattgccaagtcaatcctaagccaaaagaacaaagccggaggcatcacactacctgacttcaaactatactacaaggctacagtaaccaaaacagcatggcactggtaccaaaacagagatatagatcaatggaacagaacagagccctcagaaataacgctacatatctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttacatgttagacctaaaaccataaaaacccaagaagaaaacctaggcaataccactcaggacataggcatgggcaaggacttcatgtctaaaacaccaaagcaatggcaacaaaagacaaaattgacaaatgggatctaattaaactaaagagcttctgcacagcaaaagaagctaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcatcaccactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcaattcctcagggatctagaactggaaacaccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaatatgtggcacatatacaccatggaatactatgcagccataaaaaatgatgagttcatgtcctttgtagggacatggatgaaattggaaatcatcattctcagtaaactatcgcaaggacaaaaaaccaaacaccgcatattctcactcataggtgggaattgaacaatgagatcacatggacacaggaaggggaatatcacactctggggacagttgtggggtggggggaggggggagggatagcatcgggagatatacctaatgctagatgacgagttagtgggtgcagcgcaccagcatggcacatgtatacatatgtaactaacctgcacaatgtgcacatgtaccctaaaacttaaagtataataaaaattaaaaaaattaaaaaaaaaagatggattaaagatttaaatgtaagaactaaaaccataaaaaaccctagaagaaaacctaggcaataccattcaggacataggcatgggcaaagacttcatgactaaaacaccaaaagcaattgcaacaaaagccaaaattgacaaatggggtctaattaaactaaagagcttctgcacagcaaaagaaatgatcatcaaagtgaacaggcaacctacagaatggaagaaaatttttgcaatctatccatctgacaaagggctaatatccaaaatctgcaaggaacttaaacaaatttacaagaaaaaaaaaaacctcatcaaaaagtgggcaaaggatatgaacaggcacttcacaaaagaagacatttatgtggccaacaaacatgtgaaaaaaagcccatcatcactagtcattggagaaatatgaatcaaaaccacaatgagataccatctcatgccagttagaatggttatcattaaaatgtcaggaaacaacagatgccagagaggatttggagaaataggaacattcttacactgttggtgggagtgtaaattagttcaaccattgtggaaaacaacgtggcaattcctcaaggatctagaaccagaaataccatttgacccagctatcccattactgggtatatgcccaaaggattataaatcattctactataaagacacatgtacatgtatgtttattgcagcactattcacaatagcaaagacttggaaccaactcaaatgcccataaatgttagactggataaagaaaatgtggcatatatacaccatggaatactatgcagtcataaaaaagaatgagttcatgtcctttgcagggacatggatgaagctggaaacaatcattctcagcaaactaacacaggaacagaaaaccaaacactgcatgttttcactcatcagtaggagttgaacaatgagaacatatgggcatagggaggggaaaatcacacaccagggcctgtcatggggtggggtacaaagggagggataacattagaagaaatacctaatgtagacaatgggttgatgggtgcagcaaaccaccatggcacatgtatgcctatgtaacaaacctgaacgttctgtacatgtatcccagaacttaaagtataataaaaaataaatatgtaaataaataacaaataaataaataagagtaaagtatcaatttggtggtgaagtataatgatcataagtagaaaaattcaattgtgggaaggaaggtggcccatttttctttcagttgcttgtgggcggtagaggcattcttcaagcacctaattaatacttccattctggttatcattctgcattaggatggccagtgacctttttttcatttactggtgcattataatattttttcaaattaaattttataaaagaaaaagaaaccagtctaagacctgatgattatactttatgtcagaagggaaatatttgaaattatggaaaatcatatctcccaattgtattagagctccttcaggacaggcatactcatagccccttgaaaggaagctctttcaacaatcttcctctaagcaacatagctatcaataattttggatagtcatcttatataaaacaagacctaattaatttattgaattaagttccctggaccaggttcctagaccaaggtggtgcctgaaacaaggacagattattcatgtatcatcaggtgatttacaggacaaattggcacaaaaatcactatggaaagaggtatccaactgtactccttcagctgctcttgcaaaagtccacactcattcccaagcagcatgcctctaaacatgtgaactagtctatctcctataacttcctcttatatacattctgcctagtgttaccccttcatctatcacttgcatttatgaatcttataatctgagctgggaactaaaacatatgaaagaggttctagattcctacttttaccactaccaactcaagcatctaatataagtcaagtgtttgacagcagcagttgtagaaactagtcaccaacctaaattatgtcattcaaaggcaccagggaccttcaataggcacattcagagagcctctgaatggacttctactttccatgttataatctgtaaagggaaatcagtggatgccttgtcagcaagagattcacatttcttttgtttgttcctctccagtttttacaatcctccaattactgacactattcctctcaaatttgctatctgacatttgtccttggatgtggcactggtatttcattaacagatactaggtccaggtgaagatgagactgctcacatgcacttccttaaacatggctctcaagtacagtttctctccatttgtaaacctgtgaactaaacagataagctttctgtcccctacacattactcagacagtggagtgatgagcatagtataaccaacacatacatttttattcaaagagatgtaatgcaaagtacagagaagtcattgatccagaacagttctgaaacccagctgggcaaatgttgcaggttccatgactaagactcatccatatcttccccaagagttgttctatatgactcctggctacatcctcccagctctttgttctgccttctaagtcatcctttcattttcattaaaactgacgtatagctgaagacatagttttctcagcctgattcttatcagtaatgtttgaagatccaatggtctgttttcattgcctgctctctctgtccatttctgtccaaactggtagtgtttctcctgatataattctattaaaaatttcctgggtctcctttgaatctttttggagggtctgctcattaaataaaagacatctaaaaatcttcccaagtaagcccatctcttcattatgcttctatcaagaaacaatgcccttaagcttcttaaaagtgatgtttttattgaaagaatctgtgagtcatgacatcgaaatatttagagaaccttttgaactgagtaataatctggggcatcatgtaagacagctttgatgttttaacaaaggttttttttaaatttgtgtgggtacatggtaggtgtatatatttatggagtacataagatgttttgatacaggcatgaaatgtgttataattacatcatggagaatgacgtattcatcccctcaaccattaatcctttgtgttacaagcaattcagttgtactcttttagttattttatgatgtatagttaacttatttttttttttttttttttttttttttgagacggagtctcgctctgtcgcccaggctggagtgcagtggtgggatctcggctcactgcaagctccgcctcccgggttcacgccattctcctgcctcagcctcccaaggagctgggactacaggcgcccgccactacgcccggctaattttttgtatttttagtagagacggggtttcaccgttttagccgggatggtctcgatctcctgacctcgtgatccgcccgcctcgtcctcccaaagtgctgggattataggccaattaacttattattgactatagtcactctgttgggctatcaaatactaggtcttattcattcattccattttttgtactcattaactacccctacctcccaacaaccccagtcctcccactatattccccagcctctggtaaccttccttctgctctctatctccatgagttcaattgttttgatttttagatctcacagataagtgggaacatgtgatgcttaccttgctgaggcttatttcacttagcataatgaactccagttccgtttaacaatggttttttttttaacattcaactcccaacttattcatgtttgacatttccttcttttctctctttgcttgcattttactctaagcagcaatatgaaatcaggctgtatttttagtgctttacccagaaattccccaacaacacccagttcattaggcatgttttctgcgttccacataccatatggaagaatattgctaaacatctgccattcataacaagaagtcctttcctccagtttccatgtttttcacattgctttaagtctcactcacaactgcctaaaaatcacataatgcttctaaaaatattttcaaggctgttcaagctttatataactttctcatcaaaatctttctagttgcagaccactgcctgcttccaaaccactttcacgtgtgcagatattattaggatagcactctgctcctagtatgaagagatgtatgaattacttatcactgcaaaacaaatcatcccaatacctagccacttataccacaaacatttacctcacacagtttctgaaggtctagcatcctaaagcaacttagccagatacctctggttcaaggtcttttatgatgttgcagtcaaggtgtcagcaggggttgaatttgtctaaaggactgactggtgctggaggatctgcttcaagatggctcactctctagctgctgttggaagaaggcttcagttccttgccacaaaggcctgtcctcagggaatgtcctcatggtatggcatcttgctttcctaggagtaaataacccaagaggcagagcaccctgccttcttatgactgtctgcaaagccacacaccatcacttctgttttgttcagttactcagaagtgagtcaccacatccagcccacactcaagtagaagagaattaagctctaatttttaaagacaggattattaaactataagtgcatatatttcttttcaaaaccacaaactgcatcactgttcaacttctacctttgcccagtcttgtgttccttatatgcttacaaatgttggttctaagagcacccgaaaaaaaccttcctgcatgtacatttctgcctcagactctctttctcagtgaaccaacccaaagaaacctatggcaatggctaacaaaacacagcaatgctttgtgcaaaatagatgggctaccaacaagagtattactattatatacaatcaaaagaagtcaggaaagataatcaacaatttgagggcagattgccccataaaaaattatggtttcttttttaatttccacatcagagccgggtctcagaacccaaagccactggatgaaggagaagttgtatccctagaaggaagacctctgaaacaccagagtaattgcatatttaaatgattcctccagaccttcccaaagaaatctatgccatttacttgcatgaacatgcactggaaacattctgaggactgctgagcacagagttcatggtggcataaatattcagggactcaaagagtcatcatgctgccattttaaagcaggagttttgggagtgacataatagaggatcacaaccaaggcctcaaaggagttattcccccattccttcctgaataatgggattcaccatacttgatgacgtgcagaacacccacaggtccttgacctgtggaataagaactaccaaggtgaaaaaagtcaagtggacacaagaaaactgtatctcactccctcctaaaatagtaaatcaaaaataacagtgtgttcctagtgaataacaacttttctacccttaaaagcttaaagtacacaggggttgtagtctccagtatgtctccatctaattgcttggagggccagacttaagtccatttgagtctggccctacaaataattgacagattgtcttagtctatttagtgttgctataatagaatatgtgaggctaagtaatttataaagagaagaggtttatttagcacccagttttgtgggttagcaagttcaagggtcttaccatggcttctggcaagggctttcatgttgcatcctaatatgacagagaaggacaaagaggaaatgcacatgtttgaagaaacaaaacccaaggggcaccctgacttgtaacaaccatctcagctccagagctccccatagcttggcctttgctgtaactgcatcacagttcagcttctccctctgcccaatcctgttcctccaccttccccagtaaatttcatgcccacaaacctcagactcagagtctgtttcgcagggagcctggtcagtagattctgtataatgttggactgaaatgaaactataaaaactgaaaaccccaaaacacatatttcctgtagagaaggggaagatctgttaacaggttctacccatgtgtctcactacgaaacttctttaaggaattccagccatgaagctagacagaaggaccagctgttgttcattagagcatattctgggtactgttggaagaaaaagagcaaggaactaagattgtgaggtgtaccatggtcctgtgctgtttccatccacctgacaccttcacttccttcaccacaatgatcacatggctctggagaactgaccaatcacgttattttgaagcttatgttatgaagccctaaatccatctgtactgttttctactccaggatttgatagtcacttaaaccaggaagttcctcactttgcttaaggtattttgtttgctgtcccttgcaactaagagagtcctaacacaggtctacttgttagccctgggaattcctagagagattagactaatgaagcctctaacaggttcatttctcatatttggaaatagacagatcactaaagccacacacacccttttctttctatacttttcttaatatcatacatctgccaggctccttgtgttaagagtctgggtgtatgttcttgatggacaagccctgatgagccttgcccacacccctttccaagcccagccttgtagagcagtagtcctaagtgtgagccgccaaaaccctgtttaatcaatgatctataggcagttatcagagtgctgttctcctgttgccccgtgaagtgacagggctttggggaatgtgctcagggctgcagtggacccctctccacagggtacagaggtatggaagaacagagtccttggcatctgcatttgagcaagacacagaaatttcttgttatatttccctcagctgagatggtggtaaagtttgctaccactacagttgtgtcagactgggctccctgagacattaaagctgccctcttgataggtttcactatccaggcaagttctgccacagccacaaagttggcagtctctgtgctacatcaataccaaaagactaattaacactaaggagtttctgaggttccacagatttctacttcctccctggactgaattctcaccccagccctcataaacaagacacgccttcttgcttccactcttgtaagcagaaattgaatgtgggtaatcaaaactcagtgtctataccctgcagacaactaccatcccaagggtgccaacaatcagttttgtaagtttatcctactcactgatatatgctactactcacctgatagtgggattatatgcagttgactctgcccctgctagagagccctgtggatggcacagccctttgccatggcccaaattgtctctattgtgatgcatcattggtccttaattacccatttcctctgcttttctcttggtccattgtgaatcagcactttatttcagtttccttattctataaatgttcactcagttaaagcaccgccaaagctggttgaagggggagtctgttgaaaagggccacaaagtctgcaatagtagaaataatggagatgaacccatagccatggagtgagggaatatcctcatcgagttgtttctaaaatgtgcaaaacagtgcctggcacagtgggaacacttgaatgtcaccactgttgtcattattttattcctactgactctgttggcaaagcatgtcaatgaaggcttccaatctaacaggtgcctctgcagctttcaatcggagctgctgcatttattttatccctttttcacattggacagctcagtggtacactccagaagatggggttctgctgcaaaagaaaagtgtagctctggaaaatcagtggaggctacagttcctcatctttccaacacagaacctacagccaactctgaccacagctcatgggttcaggcaaagctgggggcagccacctttcattaggacaaaaagacaggaaacctgtggcatccacttatttgttttcaaaagcccttctttttgaagcaaagcttctttttgaagtaccaaaaattaatcatttacaaagcatcccccatatttttataaactcagaaatgttttagctttgaagttgaaatttaatattttttaaacaaatgtaaaaattgatctttttatatttcacctagaaaactgaataagctgaattaccaggaatatttttttcactttcatttttaagtaaaaactttgcaacggaaaacaaaatagtacgtagaaatattttgtaaactataaggtattttgaaaacactaattacatgttgttgttttttacttcaagttctgggatacatgtgctgaacatgcaggtttgttacatagccatacacgtgccatggtggtttgctgcacccatcaacccgtcatctaggttttaagccctgcatgaattaggcatttgtcctaatgctccccctcccctttctgcccaccccctgacaggccctggtgtgtgatgttctcctccctgtgtccaagtgttctcattgttcatctcccacttatgagaacatgcagtgttcggttttctcttcctgtgttagcttgctgagaatgatggtttccagcctcatccatgtccctgcaaaggacattaactcattcctttttatggctgcataggattccatggtgtatatttactacattttctttatccagtctaacattgatgggcatttgggttggttccaagtctttgctattgtgaataatgctgcaataaacatacatgtgcatgtgtccttatagtagaatgatttataaccttttgggtatatactcagtaatgggattgctgggtcaaatggtatttctggttctagatccttgaggaattgccacactgtcttccacagtggtcaaactaatttacactcccacaaacagtgtaaaagctttcctatttctccacatcctcaccagcatctgttgttcccagactttttagtgaccaccattctaactgacgtgagatggtatctcactgtggttttgattttcatttatctaaagaccagtgatgatgagctttacttcatatgttttttggccgcataaatgtcttcttttgtgaagtgtctgttcatatccttcacccacttttcgatggagttgtttgttttttcttgtagatgtgtttaagttccttgtagattcagaatattagccctttgtcagatggatagattgcaaaaattttctcccattctgtaggttgcctgttcactctgatgatagtttcctttgctgtgcagaagctcttagtttaattagatcccatttgtcaattttagaattttagtttttgttgcaattgctttttgtgttgtagtcattaagtctttgtccatgcttatgtcctgcatggtattgcctaggttttcttctagggtttttatggttttaggttttatgtttaagtctttaatccatcttgagttaatttttgtataaggtgtaaggaagggatccagtttcagttttttgcatatggttagccagctttcccagcaccaattattaaataagaaatcctttccccattgcttgtttttgtcaggtttgctgaagatcagatatttgtagatgtgtgatgttatttctgaggcctctgttctgttccattggtctatatatctgttttgataccagtaccatgctattttggttactgtagccttgtattatagcttgaagtcaggtagtgtgatgccttcagctttgttctttttgcttaggattgtcttggctatgcagcctcttttttggttccatataaaatttaaagtatttctttctaattctgtgaagaaagtcaatggcagcatgatgggaattgcattgaatctataaattactttgggcaatatggctattttcatgatattgattcttcctatccatgagcagggaatgtttttccatttgtttgtgtcctctcttattgagcagtggtttgtagttctccttgaagaggtccttcacatcccttataagttgtattcctaggtattttattttctttgtagcaattgtgaatgggagttcactcatgatttgcctctctgttcatctattattggtgtataggaatgcttgtgatttttgtacattgattttatatcctgagactttgctgaagttgtttatcagcttaagaagttttgggactgagacaatggggttttctaaatatacaatcatgtcatctgcaaacagagacaatttgacttcctctcttcctgtttaaataccctttatttctttctctttcctcatttccctggccagaagtcccaatactatgttgaataggagtggtgagaaggggtgtgtttgccttgtgccagttttcaaagggaatgcttccagcttttgcccattcagtatgatattggctgtgggtttgtcataaatagctcttattattttgagatatgttccatcaatacctagtttattgagagtttttagcatgaaggggtgttgaattttatcgaaggccttttctgcatctattgagataatcatgtggtgtttgtcattggttctgtttatgtgatggattacatttattgatttgtgtatttgaaccagccttgtatcccagggatgaagccaacttgatcatggtgaataagctttttgatgtgctgctggatttgatttgccagtattttattgaggattttcgcatcaaagttcatcagggatattggcctgaaatgttctttttttgttgtgtctctgccaggttttggaatcaggatgatgctggcctcataaaatgagttagggaggaatcactttttttctattgtttagaatagtttcagaaggaacggtaccagctcctctttgtacctctgttagaattcaactgtgaatccatctggtcctgggctttttttggttgataggctattaattactgcctcaatttcagaacttgttatcaatctattcagggattcaacttcttcctggtttcgtctttggagggtgtatatgtccaggaatttatccattttttctagattttctagttgatttgcatagaggtgtttctagtattctctgatggtagtttgtatttctgtgggaccagtggtgatatcctgtatgtcaggcctctgagactaagctaagccatcatatcccctgtgacctacatgtatacatccagatggcctgaagtaactgaagaatcacaaaagaagtgatatttaaatggcctgttcctgccttaactgatgacattcaactgcaaaagaagtgcaaatggccagtccttgccttaactgatgacattagcttctgaaattccttctggctcatcctggctcaaaaagctccctgactgagcaccttgtgacccccactcctgtctgccagagaacccccctttgactttaattttcctttacctacccaaatcttataaaacagccccacccttatctcccttcgctgactctcttttcagactcagcctgcctgcacccaggtgaaataaacagcctcattgttcacacaaagcctgtttggtggtctcttcacacagaagcgagtgaaattttggtgccatgacttggaccaggggacctcccttgtgagatcaatcccctgtccttctgctctttgatccgtgagaaagatccacctatgacctcaggtcctccgactgaccagcccaaggaacatcacaccaattttaaatccagtaagcgacctctttctactctcttctccaacctctctcactatccctcaacctctttctcctttcaatcttggcaccacacttcaatctctcccttctcttaatttcagttcctttccttttcttgtagaaacaggagatgcattttatccgtggacccaaaactccagcaccggtcacagactcaggaagacagtcttcccttggtgtttaatcatacgcggatgcctgcctgattattcacccacatttcagaggtgtctgacccctgaccccttctctccatttctctaccccttctccacttttatggggggcaagaacacccccaaccccttctctccatgtctctaccccttctccacttttctgggggacaataaccccctgaccacttctctccatgtttcttggggagcaagcaccccccaccccttctctctgtgtctctactctctcttttctctgggcttgcctccttcactatgggtaggcttccaccctccattcctccttctcccttagcctgtgttcttaagaacttaaaactgtcaggcctctgagcccaagctaagccatcatatcacctgtgacctgcaagtacatatccagatgtctggttcctgccttaactgatgacattccaccacaaaagaagttaaaatggcttgttcctgccttaactgatgacattaccttgtgaaattccttctcctggctcatcctggctcaaaagctcccccactgagcaccttgtgacccccacccctgccagccggagaacaacccccctactttgactgcaattttcctttacctacccaaatcttataaaatggccccaccccatctccctttgctgactctcttttcagactcagcccacatgcactcaggtgaaataaacagccttgttgctcacacaaagcctgtttggtggtctcttcacatggatgcaagtgaaaaaaaacctcttcaactcacacatgacctaaaacctaaatgccttattttcttctgcaacaccccttgaccccaatacaaactcgacagtggttccaaatagccagaaaacggcactttcaatttttccatcctacaaaatctacataattcttgtcataaaatgggcaaatggtctgaggttcctgatgtccaggcattcttttacacatcggtccctccatagtctctgctcccaatgcaactcatcccaaatcttgcttctttccctcccacctgtcccctcagtcccaacccaaagcatcactgagtgtttccaatcttccttttctacagacacatctgacctctccccaggctgcccctcaccaggccgagctaggtcccaattcttcctcagcctctgctcccctaccctataatcctttttatcacctcccctcctcacacccggtccagtttacagtttcattctgtgactagccctcccccacctgcccagcaatttcctcttaaaaaggtggctggagctaaaggcatagtcaaggttaatgctcctttttctttatcccaaatcagatagcatttaggctgtttttcatcaaatataaaaacgcagcctagttcatggctcgtttggcagcaaccctgagatgctttacagccctagcccctaaaaggtcaaaaggtcatcttattctcaatatacattttattgcccaatccgctcccgacattaaataaaagtacaaaaactaaattctggccctcaaaccccacaacaggacttaattaaccttaccttcaaggtgtataataataaagtagaggcagctaagtagcaatgtatttctaagttgcaattccttgcctccactgtgagacaaaccccagccatatctccagtacacaagaactccaaacgcctgaaccacagctgccagggtttcctccagaacctcctcccccaggagcttgctacaagtgatggaaatctggccactgggccaaggaatgcccacagcccgggattcctccaaagccatgtcccatctgtgaaggaccccactgaaaatcagactgttcaactcacctggcagccacttccaaagcccctggaactctggcccaaggttctctgactgactccttcccagatcttctaggcttagcagctgaagactgacactgcctaatcaccttagaagcctacaggaccatcacagatgctctaggtaactctcagagtggagggtaagtccatccccttcttaatcaatacggaggctacccactccacattaccttcttttcaagggcctgtttcccttgcctccataacttttgtagatattgatggccaggcttctaaacctcttaaaactccccaactcttatgccaacttagaaaatactcttttaagcactcctttatagttatccccacctgcccagttcccttattaggccgagatattttaactaaattatctgcttccctgactattcctgggctacagccacaccttattgccaccttttcccccagttcaaagactccttcacatcctccccttgtatctccccaccttaatccacaagtataggatgcctctactccctccttggtgaccgatcatgcaccccttaccatctcattaaaacctaatcacccttaccctgctcaatgccaatatcccatcctgcagcatgctttaaaaggattaaagcctgttatcactcacctgctacagcatggccttttagagcctataaactcttcttacaattcccccattttacctgtcctaaaaccagacaagccttacaggttagttcaggatctgcgccttatcaaccaaattgttttgcctatccaccccatggtgccaaacccatatactctcctatcctcaatacctccctctactacccattattctgttctggatctcaaacatactttctttactattcctttgcacccttcatcccagcctctctttgctttcacttggactgaccctgacacccattaggctcagcaaattacctgggctgtactgctgcaaggcttcacagacagcccccattacttcagtcaagcccaaatttcttcctcatctgttacctatctcggcataattctcataaaaacacacgtgctctccctgctgatcctgtccagctgatctcccaaaccccaatcccttctacaaaacaacaactcctttccatcctaggcatggttaatgcagtcagaattctcacacaagagccaggaccgtaccctgtagcctttctgtccaaacaacttgaccttactgttttagcctagccctcatgtctgcatgcagtggctgccactgccttaatacttttagaggccctaaaaatcacaaactatgctcaactcactctctacagttctaataacttctgaaatctattttcttcctcatacctgacgcatatactttctgctccccagctccttcagctgtactcactctttgttgagtctcccacagttaccattgttcctggcccggacttcaatccagcctcccacattattccagataccacacctgaccctcatgactgtatctctctgatccacctgacattcaccccatttccccatatttccttcttccctgttccttaccctgatcacatttagtttattgatggtagttcccccaggcctaatcgccacacaccagcaaaggcaggctatgctatagtaaaagccaccagcccgcctcttagaacgtctcattttctttccatcatggaaacctatcctcaaggaaataacttctcagtgttccatctgctattctgctactcctcagggattattcaagccccctcccttccctacacatcaagctcggggacttgccactgcccaggactggcaactcttaactccctcttagagaggatagatgatctttgctggcaggggaccctccaatactttcaccctgatgaagttctattctttacttttatactcactcttatcctcattcccattcttatgccaccctctacctctccccagctacctccaccacactatcaacctcactcattctctcctagctgtttctaatccctccttagtgaacaactgctggctttgcatttccctttcttccagcgcctacacagctgtcctcaccttacatgcagactaggcaacatctcctgtctccctacactctgaacttcctttaacagccctcacctttaccctccagaagaactcatttactttctagacaggtccagcaagacctccccagacatttcatatcagcaagctgccgccctcctccgcacttacttaaaaaacctttctccttatatcaactctactccccccatatttagatctctcacaacacaaactactattcctgtggccactcctttatgtatatcttggcaaagacccactggaattcccctaggtaacctttcaccttcttgatgttcctttactcttcatctccaaagcccaactacgcacatcactgaaacaactggagccttctagctctgtattacagacaagccctctatcaatactggcaaacttaaaaacattagcagtaattattgcttaggaagacacttacccagtatttcactccattcttggctaccttccccttgctcgtcagactctcctcccaggccctcttcttgtttgcttatacccagccccgtaaataacagtaaaagtttgctcatagacactcaacgttttctcctacaccatgaaaatcaaaccttcccctctacgctgttaccccattagtccccattacaacctctgatggctgccgccctagctcgatccctaggagtctaggtaaaagacacccctttcagccctccttctcatctttttactttgcgtctccagttttgcctcacacaaggtctcttcttcctctgtggatcctctacctacatgtgtctacctgctaattggacaggcacatgcacactagttttccttacccccaaaattcaatttgcaaatagaaccaaagagttccctgttcccctcatgacaccaacatgacaaaaaagagttattccactaattcccttgcttgtcggtttaggactttctgcctcccctattgctctcggtactgcaataacaggcatttcaacctctgtcatgaccttctgtagcgtctctaatgacttctctgctagcatcacagacatatcacaaactttatcagtcctccaggcctaagttgactctttagctgcagttgtcctccaaaaccgctgaggccttgacttactcactactgaaaaaggaagactgtatattcttaaatgaagagtgttgtttttacctaaatcaatctggcctggtgtatgacaacataaaaaaactcaaggatagagcccaaaaacttgccaaccaagcaagtaattatgctgaacccccttaggcactctctaattagacgtcctaggtcctcccaattcttagtcctttaatacctgtttttctccttctcttattccatttaatttttcaattcatgcaaaaccgtatccaggccatcaccaataattctacacgacaaatgtttcttctaacaaccccacaatatcaccccttaccacaaaatcttccttcagcttaatctctcacactctaggttcccacgccacccctaatcccgctcgaagcagccccgacagacatcgtccattatctctccataccacccccaaaaattttcaccgccccaacacttcaacactattatgttttattttccttattaatataagaagagaggaatgtcaggcctctgaacccaagctaagccatcatatcccctatgacctgcacgtatacatccagatagcctaaagtaactgaagaatcacaaaagaagtgatatttaaatggcctgttcctgccttaactgatgacattccaccacaaaagaagttaaaatggccagtccttaccttaactggtgacactaccttgtgaaattccttctcctggctcatcctggctcaaaaagctcccccactgagcaccttgtgacccccacccctgcccaccagagaacaacccccctttgactgtaattttcctttacctacccaaatcttgtaaaacagccccacccctatctcccttggctgactcttttcggactcagcccgcctgcacccaggtgaaacagccttgttgctcacacaaagcctgtttggtggtctcttcacaaggatgcaaatgaaactctgtatcattttttattgtgtttatttgatattctcttttcttctttattagtctagctagcagtctatttccttaattttttcaaaaaaaaaaaaagcccctggattcagattatttgaaaagttttttgtgtctctgtctccttcagttccactctgatgttacttttttcttgtcttctgctagctcaatcatcccaggtcaacatcccaggtcaattcctgctgtgctggcagcaggaatttcaagccagtgattcatagcttgctgggctccatgggagtgggacctgctgagcgagactacttggctccctggcttcagcctcctttccaggtaagtgaacggttctgactctctggggttccaggcgccaccaggggatgaaaaaaaaatttctgcagctggctcggtgtctgcccgaacagccgcccagttttgtgcttgaaacccagggccctggtggtgtaggctcaccatggaatctcctggtttgcggattgcaaaagctatgggaaaagcatagtatctgggtgggatagcacagtccctcatggcttcccttggctgggaaagggaggcctcctgctccttgcacttcccgggtaaggtgatgccccaccttgcttatgctcgccctccatgggctgcacccactgtctaaccagtcgcaatgagataaacaggatatctcagttggaaatgcagaaatcacccgccttctgcataggtctcactgggagctgcagactggagctgttcctattcgaccatcttgccagaacccccaacaagaatatttttaaaacaaagtaaataccaccatactcctggaaaaaaaaaatacacttttgctgtctgccaagaagcagcagcatggggttcacaaatagttggattcctagtaaagattctgcccagctgaaaattggctttgaaaataatgcgaccagaaactttgggagaacagaactttaagtggctcagatagccttcttagagtttggattaccattggttgttctcctaaagtgataagaagtttctagaggaacagtgtggagatcaaaatggcctatgatcaccagaatgctatatatccagcccctatgccctttgtgctgtacttgcctatgtgggttataaggacccaagtcctacagagtcaggaatcacccttccctttaaaatcttccttctttgacaaagccccgctcctacatgactgcaggaaatccagttctttcccaaaatattccagaggataccaaaggtagcttacattttcaaccaacatggtgcctctctggtctgcttgtttcctatggaccaccactggtcctgagcctcttctctccatagctacaaactttttgggtaccacaaaccatacttctccttttattccccaagaacagcgaataacaaagcttgaagataacaaaaggggagtatgtgacaataacttaaaactgggaactagagagcagcttctttctactcctggtgtcacccaagggtcccttctggcttttcccctgccgcctctgccctgctgcccctatggtggggtccattccctttttttcagttggcatctctggctgacatgttctccacccctaggcagcaaaaccagattcctttatggctctaaaatctctgcagaggtgtttgtttcctaaagttatcttttctatcattaagcaaaataactggattgtgcgcagccccctgctggatcatgtgtcactagtactgggcctccctaccattaaggaacccagcactttcaagttctctgattctccatgtgacatgcccaagtgaaccaataccaccactgccccaatcacccacccattcccaaaaagtgaaaaataagcacacaaacaagtgactagtgtttaatctcagaaacatttgcattcagagtacgttcccttagaattttctcctctccactccatgaggagtgggcatgtgctttattatatcaacaagactaagaagccgcacccgagtggtcccactcaaaaaagagatttctgtttctacctcaaaatgcagaaaccattacagattaaaagagaaacacacacacacactttgagaaactcgcccttcctcatcttcaaagtgtggggtatgcattccagatctctcagcctgatggacagcttggaagtggaagggaccaatgtccagcaagtggactttgccccatgtccattgtgccttgtgtcttcctagccaactcagaactcctcacatccagcccccagactaccgctcatgggctcaggcaaaggtgggagtagccagggtttggcacttgggagacactcaaaaatattttttggacaaacaagtgaatgtgagccctgaaactttctagagagtctctgtcccattgggttcaagccagtaaaaagccagagaagtgtctttctgtcccaaacataagcaagagatggatgagtcctctgtgcagaagttactaaacactccttggtgtggaggagttttttgttaatgaaacaacatccagtttgtttgatgaaagattaatatggtcaatgagctcaaagtcatcttcagattaaagcattcactaaaacatggctgggttagtttgcagctaaaaggaataaatatactttataaaatatgagttcctggtactcaggttctgcttccaaggaagtctcaacctagaccatataatgaatagagactgaaggaagaggtattgggaactcaactgattctcaggcaggggagtgtgagaagaaatggggaagaggaactagggatatcagtttcatcctggtcatgattcacagaaatgagtgcagagggaagacaaagtcagatgcccagactgcagtgttggggaacaggaggccattgagtttagattgctaagaaaaggatggagggtaaaaacattgaagagtttcagtgagagtctattttctccaaataggagaaaagcttatggagataccaacagaccttatctgaaacactctgagggttccatcttgctcttttccacattcttcatattttctaggtatctctggaggcataagagaacacttttctagcttttttgggtggtttcagctaccagctatcactacaatccccagccataatttcagatcttccatcctgtcaactttcttcaaaacacaaaaataactcctttctctccctcactcacacagtagagttcaattgattaaacttatcaaattattttaaatattcatctgaaatcagtgagactagaaacttcacattttagggtaattatgaggtacaaaagcaagataaattgtcttatcgatgatacttttgatagaagatttttaaacaataaggcataaagttgatgtataattttaaaaagaaaatatttcttgggatatgtgtttctagattaaggtaccatgggccctgaataacgaatctcagtttttcttaaggtcctcctcctctgagctacactgtgggtcgaaaagggcaggattatcataaatggaaagaagctagagacattttagttaaataaaaagaacatctggaaaaagacatcttcgttactggaaatattcaagcagaggtttctgggatgtttctgatggcactcaagcatcggagaccaaggtcagcctaagacacaagcaaggtcccatcctacaaagagagtgaaattagatccgtatatgaaatgcctagcacagtgcctggcgcataagagatacacactagataccagatccttcccatcctgagagtctgtgggtctatgctcgtatatattggatgtatttctggaagggtaattggatacattgtagattcttccagaagttcacaattttcttaatcggagccattgagagaaggcaagggaaggaagcatgttctttttgcttgtgtcagtaactcttcctctagctggagttttcatcaccttcaggcagttattggtttgggctttatgctatccactacagctgaaataactgctccagcagccttcgctccttccatcagggcgtgctctacctgcaaagcacatcagttcacaggacaatcagtaccaatcctaggcttgcaccctcccctacctccaccccaccatacccattcagcaaccagcctgtctggagtctattcccaagagaagaagcagtccatgctatcttatattttcaaaactcctagagtgacaagagaccaagaaaagccaggattgttggagacagacaaccccttcctccctctgtgccatttggcccagggtctgcttccagtgtggggctcagaggcaaaggatctcacagcaccacagccactgaggccctcattctacaaacaggggatccaagagccagggagcggaactcacttggacagagccatacagtgaattcatgtccaaacttagctcttgggttcttgggcctcatgactcctaggcccaagcttcttcagaggacttcttgtaatgccctcagtccttggggtcttcatgtgcaaattctcacgggacgggaggtttctcacaccagggcccaccaagccccggacactagagaaaagcctcacaagaatggagtgcaggctggagaggatgcagagcagagaggaggaaggtgcagaaagtaaagggcacagcagggaggctgccaatggtcactgaggatgggctggcaaaagcagagactaacattggaatgtgagcccaatctgcttagacaacagaagaaacatagaaaaaaaatagaataattatgttcttcttttaatccttaattttttccatctctttaaagggggataataggttgggtgtggtggctcacgcctgtaatcccagcactttgggaggctgaggcgtgtgggtcacgaggtcaagagattgagaccatcctgaccaacatggtgaaaccccatctctactaaaaatacaaaaattagctgggcatggtggcgtgcacctggagtcccagctactcgggaggctgaagcaggagaaccgcttgaacctgggaggcagaggttgcagtgagccgagatcacgccatcgcactccagtctgggtgacagagcaagactctgtctcaaaaaaaaaggggagtagtgataataaatgctttctctgctcatctcatggagttttagtaaggatcacctattaacatgaatagcccaagttttcacatacatttaggattcaaagttatttcacatgcactgaactacatgaatttattacttctctatatgggaggaagtgacagagccaaatgcagtataggccaggcaggtaatgtgagtgaggcaggtgggtgacatacctaccccttatcccctgcaaagccacagcatgtccctacagagtgtcagcaagtaggaatgccagcccagtggcctgatcaattgtatgttaaaaagaaagctgagggccaggctcagtggctcatgcctgtaatctagcactttgggaggccgaggcgggtggatcacctgaggtcaggcattcaagaccagcctggccaacatggcaaaaccccatttctactcaaaatacaaaaattagccagacgtggtggcgcacacctagtaatcccagctacttgggagactgaggcaggagaatcgcttgaacccaggaggcggaggttgcagtgagccgagattgcactactgcactccaacttgggcgacagagcaaaactctgtctcaaaaaaaagagagagagagagaagctgagaacctacatctttttatataaaatttctatatttttaaatattggcaagtaattcaaacaaaaagtgtgtgtgtgtgtgtgtgtgtgtgtgtgtgtgtgtgtgtgtatccaagatgtggcccacaaagtactaggttgcaattttatcaacagagtatctgcttctgcttatccctgctttgttaaggaagaaatggtctttggccagtcacggtggcttacacctgtaatcccagcactttgggaggtcgaagtggaggatcacttgagcccaggagttcaagaccagcctgggcaacatagcaaaaccacctctcaacaaaaaaattaaaattaactgggtgtggtgatgcacacctgaagtcccagctattcaggaggctaaggcaggaggacggcctgagcccaggaggttgtggctgcaatgagccatgattatgtcattacactccagcctaggtgacagagtgagatcctgtctccaaagaaagaggggaaaaaaagaaaagaaagaaaagctttcagaaatatactgatttgaccaaggatacccctctagttaatagttgagctggggctccaatcgctggtcttactattagcccagtgccttttctactcctccctgggttaataaaggtgaaaatacctcctgaaccataaagtcctgcagaaatagaaggccctactagtataacgaataatataatgaaagccctgattaccattctgatcactaatgaaatgacaaaccccaagaaagctctggaagaagccatcatcagagcaaatggggtcacacctgctggctccggggtacgccatatctgaggccattgacaaagtgctcacagttcccttcaatcaggctgtactgcacgatcttgttgaccatcttttttgtacgctggatgatcttgtccaccggcaagggcaggtacgtcccatctagcttgttattgaccttccaggagcagccatgcagcacatcctccagacgactgtatttcaccacggcccgattgctaaagatggaagtaatgctgcccacctcaaactcctcacctggagaccaaagacaaacaaaggttgggaaatacaaggagtagcaaagcagagcacagtctaagactctgagtaagctgcttcccctggagtctcattggcaccatcagtagaagggtggcagaagaggggaagttggaatcaaagaaccgcagagaatcaactttcctgagaagccctttgccctgcgcctcactccctgctctcaacccgcacaggagtctctttctcattaaactcttggagcaccttcccatgtggtcccagactgtgttgcactgacctacccaagtcctaggatttgagtctcatttcctgagaagacttcagtaatcttcacaaacatgtaaagagcactctctatgtaagtgtcagctcatgggtaaaaggctatcacatacatgattatggtggttccatgtcacgcctccctctgggctgccacagggacacaggggaagccagccaagcagggctctgaatggcacctgctcctgccagcttccacctacagccacttgactgacctctactcaaatacggggattctcattaagggtatgtttgaaaacagggttccacagctttgaaaaaagaaatgtttgaaaggtgctacattatcatattcagccctgagatgagacagagactgaaagagggtcaggaacctgcccaaagctgggtgggtagtcatttaaagtagcactgctacaaccatgttgatatgcgaatgtgtatacccttccctttataagttgtccaagggcaagaaatgctccatgatcttttcttacaaatttgaagaaaatctgctgattttataaaagctggcaatagataattcagcattcaggagcagaaatggcagaattcattttcagagagcaagataggggtgggggaagacataactgataagtatctctgtggttgtacaagagggaaactcctggacttagtctggaaagaagagatgaatttctacattctttgagtaggttctgagacaagaagtgggaagggtatgagtggatggggcagagaagagaggcaatgagaaaggggctctgctccatgggaacatccctgcatggtgagagactgggccagaggaagaggacaggacacagggatgacagctgagaacaagttaggaccaaaggcctttggtatagtgcccttctgtaattcaactttgaactggcaatacctgcacaggagacagcattcaaagtgcattcaatggtattcaacagggtctacctaccccttcctctcccaaaccccaacccttatcaggcctcatctcctgagataaccactgtgaccagcagttctagatacccaattttaagttgtttcccattttgctgtactcttcctctactatcatcacctcctcccccatcaaatctccactaagatttaattaacacaaattgaatctcagccatatgttaagcagctgtgagaaatgaaaagagggctgtatctacatttagggtgaaacagcaaggagcatgttggaacagcagcgagacaaggtgaggacgaaggtgccaaaggtgatcaagaagccagatgcagtgtctgaggactatagaaaacaaatgacgatcagaacatgtgagcatctgcaccctccttggggaatcctcagaaagatgaggatagatgctcaacttttgtcaatacaaaatggagctcaagttctaaaatgtgtgtatttaaacaaagggccctctaggaggtcagggaacttgggccacgctctttacacttgtatcactcttaggcctggacactcattggtttttggtgaacagagaccaagctctgtcacacagtaagcaaaggtccagtcatgcttcaaggggtcccattgctaaagaatggcagtaactgaggaacacagtaattaactgtgcttctatttactttgctaacttcaatatcagtatttcaatagactattcactcttacttgggggagccagatggaccacgcaatcatcttctacatagatggcccagtgctcatagccaattcgaaaaatctcaatcaggtctccaggtctgggtcttggttttccctataatggaaaaataaaagataaatggcacatgctcaaggaactccagagaccttgttttaggatcagggacagctcagcctaaagatcccctcagtgtggttcatcacttcacagaaacccaagctaaagaaatttctcttcacactgaggaccaaagaagtcccctcctctcctaccccactcacattactaaagccatcaaggatacccgtgccagttatcaatgtattgcctctcagctgtgaatgtatcctccaatatataccctgtgatagatgactaaacttgttttaagcatttcttccttaaagcaagtaagatgttaaaccttctcagtaaagggtgctggctttctcttgtactgcaagacaaaggggttctcctgcagtttctggctggggtgggcaggatgatggtcagtagtgtgggtgtgtggacatctagtagagttctacctcagacccaggatcctcaaggcctcctgcccctgctggcaccctgattccctctgcagggcccccacgtgacccacctgaagcccagagggtgcccccatcctctgcacacccacaccaccagttgctaatagccacttcagtcctgcttgcccagcaaatgcaaacttctctattatcgtgtgtgtgtgtgtgtgtgtgtgtgtgtgtgtgtgtgtgtgtgagagagagagagagacaggtagagagagaatgagaatatacatgaataggtaggcatagagttgtacataagcatccatctttttaaaaaatatttgaccagagctccaggttgcaccttcactgctgtgttatcatctcctagagacccagcttctgtggccctgtgacctgcaggtctttggaaatccatagctaagatgttaggactccgctggaagcctagaaatggtattgctgtctctaagccagacctgatcaactacctggagcaaagaaaagagccctggaatatggagagacacaagatggtagcgaaacacccagttacatgttctcatttcacccaagacctttggccaaaacagggtataaaagattcattcccaaaagtgatactaaaaagatatggaaaatgtgaacatgagaatttacaattaaggaaaggctgtaaaagtgtgggtgagtgcaaagtgcacaaaggaggtcataatggacttaattaatgtcattaatgtcgttaatttgtcaactactcagagcaaaatattttaatgtaatacatatgtgaaagtctctagcaaattttcgaattcaaatagacataagacatggcatactggagagaaacctttcaaatgtaaagaatacggcaaattggccaggtgcagtggctcacacttttaatactagcattttgggaggccaaggtgagtggatcacctgaggtcaggagttcaagaccagcctgaccagcatggtgaaaccccatctccactaaaaatacaaaaaaattagccaggcttggtggcacgcacctacagttccagctattcaggaggctgaggcaggagaatagcttgaacccaggaggtggaagttgcagtgagctaagatcgcgccattgcacttcagcctgggtgacagagcaagactcccatctcaaaaaaaaaaaaagaatgtggcaaattatttcacatgctctcacacctaactcaacatcagagaagtcatactagacagaattcttacagatgtgaataatgtggcaaagcctttaactggtcttcaaaccttaatgaacataagagaattcacagtagagagaaaccctataaatgtaaaggatgtgacaaagccttttaagtgcatctcaagccttagtaaacataagataattcgtgctggagaaaaaccctacaaatgcaaagaatgtggtaaagcttttaaccagtcttcaactcttattatacataagagattcatactggagagaaaccctatgattgaatatggcaaagcattttaaaggtccgtaaacataagataattcataccggagataaactctacaaatctgaaaaatgtggaaaagcttttaaccacacctcatacttttctaaacataaaataagttatactggtgagaaatcctagaaatgtgaagaatgtggcaaagcctttaaatggatgtcacaccttactgtatgtaagataattcatactaaagaaaacccctacaaatataaataatgtggcaaaacttttaattaatgttcatgccttattgcacacgaaagcatttatactttagaaaaattgtacaaatataaagaatgtggaaaagccattgctatctgctcacatcttactcaaaatcagagaattcatacttaatgaaaccattataaatgtaattactgtaaaaaaaactttcagaaaatataagcctttaaagtgaataagagtatttattctgaagaaaaacattacatatataaagaggactgtagtgcctttacttgtattacaaaccttattgtacatattttatactagaggaaaacaccaaagcagttgttcaaaccttgttgaacatcagagaatttatgttgcaaagaaaccttacagatgaaatgaatgtagaaacacatttgtttaaaaactccagcatgaagaacaccagagagttcatactaaaagatacttttgcagatgcagtaaatgtgaaaaaaatatttaatcaaacattaagtctatataaacatcagaggattcacagtagaaagaactaaggtatagacacttcatacattacactaaatcagagtgttgagtacagaaaataattcaaagccaaaactgtcagattttttttgtatataactttaaaagaaacagaagactttttttgaagagttataattacaaagtatttgttttcccttgaaaaaattatagcttgttgaaagcaaatgtaatttaattctcaaattacttcatgctgttccttcattcctattgtttatgtgaaagcatgtgatccattattgttgcatcagatctatgatagattctttttcattagttgggcattatttatgaccatttccatggaagagtaaagacattgaaataaatgtaaggtgcgcaatgaaaatctaagtggagaggctctttgtggttgacttataacattgtttgagtgaagcaagaggtaagtgttcagagtaatattcttctacatgacagtgagacgaaaacattttgaattttagtagtaaatcattttaccaattgtacttttatgtaataaaatgcagtacattttgaaattctgatttaagattacaggtgaacttaattttttaaacaaaattgtttttaaaaaacattaataggctggataaagaaaatgtggaatactatgcagccataaaaaggatgagatcatgtcctttgcagggacatggttggagctggaagccgttatcctaagcaaactaacacaggaactgaaaaccaaacaccgcatgttctcacttataaatgggagctgaatgatgagaacacgtggacacacaggaaggggaacaacacacactggggcctgtcagggtgggggttggaggagggagagcatcaggaacaatagtgaatggatgctggacttaatactaaggtgatgggttgatctgtgcacaaaccaccatagcacaattttacctatgtaacaaacctgcacatcctgcacacataccccagaacttaaaagttgaagaaaaaaaaaggaaagaaaaaaacagcccaaacagccatcaataaggaccagttaagtaaataatcctatatccacacacacagagacattagagagaggaagttgaatttacatgagcagcgtaatgctgctgagattcatgcttgctgcagcatgcgtcagttactccattatatggaggcaccacattttgcttaaccaacgttgttctttttcagtatcactttggctatcccaggtcctttgtctttccatgtaaattttaggatcacttcatcaatggttatcaaaaaaaatattttgacagggattgtgtttaatctgtagatcgatttggtgaagactgccaccttaagattgcagatatttcgcaatccacaaacatggaattttttgtgtgtacttaaatcttcaatctcccttaccaatgttttgtagcctaacatttttgttaaagttattcctaagtatttttatgctatgatgaatagaattatttttttaatttcattttcaggtagttcacttgtaatataaagaaattccattgatttttgtacattagccttatattctgcaactttgctgaacatatttaattctaatggttttgtggcccaggcgcggtggctcatgcctgtaatcccagcactttgggaggccaaggtgggtggatcacttgaggcaaggaattcaagaccagcctgggcaacatggtgaaaccccatctctattaaaaatacaaaaaaaaaaatgagccaggagtggtggcacacgcctgtagtcccagttacttgggaggctgaggcacgagaatcgcttgaatccgggaggcagaggtggaagtgagctgagatcgtgccactgcaccaccgcactccagcataggtgacagagcaagactctgcctcaaaaaaaaaaaaagttctaatagttttgtaagtacaggcatgtctcattttactgtgctttgctttattgtgcttcacagatatttcattttttacagattaaaggtttgtgacaaccgtgcgtcagataagtcaattggcgccttttttcaaacagcgtgtgctcgctttgttagcattttttagcaataaagtatttttaattaaagcatgtacttttttacatgtaatgctattgcaaatttaataggctacagaataatgtaaacataacttttatatgcactgggaaaccaaaaaatgtgtgcgactcactttcttgcaatattcgttttattctgacggtctagaaccaaacccacaatatgtctgaagtatacctgtatgtgattgactccttaggattttctacatacattgaatttttcataggtgccctttttcaagttgaggaaactccctttaactgagttcaagagaatttttttttatcatgaatggcagattttgacaaatgctttttccagaggtattgagatgatcatatgatttttgtcctttactctattaacatgatatttttttgttgttttttttttttttttggttttttgagaggaagtctaactctgttgcccaggctggagtgcagtggcgcaatcttggctcactgcaacctccacctcctgcgttcaagtgattctcgtgcctcagcctcccaagtagctggattacaggcatgcgtcaccactcccaggtaatttatttggtttgtttcaccttgttaaccaggctgatctcaaactcctgacctcaactgatctgcctgcctccacctcccaaagggctaggattacaggcatgccccacagcgcccagccctggtatattacattaattgacttgggggtgttacaccaaacttgcatttctgggataaatcttagtcattgtgtataatcatttttatattcatgctggattccatttgctagcatttttctgagggtttttacatgtatattcatagagatattagtcttgtagcttcctttttttgagataccttggctttggtatcaaggtaatactggcctcacagaatgagttgggaagcatttcttcctctattttcagaaagagtttatgaaagattggtaatttttcttatttaaacgcatggtagaattcttgagcaaagccatctgggcatgagattttctttgtgaaaagatttttatttactaattcaatttagattttctagtttttcttgagccagttttataatttgtgtctttctaggaacttacccaattcatctcagttgtctaatttgtttgcttaaagtttttcatagtgttcccttttatgtctataagattgatagtgagccccctcttacattcccagttttggcaatttgagtgctctctctttttttcttggttagtgtagctaaaagtttgtctattttacctttccaaaatactatcttttggcttcattcattttctttattgatttctgttttctatttcattgatttctactccagttgttatcattttcttacttctgcttgttttggttttagtttgctttgtttccctagtttcctaaggtaggagcttagattattgatttgagatattttttcctttctaatacaggcatttgcagctataaattttcctctaagcacttcagctgcatctcataaaattgatatgttctgtgttcattttcactcaactcaaaatattttctaacttccttgttctttttttgaccatgggttatttagatgtatgttgcttaatttccaaatacttgtaaatttcccaaaatatcacttggctattaatttctaatttaatttcatgtgatcagataaaatattttgcaggatttcaatcccttcaaatttactgagacttgctttatggcctagaagagggtctacactggaaaacactcatgtgtgctagagaagaatatgtattctgttgttgagtaaaatgttttataaatgtcagttagatcatgtcagttagttgcttacatcttctatctgctcactgattttctgtctagttgttctatccactattgagagtggggtattgaagtctcccaactattatttctgaattcccaatttatccctttatttctatcagtttttgcttcatactttttgggattattttgttggatatgtatatgtttataattgttatatcttcctgatgaattcaccttttgtcattatagaatgaccctttttttctaataatacctcttctcttaaaatctattttgtctgatattagtacaaccactcctgctacggctactgtttatatcaacctatttgtgactttagatctaaagtgtgcctcttgtggatggcatataactggatcttgtactatcaagtcatatgatctctgcctttttttggtgtgtttaattcattcacatttaatgttactattaataaagttggatttatgactataattttactgtcaatcttctgtacatcacgtcttttttgttcctctgttcctcttttgccttcttttttgtatcaaatacgtattttctaatgatcattttaattcctctgttaactttttaataacatttttaatagttttctttgtggttgctctagggattacaatgtgcatcttgacttattgctatctacttcagattaatactaacttgattcctgtaaaatatggaaacttaaaattagctccattccttcttccctcctttatgttattattgtcagatatattacatccaaatatgttataaaccgaagacagtgttacaaatattgctttatacaaatttttgtcttttaaattagttaagagaaaaaggaaaaagtatacttatggtcatttatattaactacattttaccatttctggtactctccatttcttcctgttgattaagatacttactgtctggtgtcattgatctaatacagcttcatttcagtccctctcctttgtgctattactattatatttattatatatttgcatgttataagaccaagaataggatttataactagttttattcaattacctttcaaattggtcagcataaatgataaaatatatatttagattcttctgtataattacctttactggtgctttgtatttcatgtggcttagaatgctatctggtgtgactttctttccacccaaagaattttctttgctatttattttaaggcaagtgtgctagccacaaattctctcattctccattcatctgggactatctttatttcaccttcatttttgcaagatacattactggatacaaaattattggttaacaggtttttttctttcagcatttttaatatgtcatcccactgccttctggtctccattgtttctgatgaaaagttgactattgttttttattgtgcatctcttgtatacaataagtctttttttctcttgctgttttcaagattctctctttgtgtttggctttcatctgtttgaatgatatgtctgggtattcacagagcttcttgggtgtatagattaatgttttacatcaaatttggaaagtattcagttatcttttatataggtatttttttctgcctttttatcatctctctttctgggaccccaattatacatttgttggtttgctcaatggtgtctccttggcctctgaggctctgttcatttttctttttctttttcctcctactcttcatactaggtagttgctgttgatccatctttgagtttgctgattcttttttctttttggtaactcaaatttgctgttaaatcactctagtgaatgttttattttggccattgtgtttttcaaccccagtattttcatttggtgcttctttatcatttctacctccttattaatattgtatatttgatcggtcattgtcattccactttcctttaattctttaaacttgattttatttacttctttaaatatactcaaaatagcagtttagaagtatttgctacatgcaacatgtaggcccactaggaaacagtctctactgtttttgtgtgtatgggtccctctttcctgtttctttgcaggtctcataatttgttgttgaaaaactggacgttctaggtaacataccgtagcaactgtgggctctgatctccttccccacccaaccagggcggacggttgttgctgtttgcttgtttgtttgttgtttgtttagtgacccacctggactgattctgtgatgtctgtttgtctcacagcatgtaaccactgagatatctgcttagagtttttttcttgtttttatttttatttatttttttgagacagagtctcgccgtgtcgcccaggctggagtgcaatggtgtgatctcggcccactgcaacctccgccttccaggttcaaacgattctcctgcctcagcctcctgagtagctgagattacaggtgcctgccaccatgcacagctaatttttgtattttagtagagacagggtttcaccatgttggcgaggctggtctcgaactcctgacctcatgatccgcccacatcagcctcccaaagtgctgggattacaggcgtgagccacagtgcccggcttcttgtttttaagcctggcttcctagatcggcatagcttaatggccagaagttgagccacaccttgtgccgcgaaggctttaccttttgtcagtggatctctgtgtggcttggagaattcattcaaagttccagatttttatgagtctccagtctgtcctgaatgtgaatgtgtatgcagccttgtgcataccttctagaccaccagacacatgtggcagcttttcaagaccctctttagttgtatcattacctggatttccatgttaaatttttggcaggcctgttggcctattgcttgtcctaaccagtactgcaacctcaagctagctgcaattttggtcttccatgattgtcactgagataactcttgttttcaacaaccctgggcatggaagtaaagtcagtcaccctctgctgccacgccattccctcccacaagccccacccacctggatagaacttccttaccacaaccgcagagctggaggtgaaggggcaatgctaaaacactacagacttccactgttctttctgagaaccaatagactttcttttttttttttttagacggagtcttgctctgttacccaggctggagtgcagtggcgcgatctcagctcactgcaacctccgcctccctggtttcaagggattctcctgcctcagccacccgagtagctgggactacaggctcgcgccaccacgccctgctgattttttgtatttttagtagagacggggttttaccgtgttagccaggatggtctcaatctcctgacctgcccgccttggcctcccaaagtgctgggattacaggcgtgagcccacgcccgaccacggatggactttcttaaattaacccttctcaatctgttgtatggctttggtcaaatttccagtctttaaatgactgtctttggcaattttgtctggcttcataattgttttgggaaaagaggatttgctgagatctgcactcagccattccacaagtcctgcccacttgcagcaatgagtttttgtgggcacaaagcaaacagtatacactacaatatttcatggaaggaactgaggccaagagagaggaagtgctttgtctaaagtcccacagcaagtccatggtcgagctaggaccagaactactcccttgcccctgccaacaaaccaactctttcttctgccttaaagggaaaatgtaatggcagccacatatccactagagggctccccataccaggcttctcacccagaaagcagaatgatattgcaggagacttcaaactggacttcattttcttttgccataagcccagggaaagcagtagggatatcccccaccataaatcccggaagccggtagtatacagaagaggttgagtgctacgagttgggaagacagcatgtgagtgatgtagatggatacagaggagcagaaagcagccaagagagtaagtgaagaaaggcaaagtggaggagagctctttctcgtcctttgaagaagactaaaaaggaacaatagcaaatagtattttctttgtgattcagatagtaataagactatattgctttaagcagatgcctctgtcttcataaatggcaaaggatcagagaaactgttttaaaatgttcataagaaagtctgaagtttaaatattttgaagctcattttaaaaaatcaagtcaggttcaacatttgcatgtgcagatgcaggtaaacagttaaattgcctttaatttataatttaggtatatacagatttttgattcatagattgtctaattattttttcctttcagacataggtaaatgagagaggaagagaagttatttagcctaatttctttatatgaacatatgtgctaagctgaggccatttctgctattatacacacatgacacaggagaccccataggcccatcctcactgttacagtaatctaaggaccattactatctaagtcctgacactggtcaggaagaaaaacagaaatgcccatggacaaaagatgaacaagaagtgaagaacaggcgccagagctcaaatcaatccaactcaggctattatttctggcattgatcagggtgaaggaaatggcagtaacagtaagattatgggacaggtttttctgagtcactccagagggaaagccacttgacacgttatgttactcttgaactaacccctgattccatctcactctacctgaccacagaccccaataccttagagtcctaaccaatgcctttcacccaccatccaccatatctagtggagggcagggctctcagagtcggccaagccagctggacggtcacgtctgttctttgtaggaacatgcggtccgttcttcaccatccctccaccttggacatatttccccaccaaccaaatagccagttacttcccactcaacatggctaggtcattccctatgacaacaaacaagcaatcaatcaaatccttgttgttgtttcctggaaaactgacagcaagaagataacccaattcattgtgaggccaatctaagccagaagaaagctcagaaaacccaagttctgttcatcaaggatgtcgaacaagctttgtggtacagaaaacagaaggctcagggattggagaaggaaagaggagggaattttggaattttaagtattttcttttgcattttaatactctctcatctgcaatattgccactggatgaggtagtaaggtataaaactaaatgggattcacagagacttaacagttatccactctcttgttaaatttcctcccactgtaaatcgattatattgagtattgattctcagccttggttacaaattgaaatcgcctgtggagctttaaaaagttcagattggtctggagtatagcctgggtgccagagttttaaaagctccttaggtgagtttaaggtgcagccaaggttgcggttatactggggtcttttctacagtcccatccttccctttttcttttctttaacatctctccagcatttcatgaagttctgctaacttcatgagccacagagtagctgtctgtatgctacagagccgcctccaatcccagttgatgctggtaccttcaattctaggtgaagattttgctgccctgtttgcctttgtgtgattggattaattcgaaagccttgtcttcaagctctttcttttattaatacttgttcagttctatttcccatgcattttgtatatctctaagtgtgtctttcatttccataagttgtgcttttaatttataatttctatttttctggagcatttttcatccatatgctgtattgtcttaaaaaattgctttaacttggttttcacctttctctggtatctccttgaatagcttaataatcaaccttctgggctgggtgtggtggctcacgcctataatcccagcactgtgggaggctgaggcaggtggatcacctgagctcaggcgttcaagaccagcctggccaatatggcaaaacccctcctctactaaaactacaaaaattagtgagacatggtggcacatgcctgtaatcccagcaactggggaggctgaggcaggagaatcacttgaacctgggagatggaggttgcagtgagccaagatcgtgccattgcactccagcctgggtgacagagcaagactccatctcaaaaataataataataataataatcaaccttctgaattctgtttgtccctttagaataaatgttcatttcaaagctccccgtacatctgcacaggctggcaacccagctctggcccttctcccggaaacaggtgcccacttagagaaactcctattttctaaggcctcctatctgacaaagaaaaaaataatcatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccgcatgttctcactcataggtgggaactgaacaatgagaacacatggacacaggaaggggaacatcacacaccagggactgttgtggggtagggggagcggggagggatagaattaggagacatacctaatgctaaatgatgagttaataggtgcagcgcaccaacatggcacatgtatacatatgtaacaaacctgcacgttgtgcacatgtaccctaaaacttaaagtataataataaaaaaaaagaaaaaaataatcaaaagtatgaacaaagcctcctagaaatttgggattatctcaaatgaccaaaactaaaaataattagtgttcctgaggaagaagaggaatctaaaagtttggaaaacacatttgagggaataattgagaaaaatttccctggccttaccacagatctagacatcaaaatacaggaaactcaacaactgggaaattcatcacaaaaagatcatcatccaggcacatagtcatcatgttatctaaaatcaagacaaaggaaagaatcttatgagctgtgaggcaaaagcgtcaggtaacctagaaaggaaaccctaataggttaacagcagattgctcagcagaaaccctgcaaaacagaagggactggggtcctatctttagccatctcaaacaaaataatggtcagccaagaattttgtatccagcaaaattaagcttcataagtggaggggaaataaagtctttttcagacaaagaactgctgacagaattcaccacaactaagccagcactacaagaaatgataaaaggagttctaaatcttgaaagaaaacttcaaaatacaccaaattagaacctccttaaatctcacacagcctataaaataataacacaatttttaaaaaaaaagatattcaggcaacaactagcacaatgattaaaacagcacctcacatctcaatactaaaattgactgtaaatggcctaaatgctccacttaaaggatacagaatggcagaatggattaaaatccaccaaccaagtatctgctgtctctaagagactcacctaatgcataaggacacataaacttaaaaggggaggaaaaagatattccaagcaaatggaaaccaaaagtgagctagagtagctattcttatataagacaaaacagaccttaaaacaacaacggtttaaaaagaccaagagggacattatataataataaaaagatcagtccaacaggaaaatatcataatcctaaatatatatgcacataacacaagagctcctaagtttataaaccaattattactacacctaagaaatgagatagatggcaacacagtaatagtggggggacttcagtactccactgacagcactagacaggtcatcaagacggaatgtcaacaaagaaacaatggacttaaacaataccctagaacaaataaacttaacagatatttacagaacattccacccaacaactgcaaaatatacattcttttcatcagcacatggaacattcgccaagatagatcatttgataggccacaaaacaagtttcaatcaatttaagaaaatcgaaaatatatcaagtaccctctcagaccacagtggaataaaattagaaattaactctgaaaggaaccctcaaaactatacaaatacaaggaaattaagtcatctactcctcaatgatatttggtcaacaatgaaatcaagacagaaatttaaaaattctttgaactgaacaataatagtgacacaacttatcaaaagctcagtgacacagcaaaagtggtgctaagaggaaagttcatagcattaaatgcctacaccaaaaaaaaaaaaaaaaaaaaatctaaggttacacctcaaggaactagagaaacaagaataaaccaaacctaaatcagcagaggaaaagaaataaccaagatcagagcagaagtaaatgaaattgaagcaaaaaaaaaatatatatatatatatgtatatatatatatatatatatatatatatatatatatatatacacatatatatatatgaaacaaaaagctggttctttgaaaagataaacaaaattgatagaccattaatgagattaaccaagaaaagagaagagatccaaataaattcaattagaaaagacatgggagatattaaaactgagaccacagaaatacaaaagatcattcacacacacaaactagaaaatctagaggatatggataaattcctgtaaatatgcaaccctcctagattaaatcaggaagaaatagaaactctgaacagacgataacaagtagcaagattgaaacagtaatttttaaaaatgccaacaacagaaaaaaaaaaaaaagtccaggaccagacagattcacagctgaattctatcaggcattcaaagcattgatatcaatcttactgaaactattccaaaagacagagaaagggggaatgctccctaaatccttatataaagccagcatcaccttaataccaaaaccaggaaaggacataaaaaaaaaaagaaaactacagaccaatatccctgatgaacacggatgcaaaaatcctcaacaaaatactagttaactgaatcaaacagcatatcaaaaagataatccaccatgatcaagtgggttttatagcagggatgcagggatggtttaatatatgcaagtcaataaatgtgatatatcacataaacagaattaaaaacaaaaatcacatgattatctcaatagacacagaaatagcatttgacaagatccagcatccctttatgattaaaaacctcaacaaaatcagcataaaagggacaaacctcaaggcaataaaagccatctacgacaaacccacagccaacattatagtgattggggaaaagttgaaagcattcccccagataactggaaaaagacgaggatgcccactttcaccacatttattcgacatagtgctagaagtcctagccagagcaatcagacaagagaaagaaataaagggcatccaaatcagtaaaaaggaagtcaaactgttgctgtttgctgatatgatcatagacctggaaaaccctaaagcctaatccaaaaagtcctagaactggtaaatcaatttagcaaagtttcaggatacaaaattattgtacacaaatcagtagccctgctgtacaccaacaatgaccaagctgagaatcaaatcaagaactcaaccccttctaaaacagctgtaaaaaaaaaaaaatacttaggaatatacctaaccaaagacatgaaagatctctacaaggaaaacaaaacactgctgaaagaaatcacagatgacacaaacaaatggaaacacatctcatgctcatggatgggtagaatcaatattgtgaaaatgatcatactgccaaaagcaatctacaaatttagtgtaattcccatcaaaatacctattcacagaactagaatgaaacaatcctaaaattagtatggaaccaaaaaagagcccacatagccaaagcaagactaagcaaaaagaacaaatcttgaggcatcacattacctgactttgaactatactgcaaggctatagttaccaaaacagcatggtactggtataaaaacaggcatgtagaccaatgtaacagaatagggaacccagaaataaaacaaaatacagccaactgtcttcaacaaagcaaacaaaaacataaagtagaaaaggacatcctattcaacaaaaaatgctgggataattggcaagccacatgtagaagaataaagctggatcctcaactctcaccttctacaaaaatcaactcaagatgcatcaaagatttaaatctaagatatgaaaccataaaaattctagaagataacatcagaaaaacccttctagacattggcttaggaaaagagttcatgatcaagaacccaaaagcaaatgcaacataaacaaagataaatagatgggacctaattaaaccaaaaagcttctgcacagcaaaagaaacaataagcagagtaaacggacaacccacagagtgggagagaatttgtacaaactatgcattcaacaaaggactaatatccaaaatctgcaaggaaatcaagcaaataaatcagcaaggaaaaaaacaatcccatcaaaaagtgggcaaaggacatgaacaggcaattctcaaaagaagatatacaaatggccaacaaacatattaaaaaactgctcaacgtcactaattatcagagaaatgcaaatcaaaaccacgatgcaataataccaccttactcctccaaaatggccataacttaaaaataaaaaaaataatatgtgttggcatagatgtggtgaaaagggaacacttttacactgctggtggggatgtaaactgatacaatcactatggaaaacaccatggagactccttaaagaactagaagtagcacaacaatttgatccagcaatcccactactgggtatctaaccagaggaaaagaagtcattgtatgaaaaaggcacttgcacatgcatgtttatagcagcacaattcacaactgcaaaaatatggaaccagcctaaatgaccatcaaccaatgagtggacaaagaaaatgtggtatatatatatatgcacacacacacacatacacacacaccacggaatactactcagccgtaaaaaggaatgaaacaatgacattcacagcaacctggatagagctggagaccattattctaagtgaagtaactcaggaatggaaaacaaaaaaatcatatgctctcacttataagtgggggctagctatgagggcacaaaggcataagaatgatgtaatcaactttagggactcagaagggaagggtgggagtggggtgagggataaaagactacacattgagtatagtgtacactgctcaggtgatggatgcactaaaatctcagaaatcaccacgaaggaacttttgcatgcaaccaaacaccacctgttcccccaaaactattgaaataaaaatacagataaaaatgtatcaaatatgtaaatgtaaaaaacaaaactataaaatacctagaagaaaacaggagaaaatctttgtgacactggattaggcaaaggtctcttagatacaccaccaaaggcactattcatagagatttatatgaaatcatgttgtatgtccacttctttggcggtctccttcatataactattttgagtgacatccgtgttgttgctttttatcaacagttcattcctttttattactgagcagtatttcattacatttccgttttataaaaggaaaagctgacacattggacttcatcaaaatttaagaacctgttctgaagagacaagccacagatggagagaaaatattataaagtatatatctgatgacgtacttgtatacagaacttctgaagaactctcaaaacatacaaaccaataggaaaaaatgggcaaaagatttgaacacttcaccaaagattatatatatggatggcaaatatacgcatgaaaagacgttcaacattattagtcattaggaaaatgcaaatgaaaaccacaatgagatacctacacatctattaaaatagctaaaatttagaagattttgaccatgccaaatgctgatgaactggaactcttataaactgctggtaggaatgtaaaatgatacaaccactgtggaaaacagtaagttaaggttagagctcttttagaatttgtctggcaggcttggaaagccccaaaaaagaaaaaaaaaatgttaaggaaaacagtaaattaaatatacatctaccacatgacctagccatttcattcctacatattcacccaagaggaaaaaatatacagtctgcacaaagactcgtacataaatgttcaagcagatttgtgatagtcaaaaactagtaacaactcaaatgctcaatcaacaggtgaacacataaacaagagtggtatatccatacaatgaaatactgctcagtaataaaaaggaatgaactgttgataaaaagcaacaacatggatgtcagtcaaaatagttatatgggctggctgcagtggctcatgcctgtaatcccaacactttgggaagccgaggcgggaggatcatgaggtcgggagatcgagaccatcctggctaacacagtgaaaccccgtctctaccaaaaatacaaaaaattagccgggcatggtggcaggtgcctctagtcccagctactcgggaggctgaggcaggagaatggcgtgagcccaagaggcagagcttgcagtgagccaagatcacgccactgcactccagcctgggcgacagagcgagactccatctcgaaaaaaatatatatagttatatgaaggagacagacaaagaagtgcacatacaatatgatttcatataaatctctaaaaatgtgaacacatctatggtgacaaaaagcatatcagttgttgcctggggatgggagtggtatgggaagagagagggattacaaaaggcacaaagaaacttttgtaaatgacagagattattcattatcttgattgtggtgaagatttgacaggatatatatatagatgtcaaaatgtatcaaactatacacttcactggcatatatatatgccaaatttatcaaattgtatattttagatatgtggagtttactatatgtcaattacacctcaataaaactgctttaaaacaaagcataaccaacatcccaaatcaggatatttattagaccatctaaaccaagtttgtccaacccgcagcccacaggccacatacagcccaggacagctttgaatgtggcccaacacaaatttgtaaactttattaaaacattatgagacttttttgtgggttttttttttttttaagctcaacagctatcgtcagtgttagtgtattttatgtgtggcccaagacgtttcttcttccagtgtggcccagggaagcctaaagattggacacccctagaaacaaagtaaaatacaatatgtagagaagttgccaggaggttaaagatagtcactttgagaattcttgttacacctacctcagctgcttgctttattaacttgccttcattctcaggctttggaattgaactccagtctgctttctggctgggtgtggtctccaagctaactacagccttctccctaaatgattttgcaatcacaaagttaacaaatatcactatttcataattattggaaaatctgtattacagatttgtgatttttaagatggcttttggtttggagactgtagggaacatttccccccgtttgtttctgtgaacccattagctttcatacaaaagaattgctgtttgctggttttctgacaattgttcaaatgctaatgatagcaagaagcagttttgggggtttttattttttaatttgctaataatgtctttttaatgtttatcaaagtgatacttgcacatggtttccagtacataagaatttataatgaaatgcaaggagccttcctcctttcccttttcatcccagccctactgcccagaggcaaaccccttgaactctttcttccaataattagccccagatttctaagaaagcttgataagccacaacactgcaactgcaagtaatatgaatgaaatcagtatatttctcccttgaaacaaaatgttacaggagaggacagaaatgaaaggcaagaatatgctttcaagcatattaaattaaggtagtatagtagagtaaaatacttcgaagccaaaagatctaggtttgaatcctagctttcatgattgctgtcccaccttgagctagtaaattaatgtctgactctcagcttgattatctttaaaaatagagatgaaaatgtgtctcacagtggtcaagaaggtgaaaggacacagcacatgtaaacatctggtataccaccaactcagaaatgactttttctttaccttttcccatgctttaaactcttctccagaaaaaaatagtgtgtggggcagaggggacacccctcattttcagtagagctcctctccaaaatttcagcccctcggaattttttaaagcagcaatcatcatgttgttaatgaaagtgaattcaggaaatctgccaaaggccgactcattgttcactgattagtgagaccaaggacaatactgtaagcctcctgctaaagccattcatttctctggggtctagagaatggccttgtggctagaaacagctgcaacgcatgcctgtggccagcaggtcccaagcccagtaccatctgttatcacccaggatcacaccagccttccccttgctgggtaccggctggctggttcacacaaaaaccacctctgggtttgttttacagaactgcattccaagtcaattctccaaaagatttcttccacccaaagaccccaaccttacaatcttcttacccttgctggatgcttctgccctgttctaatgtgcccggcggaggctgcttggctgggagctggaccaacgctgcgaatcccacggattcttctaattcaaggggggaaatgctatttagacctgtgaaaggagagttcgagcaagcaccttgaccgctacggagagtgggctcagagctctagtctagcatcgtgcctggcccctggttaggcctcagaaaatcttgggatgaatggagagggttgtggaactaggtgctggagcgggttcagttcctctgccaaagagagactttgggattcctgggaacggaatcggggagaggatgaagaagggcgcctcgcctctatcctaagcccgatgggaggaacctctgccgagccagagccggtcttaacaccaccctccggagctgccaccactgcctcacttccatatgagatatagcgggaaggagggagtggctgcctggctcgctttgattagctttataacaagcggtcgttctgaaatactcgctcatgatggctaacagacaacacaatcgccaaatgtcttaagaaaaggagctttgagggtaaccgcccgctgggacctgaaggacaattgcggattgtccttcagccgcattcttggggctgacctgagtggggcacagctgaacgtctgagcgcaggcggctggtccttgggcccggtactggcggttcgcgaggcgggtttggggaggggtgggggaatcctagggaggcggagcgcgtactccccctcggcgcccgggctcaggcccatcccgcctctgcggcctcgccggcccccaggccttgcaggggactacgcccctggcgagttcccagtcggcgcggcccctggtcggcggagccgcggaagcttgggcactgggggcggctcggggaggaaccgcggaggggaaagcgccgcgggctgcaaacggcagaggcgcgcggggtggcgacagtggcgcgggcgcagtgagcgcgtccgagaacagaatgggacgaaacggggcgcttagaggcccgggaatctgtgggtcttttaggcggagaggggcgaaggaggttattcgttttggggaaggtcatggaaacagcaaaggctcagaggtggtgcctaaagtggctggagaagctgaacggtttggaacagaggcgtgacttggaggggtaaatggagaccagattaggaagccttgggaggcacaatcaggggttaaaatcttgaacaattcagagttgttttatttttaaaaatatatagaaaatgaaatctacacttacgtaatagataacttatgaaaaagtacatggaatacacatgttgcagtcttgccaatgtaccttaatgtagcagtttctccttgtctggactgatacccgggattctttgtcctactccaagaaaattaaggaacgggacataaggtgaggtgggagcgaaagtttaataagcgaaagaagaaagctctccacagtgagctgagtatgcaagtggattgccctgttacagctgaattcaaaagcttttgcaagaaaatctcttatctctgtagtagtttgagtaacttctcttatcagtaaagctgtcttacgcagctgtggttatgtatctatgcaagcacaaagcaccgccttttttgtttgcataactgtgggtttgttttaggtaagcccccctcctccctgtgaaagttcccaccatgtatatgcctgaaaaggggagaaaactttcctgggagctccctaattatacaaagaacaaaaggcttctgtgctggaccctgtctgcttatctgtgtgcaggtggagcctgagttttttaccaggttgttttatttttgcctgttgctgtgacttttcaggcaggccgcttctgcattgagtcttccccaactgattttctctttccttctctctcgcacacagttaggaaacataatgtaattactacccatgacaaaaccatcctacgtaagaaatggaacattcctagtacagatgctccccacctatggattccttccttatcccttctccctctgcacgcccaacgtctatcctgacctttgtgtctgtcataccctcactttttaaaatagttttttaaatcgcttctttgtatccctaatacatcactttgttttgcttctctgaaactttataaaaatggtgctatggtctgggtgtttgtgactccataaaattcatgtgctagaattctaacccccaaagtgatggtatcaggagatgggccctttggtcatgagtgggattcataagagcccttataaaggaggtcctgcagagctacctagccacttccaccatgtgagaacacagcagttgctgagaccagtccctcacaagacaggaatctgctggtgccttgatcttggacttcccagcctccagaactgtgagaaataaattgttgttgtttataagccacccagcgtatggtattttgttatagcagcccaaatggactaagacaaatggtatcatgctgttaagttctcttctgcaattttcttctttcaaagttgtttctataatacatacacagtgctgtatagtcctgtaattcattttcactgcagtaaaatattccactatgtggctataccacaatttattgacctagtgataaagccacttggtgatttgttggttcttttttttttttttttttttttcaatttggggttggaaacaattgagaagaacccaatttgtatcctggtgtatgcatgcagacatcacacaagatgtaatacctaggagtatatacaaatatccaactttacaataaaacactagaactatttccccaattggtggtcccaatttcacttctaccagcaatgggtaagatttattaatttacatcctcaccaacacttagtattgtcacacttcttgatttttccaggtgagtgaatgtaaaatagtatttcaccagcgttttaatttgcatttccctgatcactaataaagttgagacctttacatatatttatcacattccctctttttaaaagtgtctgttcatgtcctttgcccatttttctttggagttgtgttctttttgatttgtagagctctttgtatattcttgatactcatctttagtcagttatacttgtttacacacattttcttgcagttcatggcttgtcttttcactttcttcatgatgtcttctgacaagtagaattcatgtcttttcttttgtggtcagctccctatcttttcatgaagtctttcttgccctgaattcagaaaacattctcttatattttctttttttttttttttttttttttttttggagatggagtcttgctctgtcgcccaggctggagtgcagtggtgctatcttggctcactgcaagctctgcctcccgggttcacgccattctcctgcctcagcctcctgagtagctgggactacagacgcccaccaccatggccagctaattttctttttttttttttttttttttttgtatttttagtagagacagggtttcaccatgttaaccaggatggtctcgatctcctgacctcatgatctgcctgccttggcctcccaagtactgggattacaggcgtgagccaccgtgcctggccagatagtctcctatattttcttgaaaatgtttttaaattttgcctttttcgctaatccatttggaattgatttttgtatatgtgggaggcagggatccaacttcatttttcctcatatgaataactgtctcagcatcacttgttgatagtttccacttcttcatagatgaacaaggccacctctgtcctgcataatgctttgaaagagcaggaatactgttgactctattcagtatcactgataaatgtatctgtctttgtgctactatcatgtggttttaattgctacatctttatgataaatcttgatgtacaaatatctcaagatccctccttacttattcttcctcaggaacttctcaaccatgcttgagcttttgcctttcattataaattgcaaaactagtttgtcaagttgctcaaaataccctattggcattttgcttggaattacagtaaatcaataaatcagcttggcaattttggcatctttacaaaattgtttctttcagttaataatgtattctatctctctattgttaggttttaaaacctttcaatgaattcttctaatattcttcataaatatctaatcttagtatattgcattttccctctacttatttggaagtttacactgtattcttttacttattgcccttgaaattttaacatgtatgcttaagtctaaaattaatatcctaaacaatcctctgaaacaatgtaaggaccttggaacactttcactctaatctttcctacccatgctattttagtctgcccctttttaatccccaattcacattattattaccattattatattaggcagacattcttttagatttgcctatatgtttgccaccacctttgctcatcattccttcttgcatcacaaaccttctgtctgaggtcacctttcttcccaaaatacagatgggccttgaaggtcctatagtgaagttctattggtgattaactgctggttctcacggtgctgagatgaggacctcagtgcttcctgtgacaccatgtggaggagctgagatggagaagcagaaggacttctaattctggaaaggcctgttaaattaagcttagcctaaagctgcctccttacgtattttaagttcagcctaaaggtttctctgtacatagtgaaatgtaacttaactggatgtgtaaacagactataacctactcttgtgccagccaccgagttttagccaactgttcaaatcatgttcaaataaggcaaatgccaagctgtaacccgtccagctgttgctgtacctcacttgtttctgtatatcactttcctttttctgaccataaatcatcttcgacaatgcagtatcactggagtgtctctgaatctcctgtgattcgacaggttgcctgattcataaattatttgctcatttaaactatgttcaatttaatttgtctttcttttgacacgcccaaagggagacccaggtgcctctctggcggtggggggtgagagtcctcagtggcagagagtgttggaatgaaagaactttgcctgcacactgtctctatggagaccacatacacaaaggcccccagcacaagagaactacgcagagctggagggagtccatggactgtcccacggcacactagaatctatcacctctgtcccttctccatgctcccaactgcaaagggaggaagaggtggtgtctttgaggtagacatagtagcccctgtcatccttctattccagggtactgcagtgggagggagggtgcccaaaggagcaaaccgtgctccccacatccaggcccttagccatgcatctcacctgccattagtaggatatggaatcaaaagcttaacattaattatggcttttgttttgaatttctactttttactatggacattttcacatacatatgaaagtaagaaagaaaagaagtattctgtttgagaaatgcaagcctcctttaaattatcagacccaaagagacactggaatgagaagcagtcgtgtcccactgcccccttaagcttagtaatgatttcgaagctgcttgctaggcaggctccagactgagaacccacatagcctgccaccctctggattatacccatggcatctttttttgtggggggattgggggggatattcatcccttcaaggatttatccattgtgttacaaacaatccaattatattcttttatttttaaatgtataattaaattattgactatagtctccctgttgtgatatcaatactaggtcttattcattctatttttttgtacccattaacaattccccctccctcccacctccccactacccttcccagcatctggtaaacatccttctactctgtatctccatgagtttaattgttttgattttttaaatcccaccaataaacgagaacatgtgatgtttgtctctctgtgcccggcttatttcacttagcataatgacctccagttccatccatgttgttgccaatgagagaatctcattctttctcgtggctgaatattactcccttgtgtatatgtaccacagtttctttatccattcatctgctgagacactttgcttccgaatcttggctattgtgaacagtgctgcagtaaacatgggcatgcagatatctctctgatatactgacttcctttcttttgggcatatacctagcagtgggattgctggatcatatgacggctctatttttagtttttaggaaccgccaaactattctctatagtggttgtactaatttacatccccaccaacattgcacagcagttcccttttgtccacatcctccagcatttgttattgcctgtcttttggatacaagccatttaattgatatatcattgtaattttgatgtgcatttatccgatgatcagtgatgttgagcactttttcatttgcctgtttgccatttgtatgccttcttttgagaaaatgtctattcagatcatttgccttttttaaaatcaaattattagatttttttcctatagagttatttgagcttgttatatattctggttattcatcccttatcagataggtagtttgtatatgttttctcccattctgtgggttggcttgacactttgttgattgtttcctttgctgttcagaagattttaacttggtgtgatcccatttgtccatttttgctttggttttctatgcttgtgaggtattcctcaagaaacttttgccaagaccaacgtgaaagttaccccaatgttttcttgaagtagtttcatggtttgaggtcttagattgaagttgttaatccacttgatttgatttttatatatggcaagagataggaatcaagtttcattcttctgcatgtggatatccaattctcacaacaccatttattgaagagattgtcttttcatccaatatatgtgcttggcacctttgtcaaaaatgagttcactgtgggtgtatggatttgtttctgagttctgtattctgttccattggtctatctgtctttttatggcagtagcatgctgttttgattactgtaactctgtagtataattggtagtcaaataatgtgattcctccagttttgttccttttactcaggatagctttggctactcttgtgattccacacaaattttaggatttttttttcaatttctgtgaagaattacattggtattttgatagagattgcactgaatctgtagattgctttgggtagtatggacattttaacaatattgattcttccaatccatgaacatgaaatatctttccattttttgtgtgtcctcttcaacttctttcatcattgtttcacagtttcattgtagagatatttcacttctttggttaattcctaggtcttggattttatttgtggatattgtaaatgggattactttttaaacttctttttcagattgttcactgttgacacatagaaatactactgatctttgcatgttgattttgtatcctgcaacattactgagttggtttatcagttctaatagtttttcggtggactctttaggtttttccaaatataagatcatataatctacaaacaaggataattttacttcttccattccagtctggatgccctttatttccttctcttgtctaattgttctaacgagaacttccagttctatgttgaataacagtggtgacagtaggcatccttgtcatgtcccaaatcttagaggagaggctttcagattttccccactcagtatgatactagccatgccagctggtatctccctaggtcacatgccaccctaattgattggctgtatacccaacctggcactagaagttgcctaggaattgcagttcttgtgtcctagactgcctttcaagtttacctaggaccccagagcacttcaccctgtggtggctaggcttgccaagaaactcaagttctgaccactggctagggctggttcaaatgctccctccatgcctgagcgctggctgagcccagcatggctttattctctgctgtgacagagcagcactgagttccatgtaaaatccttcagtcaccatgctctccctccccagagtgcacagattctcttctctatggtgcatggccactgctagggggtggggtaggggtggtgtcagcaattcaagactgtctctcttgccttcctcaatgtctctttccacaatatgaagtgaaaaccaggtaccacagttgctcacctgatttttggtcctcgtgatgatgcttttctgtgtgcagatagttgataaaatctggtgttcctgtggtggggggcgggtggtataggcttctattccacatctcgctctgccccttctctgtttttcatgaaggacactagaatcttcccagtcatcaggttcaagatactggagtcactcatccatcccctttccctcgactcccttattcagctggctgtcaggttctgtcaattcttcttgcctagtatttctcctaaatatcctaccctctgttccagaatgatttgaaactgacctctagagaaagaggatccgtggaagagttttctagtgatctagaaggctatcagatagaagagggaggcagagatatagaccaaagtaggtgaaagtacacattagtccctcctctaggccccaagagttacacccattcagaagcagggattgtgaaagagcctgctggaacaaagaaggggacagagggggccacctcaagatccctgaccacaaattatttttcctaggctgttaattgataattgattaataatagttataattggggtattataattagtaaattataattttttattataattttaaatttatatataattttaaaattataatttactaattgtaatgccccaattataatctgtggccagttagaagaagagtatgggactagtttgtgcttgagccacaattccaggtctactgggataaattgaggagcagaggctggacaagagccataaatcatcagtggttatgaaaccacctttgcaaatttatgatggtgagaaaattatgacagggaaagagatctgatccaactaacatccatcttgctcttgacctccaaactgcccttgatcattcctgagtttaggccaagctaactttgggagacatttatgtaaaaagtaaagtagaggttcctcttcaaagactttcctccccatctaattagaaataaatagtaacttctcttagaagcaaaatttattcaaagacctgtgctaacattcttaaatatctgctagccgtaatagagaaatcaatgtactttatgttcttagctcccacaatttagcctaaatatttgccctggcatgcttatactggtccaagcaagcattaggttatagcctgttcctcttccttatttgaaggtatttttacctttctcagcattccgcaagttacttcctccttcctttgttctcctctgcctttgcctctcttaaaaagctctaagttgctagccaatcgggacaactacagaatatgaggtcccgttccagccagtggaaaccggacacagcagtagggtgaacacatcaggttataaatgaccctgtctcctttgttgagtgtactcttatggcaaaactgctggcgagtgtaccctttctgcagaaagtataaaaatggccttgctgagaaaattaaatttattttcaagtgctatttcattatggtactggggaacaaacatttcaaacatttagtttatagtttaaatgataatagcccttccctaaaactaacccacctttgtaaagctaatgaaaggccaccaggttaggaggatgagaggagcctagattctgccaaggtgtagaggtaaacaattaccagccattattccagagatcataagatttgcaactcccccaattactcctgcagataatatcatgattgtagaacctcagattgacaatttgagatgtattttcaggtttttgcatttctgacaatcaaccgatggctccacctggacctgccaaccccgccaagcagtcgtggacccagaagcagactccctggcctgccaaactatccttacaaaaccctagcctccaacttttcaggaagattgatttgagtaataactccatttaccacgtggcacggctggcctcaatgattaaactctattgcaatgctgtggtctcagtgaattggttttgtctgtgcaatgggcaggaagaacccatggggcggttacagttacattcattcattccataaatatatttgaatactcactctgtgtcaggcactttgctcaatactgagggtataggaataagtctgccatcatgaaacatagtcagggagtacagcgaatggggagaaaaattaaacagttcttcaaatatacaacgagtgatggtaggcattgtaagggaaaaatggagtagggagctgagctggccgtggggatgcaccccaaccaccttgcacatgtgttctcaggacctcctgagggctgtcatgggccatggtcactcatatttggctcagaataaatctcttcaaatattttagagttcgactcttttcatcaacaggtgggaatagatgatcccctgccaggtttggggagaaaggtgtgaggactaaactctgatttttttatcttgcccaaattcctgaggggtctggggagtcatgccctacaaatcataaattctcatcagatgggttttatttaaccctatatattgtgactgactttccaacctagctctggcataacattaggagacaaggaaaaaaatcaaaatattttaccccaaaacatgtttctttgccatattttgaaatgaccctgcaaagttgttctttgtgggggaaaatgtgcaactgtaaagaatctctgttaacatagctaggtttttttcttccagaccctcctaatctcctaaagagattaactgagacctgaataggaaacatttgtcatccattgtctctaagggcagccacgatcagacttcaaaagaactttggtctccacaatctttatcttaatctgaactttccctttctatgaattccaggtctttagacaaactcaaccaattgtcaaccagaaaatgtttaaattcacctacagcctggaagccccctgcccccctccttcctgctttgagttgtcccacctttctggaccaaacaacctatgtatatctttttttcttttcgttttttttttttttttttttgagatggatggagttttgctctgtcacctaggctgaagtgcagttgtgtgatctcagtttactgcaacttctgcctcctgggttcaagtgattcttgtgcctcagcctcctgagtggctgggatcacaggtgtgcaccactatgcctggctaatttttttgtatttttagtagagatgggggttacaccatgttggccaggctggtctcaaactcctgacctcaagtgatccacccacctcggcctcccaaagtgctgggattacaggcgtgagccactatgcccaaccccaaacctatgtatttcttcaatgtatttgattgaggtctcttgcctctctaaaatgtataaaaccaggctgcaccccaaccaccttgcacatgtgttctcaggacctcctgagggctgtcatgggccgtggtcactcatatttggctcagaataaatctcttcaaatattttagagttcgactcttttcgtcaacaggtgggaatagatgatgccctgccagtgtcagggtcaccctaggccgttggccccctgaggtcaccagcactttcctggatttctctcacaagttctccctcattctggctcaggaagagagactgcttctctcacccctaaacactcacagacactgaggccctttcttatcctggagcaagcagaagctcttgacaagcccaataaagtcaaaaagcagttacctaaaaagagaaaggaaatgcaccatcctcttcctgcagctgcctccccggaacaggcctcatcagccctacctctggctgtggcaatagccttggggtttcaggaagataacagttacagctactccactcttaggggctgaattgggtcctttcaaaaagcctgtgttgaagccccagacccttagaatgtgactgtatctgtaggcaaggcattttaagaggtgattaaggtaaaatgaagtcatgtggttgggccctcatccaatatgactggagtcctcataagatgagaagattaagacacaaacgcagagacctggggaaggtggctatctgcaagccaaagagagaggcctcagaagaaaccaaaccctctgacatattgatcttggacttctggcctccagaacagtaagaaaataagtttctgttgttcaagccacctggtctgtgggttttgttatggcagtgaggactaaactctgacgtttttcttctcttgcctaaattcctatttaaggggcctggggagtcacaacctacaaaccataaaatctcaacagaggggttttgtttaaccttacataatgtggctcactttccatactgactctgacataacatcacatgacggataagaaggaaatcaaatattttaccaccaaatatgtttctttgccatattttaaaatggcctgcagagccattctcgtgggggggaaattgcatttgtaaaaaatctctgctaacataactagatctttcccccttccaggccctcccaagcctgaagaaattaattgagtctagcacctttttggggtctgaatagaaaacatttgccatctattgtctctaagggtggccacccttgaggcttcatctacataatgagaaccctggtctccacaacctcttatcttgacccggacactcccttctattgattccaggcctttagataataacttaactctttcaaccaatagccaatcagaaagtcttggagtccccctatgacctgtaacccccaccccgactccctctttgagttatgccacctttcgaacctgaaccaatcataaaacctggctgcagcccaaccaccttaggcacatgttctcaggacctcttggaactgtgccttaggccttggtcactcatatttgcttcagaataaacgtctttaaatattttacagagtttgactttttttatccacagcagcccaagcaagctaacgtatcctccttcctcatttcacccaggaaggaagtgaggctggatggggaaagcacaccattgacctcaagccgcaagatctgcactggttccggggctgggactaggacccagatctgattccagtgcagcgtcccatgtccagacccattcaacttggaaaccaaaagtaaaattctaggccccacaaccaactgaacggacccctcctctcagccaaaggcattccaaagttaacctgagaaacagttcagactgtgatgggaagtgggggttggatatgccttattatgccctctccccctttgaaattcaggcacaactgaccagcattaacattaaaacaaaaatctgaagactgactaaacagactcattgtagcaataagacaccaagttctatcctggctctagtatagcatcacatgacagagggccctgaaagaaattaaaccattttaccccaaaatattaatatacatatttgacatattttgaaatggccctgcaaacctcactcttgtggggaaaatctgctctgcaaagcatccccttccctttccaagtcttttccctgatccaggcatctttttaggtctgataagagctctgatgcctgcttcctggaggcttcatctgcatgataaaaccttggtctccacaccccttaacttaacccagacactcccttctactgagtccaggtctgtaggtacttacttaactctttcaaccaataaccaatcaggaagtctttgaatccacctatgacctggaagcccacctcttcgagttgtgccacctttctggaccaaaccaatgtacatatcacatgtattgcttgatgtctcatgtctccctaaaatgtataaaaccaaaatctagctcaataaccttgagcacacgttctcaggatctcctggggctgtgtcacaggccattggtcactcatatttgggtcagaataaatctcttcaactatttcagaatttgactcttttcttcaagaaactggcccctccacccttagcttcctctcactgtgtatacagagcacccttcctgagcacgtctgattgaatttctccaaataagcaccttcagtaacccagctccacctactcggcaacatctgaacaaactcagctccgcacccaaagcccttctagttccatcctaagtcaatgcttctcaaactttaaagtgcatcagaatcacctggaggggctgttaaaatgcagattcctggccccagcttccagagagtgctcctcagttggtctggggtggggaccccaaacttgcatttttaacaagtttccaggtgaggctgatgctggtggcttgtggaccacagcttaggtagcactggctaagataccttatcccaggacccttcatgcactctccctccatccagggagctgcttactctgccctcagcaccccatgcgcttgagcctttgcccagcctggtcctggtccaggaattccctgctgccaagtctgatgcaatgggtcagatcctggaacctcctaactcaggataaagttgagaggttgtgctgctttttaaagggaaagccttattgggatttgaaccagaactggaaggactgtagtaaaatgcagatatttgggcccacccccagatacaggcctcgctgtgggacatgctgctatggtcactttctccatgtacagatgaacaaagggtggcccagagataggaagtgactttcccaagggcacacagcacattagacgagaggctgaagaggaagtcaagtttcaagtctccctcctgcgcagttctgtgcttcttgtgctgccttttccaagcttaaggggctctgctttttccccttccctcattctactttcttgtgaccccagctgggccccagcatttccagctgatgctgaaatggagcctcagggggctgtaaaacttggaaaaggaagaagagtagaggaaggggcaagaaaatgagaggaagagagccaggcgtggtggctcatgcctgtaatcccagcactttgggaggccaaggcgggcggatcacgaggtcaggatatcgagaccatcctggccaacatggtgaaactcagtctttactaacaatacaaaaattagccgggcgtggtggcacatgcctgtagtcccagagaggatgaggcaggagaattgcttgaacccaggaggcggaggctgcagtgagctgagatcgcgccactgcgctgcagcctggcaagagagcaagactccatctcaaaaaaaaaaaaaaaaaaagaaaatgaggggaagagataaaaccctttgtggtgaagggaggaaggaatgggaagtcacccaaggctgtccagggagctgggggtggggctgtttctggaacctaagcacacgtaccacctccccttcctctgacctaatgagggctcgagttggaaaccacaaaccctcgttggccccacaggagccagcctctggcttctctctgcaatggccatgtgctgcagacccggagtgggtagttagttggttaatgccagtcttcctcccctggacactgagttctgctgacagcccccgcccagccagagctctgctgtataccaccgggagtggggctggtgtggagcctggaggtcgcccgctgccctcctagggctgctccagacagcattaaaacgctgcaggtcgcaggtgagactaacagctgggagagctgctccaggcatttaggaccctgactggggcagatgagtcagcccagtgggggcagggctcctggaacgaggatctacagttggagttgccccactgtcatgtcacctggagaaaaactggacccaattcctgacagcttcattctgcaaccaccagtcttccacccggtgagttgtcactctaatgtggaacctcctcggtctctgggctcttcccttccaactgggcccacactcctgggtggtggggtggaaaggacctcagtctttctgcttctcccagcacctgccctgggttctggaaggccctcctgagcttagtaaagtggctgactgctaattcccacttgggtgtaaatgactgctaggcttccagggtcactgcattttgaaagtggcgaagcctggagccacagtgctctgcccctactgtaatggatgctaggaggatgagggtgtgggggtaggattgttgggggaatgctgattacttagtaaggacagtctcatccccagcctggaaggaagggtcaggtgggaatttccactcagggataggggttgggggtgtttctctctttctcctccagctcagtcagtgcccaagaggttttctgaagccaggcaatgatttacagaaggctgaattcccagcagacaccccctactaatgagcattaattatcactttcccttacttggccctcccctcccatgagagctgcatccactcagttaattacaggcctggagggagcctgggaatgggaagtgatcaactgctgaaccaaccagctgagcttgccaagctggcatcccaagcctccctcccatgcttctcaggtgcctgaggaatgggctgaagcagctgcccaggttacggcagctccttgctttagaggctgagagctcgcacctggagggccatcctggtggttttcagttttttctaggtggtttgggttcctaaaggttgttgggagttagagagcaacacaggaaggccaatcctgtgataccactggtatgtacctgccatcctgctcacattcattccaaacacatctatgcagagccctcacggcgtcaggtgaggcactgagcctacaggagggaaagagaaggcttcagttttgaggggcttataaactagggaaaaaagccaaccagtcgctctaagccaagggccaagccagccacatgagcaaaatgccctgggagctcaggggaagaaaggaataatccaaggaacccaagtggatgatgcttggaaagagtcagggtggaaagagacaggaggaacagcccagaaaaggcaggaagttgtaaaactgtatgatgtattttaggaaggccaggcaacttctttttttttttttttttttttttttttgagaccaagtcttgctttttcgcccaggctgaagtacagtggcatgatctcagctcactgcaacctcctccatctcccaggctcaagcaattctcctgcctcagcctcctgagtagctgggattagaggtgcatgccaccacacccagctaatttttgtatttttagtagagatagggtttcaccatgttggccaagctggtctcgaactcctgacctcaagttgatccacccgcctcagcttcccagagtgctgagattacaggcatgagccacagagcccagcccaggtaacttctacatggggaaaggtgagcctgggaaggccattgttaagtgcctctccaggggtccatttcagagttagctgtcagttcctaacttgtccattcttcttgcctcccagttcctagtctccagccactcaacagtcctcagaaagccccagtaccaggcttctggggaccagggtgacatctagtggatggcaagcctccctggggtcactgcagcctgttgtgtcctaggagctggggaaaggcaactggctggtgctgaatttggcaagggagcggaatttgacttctctggtgtaatgcagctttgccgtgtgacggtccaggaaaggggattaggtggaagaaaatatttcagtgaacactgatttttacctataaggaattttctgtttggagaggaaaagttgagttttattctgctcctttcctcccactcgcctgacatagaggtccctaagccctttctccaaacctgcatggatgagtttcttttcttgttcaggtggttccttatgtcacgacgatttttggaggcctgcatgcaggcaagatggtcatgctgcaaggagtggtccctctagatgcacacaggtaaggcgggggaggtggcccagggggtgctggagctcagccctagaggcatcgagctggagggctcctccctgccactgagatctctgtgggtctctggtcagaaccgcactttgagagcctcacctcccagtaggtttcaggtggacttccagtgtggctgcagcctgtgtccccggccagatatcgccttccacttcaaccctcgcttccataccaccaagccccatgtcatctgcaacaccctgcatggtggacgctggcaaagggaggcccggtggccccacctggccctgcgaagaggctccagcttcctcatcctctttctcttcgggaatgaggaagtgaaggtgaaggaagggacgggcattgggtggtctagaatttgtgtccttgcgcccttccttccctcagccagactccccacgacacaatgttgagtggcattggtagtggtcaggtaccaagaggaccaaggagctgccatgcccggttccaggctgccctgggcccacatggcagcaagaaagctctacagtgcctggctccaaagagggcactcctgccatagtcatggcaagcacttagagagaacctactgtataccaggaactgttctaagcccttaaaagtatctgctcattgaatgctcacaataaccccattaggtaggtaccttcattatccccatcttacagccacagtggcaggggagagggacagagaacttgatctcaaggtttagacccctaatgtgagctcctgccagaaacatgatgggatcttcagacatctccaggagacagggcagctggcgggagggtagcctcttgagcctcagtttcctcacgtaaatggagcaaagatgactctttgggctgctgagaaagcacaatgaggggcctctgttggggtagagggagcgttgaaggtgccttagtctccaggccagctctgcaacctttggaagattacttaagccgcccaaggctctgtaaaatgtacctacctcatagagatgacgtgaagttaagtgaggcaaaattgaggaaaaagtgcttggcaatgcctgggacattgttatgaactcaatgaacattagctgctgataagccagcctctgtctgtctctccaggtgagtgtgaatggacagcactttctccacttccgctaccggctcccactgtctcatgtggacacgctgggtatatttggtgacatcctggtagaggctgttggattcctgaacatcaatgtaagtttccttgggaccaaggcctgggcagtggcagcctctaatttcccctgactcctggacgggcctgggaccccttcctccaccctagactgagagagaggacgccctgtgcaccagtaatagccaagggggagggagtccactgaggtttcgggtgtgagtgggctgagggggaagagaaagtgatggcagaaagggtgtccaggagccgcaggcaggagtctgtaaccagtgtgggtctggttaacactgagaagcaatggccaggaatgatttggcacactgggggccgaaacgggtggcagctggctttatcattcccacctgatgggcttattaaagcccagatttctggggcttgccaccagagattctgattcagtaagtccaaggtggggcctaggaattgggatgttcaaaatgccagcaagaagctaccactgaccagccgaatgggaacatgaggagctgtaaaggccagggctctgcccacctcccaggcataggtaggggattgcagtggtcctaaatgctgctgattcttttctctctttctgaacagccatttgtggagggcagcagagagtacccagctggacatgtgagtttcttggcagcaaggtctgagcagccacaccagctgacccgcccttctggactgctgctcccattacacaaggcccagctgccccttccctcactgctgcggttgccacggacatggctggctctgcttcagtctctggagggcctggattttcctctcccagcccctctccaggcccagcttgggaagatgaatgggggtgggctgcatgcagagggggcaagaccccgtattcctagcaggagaggccttagttgaaatgctcatttctcaaaccacctctgcaaggtggctggggttggtcttgcgggacagaaggggagatgaggcccatgtactgcccaaggccacacagggagtggatgacaaatcctccaccccgttcttccctattattccagcgctggtgaacctctgaagtccagaggatcccactggggctccaatgactcacctactgctgtgagagagacaagccccaaatattcccaatttgttagaataacaagagtttcccttttcctgagcaaataccacatggccttgtgtcctctctttctttccctgacagcctttcctgctgatgagccccaggctggtgagtgaacctccctcctgctctgtcagggctgggggcgcagcctgggtgagcagctaatgagctcagcctggtaggacatgcccccagcctcaggatttccccttcctttatagaaaactgcaggctgtgggtgggccaggcagcttatgcccccagccgcatgatttccccttcctttatagcaagctgcaggctgtgggtgggctgggcagcttcaggctgaagctccagcttcattttaccttttctccacttattgtgaacatcattacttgatacttctctgtgccaggcccggtgccaggctctaggatagaggaacaagctggtcccagccgtccagttgctcacaggctggtgggggacagaccactagatggcaattacagttaaggatgcagtgaagggagaaggacatggtggtcgggacacagagaggccaagctcagcctggacaggccggggaaagtgttcggcaataacagagtacaggaggccaggtgcttaacaaataagcagcgtgtcctggcggcaggcctgggcagaacatgcctgccccagtgctcccctggcccccggggatgggcggtcctccccagtccccctggaagtcaacttctcaatacctcccttgttccttcaggaggtgccctgctcacatgctcttccccagggtctctcgcctgggcaggtcatcatagtacggggactggtcttgcaagagccgaagcagtaagtatccagcatctaagtggaggggagggagcagcctctctgtgacagtcacatgctataaaacatcatctcttttaatctcctagcaccaccatttaatccccattttacagatgaggaaacagaggagcagaaaggagaagtggcccaatttggcagagcttatgaaggtcaggctgggactgggaccgacagccccactgctgggagcatcattcctgctggtacatctagtcaggcctagcctcttgtcccaggtcctaggaaaggggccccaggaaaggcccttcgtaggtgcaggctgaggcccagagcaaacatgtagcttcctatggtaacacaatgtgtggttcaaaagatacagccagactgccccagagaagagggctggtatttggaagccaggacttggagggacccagtgactaagtggacattaccaaacttctcctacatggtgctttcaaacccagacctgtggctccaatccagttagacaggagccactggccggcctgccttgaggaaacgcattagagtttatgacttctctgggccagaatgcctgggttggcatgtgctcaggacacctacttgtgcaaccttaggacagatacttttcctctctgtgcctctgttttcctctctgtaagaaggggatgataggccgggcgcggtggctcacacctataatcccagcactttgggaggccgaggcgggtggatcacgaggtcaggagttggagaccagcctgaccaacatggtgaaatcctgactctactgaaaatagaaaaattagccgggcatggtggcgcatgcctgtaatcccagctactcaggaggctgaggcaggagaatcgcttatacccgggaggcagaggttgcagtgatccgagatcgcgccactgcactccagcctgggcaatagagcaagactccatctcaaaaaaaaaaaaaaaagatagagggggttgataataatgccgactttaggggtggtacttagaatagtgcctggtacatggtaagtgtccacaaatgtgggtactactgcaatcatctcagtggaggtaggggagggcagagtaaggaaagcaccctatgttctccttgcttaattttgtttttatttttaagtcactgacctcactaaacccttgccctgcacactgccgatcatgcctgtgaattctgggacaggcatgaagcccagcactcgatggcctcggcctccaaagacaggcatgactgagttggattcctggttttgtctcttataaacagtgcggtcgtgggccagtcactaaacctctctgagtctgagtttccctaccggaaaaaggtgaatgataattccaacctgctagggaaaatgaaaagtgctcagtgatggaacacttcttcccacaaaacttggaggcatgagaccgggttcatattgtagctcaaagtcacaaggttactagtgacatagtcagcaagtaactgctgtttcccaagggccatgaatgcatgtgtcctcagaggccagacaggtctcataaatagtgaggaaaccagttgggaaggtggtaaaggggaaggagtatctccatacacccagtcatgccagatcttctgactatttttaaagcaaaaatagaagccatcttttatataaactctctcaatttttgaatattatattaaagttgaagaatactatggaccagacaaaacattcctatacaccagttcagccgagatccaccaacatgaagatttagcacagcacctggtatttagcgaggctgcaaccaatgcagctgctgctattttgtgaaagcaactgatggcttgaatggggcagagagagtaagagatggagggcacaggattcatctgcagtgaaaatctatccctccttcttcacctcatcccttccctcctcgttattgagtgggagtgtatgactgcagcctcaaagagcttcaacagagcttcactgggcatctggtgatttgtgattattcagtgatctagtgggcatctagtgattcatgattatccagtgatctggcgggctgagctgcatgaaggtgaggtagggagacactgaggcctcctcaccaggagttcgcaggccagaggaagacacagtgttgtctggcaggacggggtagggggagccatagtggggctggaggctccacgcagtccactctccagggttcctgccttccaagcttcttcccaacattgggccctggccacctccttcccaaagttggaaacttacggggcctcctcctgtaaggatctaccaatagcccttgaaaggcctgtccagggcggccttttcccctaccttacctgcctctgcatcccatcaggatgccgcgccttctccagcatagctcttcaagaaggaaacttgggaagttcccaagacataaaaataatctgggccgggcgcggtggctcaagcctgtaatcccagcactttgggaggccaaggtgggcagatcacaaggtcaagagatcgagaccaccctggccaacatagtgaaaccccatctctactaaaaatacaaaaattagctgggcggtgcgggcatgcgcctgtagtcccagctactccggaggctgaggcaggagaactgcttgaacctgggaggaagaggttgcagtgagccgagatcgtgccactgcactccagcttggtgacagagcaagactctgtctcaaaaaaataaaataaaataaagaaaaataatataatccggttgccctatttgagaggcaggtgccagatccccccacccccaaatctagagtcatgaatcctagttcacatcctaacctaaggccctaccactattactagtaacagagaagtcatttaacttcttgtcctcatcacttaaatgggctgacaaacctcacagcacagaatttgtgaggattaaggaaaggcaaactagcttctgtaaaacacctactgtgtgctaggaattgctagttttcacatacattatctcctttgttcctttttttttttggctctatgaggtagagattgtattatatagcaatatttttaaacaataggtatcatctgaatgcttattacgttccaggtgctattctaaataagcatttttttatgtattcatttaattcttacaacaatgccacaggcaggtacagggcagttatgttatcgtcacattacagatgaggaaactgaggcacagagagattaagagtcttgcccaaggtcacaggactagaaagtagcagagccagggttgaatcgggactgcctgactctaaccactatgctgtttggaaaacatttaagataatacctggcacttagttagcattcaataaatgttagctgtagctatcatcatcataatcatccccattttcaggaggagaaactgaagctcaggctaggcaattttcacacacttccctcccacccccatcctcctgtagtcatagatggcaaccctggaggtcaatctcaagttcatctagaactcgtgttctttccactgttctgagcattcagccatgaggctgtcataggccctcagtgcttgtttctggaggctgaagcagctcaaccttccatccactccctgacctccatccttcccctgggggctgagcagcggcctatgggcaatgggcgctgattccttctccttcctcctgcttcctgcagttttactgtgagcctgagggaccaggctgcccatgctcctgtgacactcagggcctccttcgcagacagaactctggcctggatctcccgctgggggcagaagaaactgatctcagcccccttcctcttttacccccagagattctttgaggtaggtcagagccaaatgattacatcccttcaggctggagcacagagctgaagtcccataatgacctgggagatgctggggcaggtgtgcaggacagatgttatggggtgggaggccagagccagcagagcacagcgaatgtctgtacagcagtcctcaacgctccactctgatgccagggatcccatggccagaaactcaattgatgcaggtgggggggggcccaggcatcagctttattaaaaagctcccctaatgattccgacgtgcagaaccactcctctacaggaagcagccccagttacaggtggtgaaactgaggcccaaggctgggaagatccttgtcaaagaccacagtgggctggtgacaagccgggccccttatcctgttcttttccagcactgtactgggtgccccctgggtccagtcttcgtgtcctatgagaggaggagggtctcactggagagagcgtcaggcagacaagggaaagtctggctggaagctgcaaccccctcatgtcctcctttcccaggtgctgctcctgttccaggagggagggctgaagctggcgctcaatgggcaggggctgggggccaccagcatgaaccagcaggccctggagcagctgcgggagctccggatcagtggaagtgtccagctctactgtgtccactcctgaggatggttccagggaaataccgccagaaaacaagaaggtcagcccactcccagggccccactctcctcccctcattaaaccatccacctgacaccagcacatcaggcctggttcacctctggggtcacgagactgagtctacaggagctttgggcctgagggaaggcacaagagtgcaaaggttcctcgaactctgcaccttcctccaccaggagcctgggatatggctccatctgccttcagggcctggactgcactcacagaggcaagtgttgtagactaacaaagatactccaaaatacaatggcttaaagaatgtggtcatttattctttattatttatttatttgtggtcaaataaataaataaggttatttatttatttcgttctcatctagcaattctagagacaatggtccagcttagcagggcagctctgctccctggagacattcagggtctgtcctagccattgttccaccacccccagggcatcatcattgtctctgtggcccaagctcagctgccaccctatcttggcctcacccactgagaaggctagtagtggcagtggacaagacccacctgatatcataagccccagacatgggtccgacacacaccagctacagtcacatttcatctgcaggcactcagtctcggtcacactacctgcaagggaggctggaaatgttcttcagtgggacacataagaccagccacatgaaatagagtagtcataaaataacagaatagttttattctattactataaaaaacagggagaatggattttggtggatagccacagtctctgagacaagtagatgctgttaatatcctcattttataacataagaaactgacgcacagaaaggctaatttgccaagatcacacagtgagtaagtcatgggattagaacccagggattctgtctgcagagtttgcggctcttaaccataaaccattatctagagtacacaggcacactagagcttccagataaagatggacatcggagctggaggcttgagaggaatcaaagaaccttgcaagtcgaaaagtacagacaagacaaacgaaggaccaccaccaaggaaagagcaagattaaatgagaaataatttaagaattatatataactgtatataatatataccatatatacatatatatagcatagtatacattatacagtaatatatgtgccatggtctgaatgtttgtgtcctcccaactaaaatttatatgttgaaatcctagcacccaaggaaatggtgtttggaggtggggactttggagggtgattaggtcatgaaggtggagccttcatgaatgggattagtgcccttataaaagagactccaggccgggcgaggtggctcacgcctgtaatcccagcactttgggaggccaaggcaggcagatcacctgaagtcaggagttcgacaccagcctggccaacatggcaaaaccccgtttctactaaaaacacaaaaattagctgcgcatggtggcacacgcccgtaatcccagctactcaggaggctgaggcaggagaatcgcttgaacccgggaggcagagattgcattgagccaacatcataccactgcactccagcctgtgtgacagagccagactctgtctcaaaaaaaaaatatatatatataaataaaataaaagagactccagagagctccctcacccctaccaccatgtgagattacagcaagaaaacaggcgtttatgaaatgggaagcaggccttcaccagaaacaaaatctgccagtgctttgctcttgaattttccagcctccagaactgtcaacaataaatttgttgtttataagttacccagtctaacacattttaaagctggacctctaccattcaccatgtacaaaagttaacacaagatggattaaagatttaaagtaagaccttgaactataagaatcctagaagaaaacctaggaaacaccattctggaccctgatcttggaaaagaatttgtgactaagtcctcagaagcaatggcaacaaaaacaaaaattggcaagtgggacctaattaaagagcttctgggcagcaaaagaaactatccacagaataaacagacaccacacagaatgagagaaaaatagtatattcacaaagtgtacatcccacaaaggtctaatatcctgaatctataaggagcttaacaagaaaaaaccccatccaaaagtggacaaaaggcatgatagacaggtctcaaaagaagacatacaagtggccaataaacacatgaaaaaatgctcatcatcactaatcgtcagagaaatgcaactcaaaaccacaagaggatatcatctcataccagtcaggatgtttattattaaaaggtcaaaaacagcagatgctggtgagcctgcagagaaaagaaaatgcttatgcactgttggtgggaatgtacattagttcagtcactgtgagaagcactttggagatttctcaaagaacttaaaacagaactaccatttgatccagcaatcccattactgggtatacatccaaaagaaaatcattctaccaaaaagacacttggacttgcattttttttttttttttgagacggtgtcttgctctgtcacccaggctggagtgcagtggcacgatcttggctcactgcaagctccacctcccaggttcacgccattctcctgcctcagcctcccgagtagctgggactacaggcatccaccaccatgcccggctaattttttgtatttttttttttttagtagaacagggtttcaccatgttagccaggatggtcttgatctcctgacctcgtgatccgcccacctcggcctcccaaagtgctgggattacaggcgtgagccaccatgcccagccggacttgtatgttaattgcagcactattcacaatagcaaagacatggaatcaacctaggtgcctgtcaacagaggattggatgaagaaaatgtggtgcatatacaccatggattactacacagtcataaaaaagaatgaaactatgtcctttgcagcaacatagatgcagctggaggccattatccttagtgaattaacagaagaacagaaaaccaaataccatatattctcacttataagtaggagctaaacattgggtggtcatggacaaagagatggcaatagactctggggactactagactggagggagaaaagaaggaaggaatgggagaaagggttgaaaaaccattgggtattatgctcactacctgagtgacgggataattcacaccccaaacctcagctttacacaatatacaaacctgcacaggtactctctgaatctaaaataaaagttgaaattattttttaaaagaagataaacctcaatttccacaaatgttttataggatatttttattaaaatgtattctgtgtatagatttttaggggcacagaggagcttgcatctctacattgcttcttcccaatcatatatacagtatatccctcaatttattttggtcatcctttatttccttctgtcactgggaaaccaagttctttccttactttgtattgatagccaagaaagaatatccaattggaaaaaaaggcaagcagattttattgctggtcaggaacggaggagtgagctctttttctaaagaaccccttccgaaggtgatggaatccagggaactttaaggaattagatgtggggcggggaggtatgtatgtaagcatgtacagggaggaactccagatgtgcagttacagatcataaacatgcttcttcatatgaggtatgttcagaaaatggcagcaattttcttctaggggtggggatttgatatggtttggctatgtccccacccaaatctcatcttgaattcccatgtgttgtgggagggacgcagtgggaggtaattgaatcatgggggcaagcctttcccaggctgttctcgtgataatgaataagtctcctgagatctgatggttttaaaaagaggagtccccccctttttttaaaaaagtttttaaacttctatttgcatatttttgaaaattttgcattccaatacttaaaatcatttgaacaaaaaaaaaatggcactctgattaaacagtattacaggctgcatgacaccttgggccagcttggttttactctagatttcattgttgtcccaccccactttttccaccccacttcttccttcaccaacatgcacgttctttccttttctgccagccagaaagtcagatgggagtggcaggcttggccttcattgtcagtagttctttggtgtgaaaggggcagcagagtcatttaaacttgatccaacctctatgcatcttacaaagttaaacagctaaaataagtaaaataagaaagcaatgcttgtggaatgtacagtgcatattggcagcacatgcctcattacgattcaccagcttgcttctcctgttcaatcatttctttggaaggcagtggatttttctcttgcacttctgtcttcttcagtttcgacttatctctttgcctctgccatccatgtaagatgtgacttgttcctctttgccttccaccatgattgtgaggcttccccagccatgtggaactattagtccaattaaacctctttattttgtaaattgcctagtctcagatatgtctttatcagctgcgtggcctaatacaggactttagcattataatgatacgttaatgatctgaaggtaacaaggcatcaccagctcagtttgctggggtcttgctctgaccttatcttcctctagtaattgccaaagagtcctgaggctccagcagcctcctgggccatctgaagttctcttaagcaaacatacctgtaggtaaaatgatttaaaaacctgtttaaggaagaacaatgagctttcttagttatctactgtttaagaaaataacaagctttctcagctatgtctccagggttgctctggtaacataagatgtgtgtgtttgtttttactggggcatcgcacaacttttgttagatttatacttaggcactttatagctttgtgtgtgatttgtaaatgctatctttttaaaaaattgtacttacttgatactggtacaaaaatgcacctgatttatgtatattaatctcgttcctagcaaacttgctaaaattatatatattttattagttcaaatagacaatcttgccctggcacagtggcttacacctgtaatcccagcgcttggggaggccgaggcaggtggatcgcttgaggtcaggagtttgaaaccagccttgccaacatggcgaaactccgtctctactaaaaatacaaaaaattagctgggcatggtggcacatgcctgtaatcctgcctactcaggaagctgaggcacaaaaatctgttgaacccaggaggcagaggttgcagtgagccgagatcacaccactgcactccaggctgggggacagagcaagactctgtctcaataaataaacaaacaaacagataggtaatcttaccacttgcaaaaaataatgatttctgatttcttcctttccaatctccctctccctctctgtctctcactcttccccccactcccaaccacattccctcgcttccttcctctctccctcatgcttcctttattatatgacattggccaagaattcttgcacactgttgagtagcagtgtggttagcaggcatccttgacctgttcctgaccacagggaaatgcaattaagatttcactattaaatatgatgattatcataggttgggaatagatactatttttagggtaaagagattttcattttttcttagtttgttaagatacactttcatttttttcatgagtgagtgtcaagtctgtcttctgcgtttactgatatgatcatattttttctaatctgttaatgaggtaaattacattaataggctttctaatttcatgctataagtatctttaaattccttaaattcctggagtaaatgaatttttaatgaatacattgctgcatttcatttactgatactactgttcttgcattaagttcataaattagcttataattttacttatccatccatcaatactatcatagccttagattctggattgtctcttttctgtgcaaggtcatcaattgtttatatgtactctaggtctttaatccatagattccatcttcctttctttttttcttacattttattgttggggataaaactgataacttttccttatagagcttctcagagtctgaattctgctggttaatccctagggcattgtttaaaatactccactgtctcctgtacttcttttcatctagagttttgatcagattcagtttcaatttttcagcaagaaaaccaaaactactatcttattccctaaatgtttcttttttaatttaatttaattttatttatatatattttcttgagagagtctcaactctgtcacccaggctggaatgcagtggcgcaatctcagctcactgcagcctccacctcccaggttcaagtgattcttatgcctcagcctcctgagtagctggaattacaggtgtgctccaccactcctggctaatttttgtatttttagtagagatgaggtatcgctatgttagccaggctggtctcaaactcctgacctcaagtgatccacctgcctcaggctcccacagtgctaagattccagtcatgagccaccatgcccagctaaatatttctttttttatagcctcctgttcttgtttcctgaatatattttctcttctctcttccatgatataaattatagggagccgaagacccgtgggatgtgaccaactcagcattccactggaggctatatgatcaaacagcaaactgtttatcataaatgcaggatgtgagcaaactcacgactgctcctgccgacacaatgtttgctgagggcaatcgcttcctggcaccaagttccttgaggttatctactgggagatctagggaatgcagtcttgcaagcctactctgacccctttttccaccccccttttcactatctcttttgcctaataaatatggagggctgtgtaaagctcagcgcccttgtccactagaggcaagttgcccccgaccccttcttcctaatatactcttttgtctcttgtcttttattccacgttcgacccccccaccctttcttcagtccccctaggtccatacggtttacatagtggcaccccgaacagcaacagaatcgggtgctcaacaataaatgatgcttttgtaaattttcttctgcttgccatattttctttgttttcttgaagcttatttgttagttatttgtgtattttgctgtctatctttcaaattagaggatttcctcaaatgcctggcaatccttagttgtttgtgtttttgttgtttttgtttgtttgtttgagatggagtctcgctctgtcactcaggctagagtgcagtggcatgatctcagctcactgcaacctctgcctcctgggttcaagcaattctcctgcttcagcctcctgggtagctgggaatacaggcacatgccatcaagccaggctaatttttgtatttttgcaagagatgggttttcaccatgttgcccaggctggtcttgaactcctgacctcaggtgatctgcctgcctcagcctcccaaagtgctgggattacaggtgtgagccactgcacccagccaagtggtttgtttatattcaagagtgaggcactaaaatgctaattggaagctttgtgtacatgggttgggcttattgacttatatgactcctcacagtgaaacaggtcaatggtcaatggtctcattgtctgaagtgttatctgagttcattgtctcatgaccaagaaaattaaggagcatggctccaaagggtgaggttgaagtaaaagtttaataagcgaaagaagaaagctctccatagtgaagaggggagccagagtgggttgccattttacagttgaatgcaaaagctcttataagaaactcctctcatttctcatgtcacctggcacatttggaccatgcaagagggcttacaaaaaaaatcaaacttaattgatgtagaacaaattccatcccatacagaatataggtctatagtttttaattttcacaaagaaaagataaccagctcatcagaacatactattggtactggtttagcaaaggttcatacttctaaggtcaaggctgatattgaaacaaaaagatgtgttcttacctggagaagccacatgagccacaagggccatgtgtactacatgggtacaaggaggagctggtaccattccttctgaaactattccaatcaatagaaaaagaggaaatcctccctaattcattttatgaggccagcatcatcctgataccaaagcctggccaagaaacaacaaaaagaaaattttagaccaatatccctgatggacatcgatgcaaaaatcctcaataaaatactggcaaaccaaatccagcaacacatcaaaaagcttatccaccatgatcaagtgggcttcatccctgggatgcaaggctggttcaacatatgcaaatcaataaatgtaatccagcatataaacagaaccaaagacaaaaaccacatgattatctcaatagatgcagaagaggcctttgacaaaattcaacaaccttcatgctaaaaattctcaataaattaggtattgatgggacgtatctcaaaataataagagctatctatgacaaacgcatggccaatatcatcctgaatgggcaaaaactggaagcattccctttgaaaactggcacaagacagggatgccctctctcaccactcctattcaacatagcgttggaagttctggccagggcaattaggcaggagaaggaaataaagtgcattcaattaggaaaagaggaagtcaaattgtccatgtttgcagatgacatgattgtatatctagaaaaccccatcgtctcagcccaaaatctccttaagctgataagcaacttcagcaaagtctcaggatacaaaatcaatgtacaaaaatcacaagcattcttatacaccaataacagacacacagagagccaaatcatgagtgaactcccattcacaattgcttcaaagtgaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatacggcccaaggtaatttatagattcaatgccatccccatcatgctaccaatgactttcttcacagaattggaaaaaactactttaaagttcatacggaaccaaaaaggagcccacatcgccaagtcaatcctaagccaaaagaacaaagccggaggcatcatgctacctgacttcaaactatactacaagactacagtaaccaaaacagcatggtactggtaccaaaacagagatatagatcaatggaacagaacagagccctcagaaataatgccacgtatctacaactatctgatctttgacaaacctgacaaaaacaagcaatggggaaaggattccctatttaataaatggtgctgggaaaactggctagccatatgtagaaagctgaaactggatcccttccttacaccttatacaaaaattaattcaagatagagtaaagacttacatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagaaaaagaaactaccatcagagtgaacaggcaacctacaaaatgggagaaaattttcacaacctactcatctgacaaagggctaatatccagaatctacaatgaactcaaacaaatttacaagaaaaaaacaaacaatcccatcaaaaagtgggcaaaggatatgaacagacacttctcaaaagaagacatgtatgcagccaaaaaacacatgaaaaaatgctcatcatcactggccatcacagaaatgcaaatcaaaaccacaatgagataccatctcacaccagttagaatggcgatcattaaaaagtcaggtgctggactgactaatcattaaaacaacaggtgctggagaggatgtggagaaataggaacacttttacactgttggtgagactgcaaactagttcaaccattgtggaagtcagtgtggcgattcctcagggatgtagaactagaaataccatttgacccagccatcccattactgggtatatacccaaaggattataaatcatgctgctataaagacacatgcacatgtatgtttattgcggcactattcacaatagcaaagacttggaaccaacccaaatgtccaacaatgatagactggattaagaaaatgtggcacatatacaccatggaatactatgcagccataaaaaatgaagagttcatgtcctttgtagggacatggatgaaaccggaaaccatcattctcagcaaactattgcaaggacaaaaaaccaaacaccgcatgttctcactcataggtgggaattgaacaatgagaacacatggacacaggaaggggaacatcacactctggggactgctgtggggtggggagaaggggggagggatagcattaggagatatacctaatgctaagtgatgagttaatgggtgcagcacaccaacatggcacatgtatacatatgtaacaaacctgcactttgtgcacatgtaccctaaaacttaaagtataataataataaaataaaaagaaaaaaaaattagccaagcattgtggcacacgcctgtaatcctagctactcaggaggctgaggcaggagaatggcttgaacccaggagacagaggttgcagtgagccgagatcacaccattgatgggacagagtgagactgtctcaaaaacagaaaaaaaaatgtgcatccagtaatgtgatcataccctccctctttcccctccaacccacttaccctctttaaatttaggagctctcaaaatcacctttggaaaacagtatggaccacagattgttcctgtggattttatgatccttttctctgtccatgtccttaactttggcaaaaataaacttttaaattgagtgagacctgtctcagatactttttggtttacagtcatgagtcaataataaacagaaggaaaaacccaaatgacctataaatgtataaaataatacgcaggccaggtgcagtggctcatgcctgtaatcccaggccaggtgcagtggctcatgcctgtaatctggatacacaggatggagcacccagagaggccatggaacctctgcaccccttcctgcatgtcttaccccatgcatctctttgtttgtatcctttaaaatagcctttgtaataaactggtaagtgaaggggtgggttgcccctccacacctgtgggtgtttctcgtaaggtggaatgagagacttaggaaagaaaaagaaacagagacaaagtatagagaaagaaataagggggcccggggaaccagcgttcagcatatggaggatcccgccagcctctgagttcccttagtatttattgatcattcctgggtgtttctccgagagggggatgtgtcagggtcacaagacaattgtggggagagggtcagcagacaaacacgtgaacaaacgtctttgcatcatagacaaggtaaaggattaagtgctgtgcttttagatatgcatacacataaacatctcaatgctttacaaagcagtactgctgcccgcatgtcccacctccagccctaaggcggtttttccctatctcagtagatagaacgtacaatcaggttttataccgagacattccattgcccagggacgggcaggaaacagatgccttcctcttgtctcaactgcaagaggcatgccttcctcttatactaatcctcctcagcacagaccctttacgggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcgtgctgccttcaagcatctgtttaacaaagcacatcttgcaccgcccttaatccattcaactctgagttgacacagcacatgtttcagagagcacggggttgggggtaaggttatagattaacagaatctcaaggcagaagaatttttcttagtacagaacaaaatggagtctcctatgtctacttctttctacacagacacagtaacaatctgatctctcttgcttttccccacaggtaagtgtaagtaagtgtttgcctgagttctgtgagctgccctagcaaattaaccaaacccaatgaggaggtcctgggaaccccagtttatacacagctaatcagaaacacaagtaaaacaacctgaagctggcaattcacatcagaagttggggagaatcttgtgcaactgagccctcaacctgtgggatctgacattatctccaattagtgtcaaaattgaacagaatgagaggacacacagctgatgtctgctgcagaattgatgaatgagtagttggtggggacaaatcacacatttcttggtgagcagaggtcacagaagacgttttgttgattattgttgaatgagagaatagaaaaagcacgttgttttttttcatgcgcgtccgtgtgaagagaccaccaaacaggttttgtgtgagcaataaagcttttaatcacctgggtgcaggcgagctgagtccgaaaagagagtcagcaaagggagataggggtggggccgttttataagatttgggtaggtaaaggaaaattacagtcaaagggagtttgttctctggcaggcaggagtgggggttgcaaggtgctcagttggggaggtttttgagccaggatgaggccaggaaaacgactttcacaaggtaatgtcatcacttaaggtaaggaccggccattttcacttcttttgtggtggaatgtcatcagttaaggtggggcagggcatattcacttcttttgtgattcttcagttacttcaggccatctgggcatatacgtgcaagtcagaggggatgcaatgccttggcttgggctcagaggcctgacattttttattcctacagtctcagaggaatatagctaaaaatgtgtttacagagaagtttatagtattagcttatattagaaaagaagatatgtctcaaatcaatgatctaagcttttacctcaaggaagtaggggagccaggttttcagcaattggccagaaaagaaaaaaaaagaagggggaggaagcatatgaaaaccaaaacaagcaaagaaagaaaatgtaataaagatagaagaagtaataaataaagtagaaaaagaaaaaaatcaatcagtctaaagctggttctttgagaagatcaataaaattgataaacctctagcccagggggtcagcagagacccaagtaataaatatgttaggcctcgcatgccaggaggccacacaatctgccactgtagcacaaaagcagccatagacaatacaaaaataaatgagaatagctgtattcatgggtcttgtaagacaggcagtgggcccagtttggactggtttggatctgtgtcccatgccaaatctgtgtcccatgtttgggccccacattgtaggggtgggttgcccctacacacctgtgggtgtttctcataaggtgggacgagagatttggaaaagaaaaagacacagagacaaagtatagagaaagaaataagggggcccggggaaccagcgtttagcatatggaggatccccccagcctctgagttcccttagtatttattcatcatctgtgggtgtttctcaaagagggggatgtgtcagggtcacaagacaattgtggggagagggtcagcagacaaacacgtgaacaaaggtctttgcatcatagacaatgtaaaggattaagtgctgtgcttttagatatgcatacacataaacatctcaatgctttacaaagcagtattgctgcccgcaggtcccacctccagccctaaggcggtttttccctatctcagtagatggagcatacaatcgggttttataccgagacattccattgcccagggacgggcaggagacagatgccttcctcttgtctcaactgcaagaggcattccttcctcttttactaatcctcctcagcacagaccctttacaggtgtcgggctgggggacggtcaggtctttcccttcccacgaggccatatttcagactatcacatggggagaaaccttggacaatacctggctttcctaggcagaagtccctgcggccttccgcagtttttgtgtccctgggtacttgagattagggagtggtgatgactcttaaggagcgtgctgccttcaagcatctgtttaacaaagcacatcttgcaccgcccttaatccattcaactctgagttgacacagcacatgtttcagagagcacggggttgggggtaaggttatagattaacagaatctcaaggcagaagaatttttcttagtacataacaaaatggagtctcctatgtctacttcttcctacacagacacagtaacaatctgatctctcttgcttttccccacaccacattggagcttagcccatgaaagaattcaaggatgagcctatggtgagagaaggcaacttttttgaaccagtactgctccttgcagagcaggactaacccataggcagcgggctgagttggcaacatatgggctgttggcagctgtacttatacccacttttaattatatgctaattaagagacgggttattcagaactttctggaaaagggtggagagtttccagaaccatctaaggtaacttccaggccattaccatggcctattgcaatggtatttgtaaactgtcatggcactggtgggagtgtcttatgctaatgagcagtgagggcaaatagaggtcacttccatcaccctctgctagttttggctggcttcttcactgcatactgttctgaccacatcctgctccaatcaacatgatcaacagggctgcaacgagaaagcaagtcctgccagcctcctacctcgctactatagtaggttagtggagggggaacatttccttgtcccaaattccagccagagtctttctcaacatctaaatactgaatgctgccatggcttcaaataaatttgcaatgaaaaaacatatttttaaatggctttctattttgctgcaggaaaggaaaacaaaatctcgggacccaaactcactaagccaaagggaaaattcaagctaggaattgggtcacccaaacctgcctcccattttgttcctaaatagatagctacaaaaataaaaagctatataactccctaacaatttgctcacaagggaattctttgtgagccccaagatcttcaccctaaaacagttctgctgaatgacaccctgatgatgtaaattgacagcttatcatcacaggtatgggagaaaggacagaactataagtcatccctccattcacctgagacaaatgcatatttgactgcttatataaaaatccagattcactaagcatgaaatgaatgcataattaactattcctctaccccctcctttcacatgtaaaatgcagattcagtgaatgctgatcaaagactcaaaggaatgcaaccacttgcctcttttatctaccctccctttttttcccttttctctttcccctaatgcccacacttttccctttaaataatgatgtccccagacgcactttggaaaaagcacgaatcacagatgtttcctatggttttctgttccttttttcctggatgtgtcctaaaccttagctaaataaatctctaaatttttgactgaaagctgtctcaaatattttttgggttacagcagctattgcatctagatatacaatataaattaatgtaaaatatcatatgcttgtaatttcatacatgctagagatatcatcccaatcagggaaagctgcaagaagaaagtgttggtggtaaagcacaacttcctagatttttgctgtcagtgggctggttggaatttaaactctttgagtattaaaaacaaatcagtcttcataactgattatttctgctattattgttacctattggagcctctaggaaaaaaagaggcaatagagaaagagaggcagtctccgttgctaatgtgctcttgtgggattagatgtctgatcctttggagcagaccatccatcctgatgtgggtcagtttggactccaagtctgacaaagcagaacaggcttcagaaagccttgtttgtcacttggaatacagccgtcactcctgcagcatctaagctttggtgctgctgaagaaaggccactggctgttttggagtcctgcattcacagaccccagctgcctggaactgactctaagctaaaacctgacactatctaccacaagctgtttcaacctcagcacaagctgcaatgaactggaagtgtaagcagacagcaagggtttccagggattataggaatttaatcaactcagcaatcagccttttacagcctaccatcctgtagcctgtttcttcctaaaccttgcatagaatgcagtcatgtggttggttaaaaccagctcctaacagatcccagcaacctacagatgaatctgagtgaactttcctcattaccatgctaaagtctccaccccggaggagctacagcttcattaccatagcatgcaacctatgtgttggcacgatgactcactgcatctgtgcaactgggacccctcctctgcatgtgccgatgcaccctctcccctctccatcacccataaaaccctcctgtcacttttcgtagggaagactgctttggagaatcctcacagtgtcctccttacttgtgccaagtaataaaactgctattgatccacacctgtgttctcatgaaaagttgtttgttactaaacgaatgatccccgttttttttcgagtaacagaagtgggcatgtatggtttcttctgatagcaaccaaatacatgtcatttgtccacatcaatcagtcctgcaattctccaacactgaccgcatgttcaacaatccgactcaattccgacgctaactatccagagttaggctcagcctccacaggtaaagtctccaggctcagcaacaaatggagttccctggctactcacatttctacctggctgactacaaatggtggagaccccctaaatcccctttaaatttgataattccctagaacaacttccaaaatttagaaaactgctttacttatgattgtcagtttattataaaggatacaactcagcaacagctacatggaagaaactaagaagaaactaatatggggggcagtgattgtgcacagcttccattgttaaagaaaaaattatctaatgatacaagcttgatatccactgcactgggattttgcagcaagagagagagatggggctcaaacttgaacacagcacgggcaagtgggaattcataggcaaggagaagcatacaggtcagtggatgcaaaattacaaagaggaaacctcaggggcaagagagattctggttaaaccacactaacaggattcttgctgaagacaggccggggtgatcagacatcacctggaggacagtgagaaggatgaacccggtcagatattgagggtgggaagttcctgctaaactgacttggcagggtcctttgctaaaattagattttacaaggaagtacagatgtgcctaggaagaggtttgggaacctgactaaaatgtggtcacacagagaatctttgccaccatgccctctccagccaggccagtctcccaccacatctgtgttcacctgccccaaagctctcccaaccccgtcatgtaggggtttctacggaggctgcataatgtagacattactgattaaataatggtgatcagtccccaacctgaagttatccagctctccctcctcaaccaagagccacctcattagcataaactcagatttgtttgacagagactccttctgaataacatgacatcctatcactcaggaaattccaagggtcttaggacctctgtgtctggaactggggtcaaagaccaaaaatatatttttttatcatgccacataaggcataaataaacttttattatgctacaaggcataaatttatttaaaaataaaaatttttattatgccacaaggcaaaaacccagactctgggattgttgaatgcagactcttgtgggggcccccttaaagagttttgtgatcctaaatatttcaaaatggagtcacttacgacaagtgactcagcccacagtgaaactgctgaaccctcaaaatgataaacataggtataaaggactgaggtaataagataacatctgctgtggccagacacccccaagacctgatgagaaactgaaaccaaaaggtggctgagataatgaccatggacactcctgcagagggccataaaaacagcaaagaaactgaccacggcaagacacctgtagaagctctgcccgagaaagctctgaggcttcctcatgatatccacagcggtccctggaagctctgcccaaacacagcaacatcgttcaacagtgttttgagtgaaacccagaggcatgctaacctaaacaacagaaatgggggttttttgttttgttttgctttgagacatggtttcactccagttgcccaggctagactgcagtggagcaatctcagctgactgcagcctgacttctgggttcaggcgatcctcccatctccgcctcccaagtagctgagagtacaggcacatgccaccatgcccggctaatttttttttctgtatttttagcagagacggggtctcgccatgttggccaggctggtcttgaactcgtgggctcaagtgatccacctgtctaggcctctggttgggtgtgaaaatatggcccagttctggccaatggagaagggaacaggtcatctggggaactgtgggaaagacttaactccctgaaaaaaagacaaatgagaattatctttccctccatcttttgggcatagccaggtaaaaatgggccactcaaggctgctacagccatgggagtccctgcagggcaacagtgcagacccaggaccagtgcaatggagacagcctgctgagtccttggtgaccttggtgagccactaaacccaacctgagtcaccctcttcctgcctttctgttaccgagacaatgggtgtccaggctgttgaagcccttttgagtttagttctgcttcttgcacccaaatgcattttaatggggccatgagctcccaggctccacatggtctaaggtacccctcacctccagggcatccccatggaatgaaacaccccctctggccttctcccaagacttctggcccaatattttctgggtgtctttacaagacaatgtcctatggggtgcactggggattgacatctccctgcctccgaatgcctccccttcctggagtaggaagagctgcccagggttctttttagaagagacctttattttggccaggtgcggtggctcacacctgtaatcccagcattttgggagaccgacggggaggcagatcacaaggtcaagagatcgagaccatcctggccaacatggtgaaaccccgtctctactaaatatggaaaaatgagccaggcatggcagcaggtgcctgtaatcccagctacctgggaggctgaggcaggagaatcacttgaacccgggaggcagaggttgcaatgagccgagatcgcaccattgcactccagtctgggtgacaagagcgaaactctgtctcaaaaaaacaaacaaacaaacaaacaaacaaacaaaaaagaaaaaaaaagaaaagacctttatttctcaagcaagggcagaaattcagggctccccttcgactctggctgctcccaaggtggctttaaagcaccaatgagtccatggcttgtgtaagaaatgattagtccttccatctagagaaatagctcctttttaaacagttgtctcttttaaacagtgtttagtatttaagtgaggttgaaacagtgtcaaaaggaaagtgaaagtgaaattctctccttcagcataaaagctgatccacaaacaagaggagcaccagacctcctcttggcttcgagatggcttcggtaagtttcccagggctttgcattactgactctacagcagttgggcagctccccctaggaaaggcctcagtccaggctcctggccttgggcacacagctccagagctcgtctttagaaggctgtcatggaaaactgtatttgtcttttaaaagtgcatctgcccagctggacagggagtcctctgggcagagtccacctcctctgcgtaactggcacagtgcggggagcccgggactcccatgtagtagagagctgtggggtgccgggtgtcaaatctacctcagcctgaggagaagccagagtgtgggcaggtgggggactctgggttgtgggaagcaagcaaatcccaacatcgtctgcttctgctgtgactggggctcagtcccttctcggccccaaacgatgctttctctctcctcgttcctctgtggcatcatccagccttctaaggtgcattctaatctcagcagctttctgaaaactgaaatttctcctcctatcagcccagatgtaccgattggcagaagctctagggagagcaggctgagctcggtggtgtgtgactaaaaaggaacagcggggctcaggctattactagaaacaaaaccattccgggaaggagtcctgcaaattctggagggcagcccactccaacagcaccacctgatcctggggaagggctttactgctgccaaaacaaatcagggcttttaacagggagcccaggccaaagctcatatctcactggccaccagctgaggttgccagtaccttgactgtggttttagacattcagcattgcagttaaaagcccctctctctccccacatggaaaccatctcctgtggtgccctgacatacagaggaggagctgggagggagtcctggccctgctcctttctcctccctcttccttgtctatttccttgccccattctacgccaggcccttcactgggtcctggaggtgcagggagggaggagcacacaggatcctgcctgcctggagctcacagcccagaggggcacagggaggcacagggaattgcagctcaacttgacccctgcagagagcagcagaggcccccggggacccaggtcctaggagtggggtggcgggtcagctgagccaggctggggccatcagggcagcttctcaggtgagggggtttgagggaggggaagaggaagagtggctgcagggaagtgatggaggcagggagaaccagatgtgcagagcagcagagaccagagccagggcagtagtgaggggctgggatgtcactcagtgggcctgtgggtgcagagcccagggagggagaggagggtgaggaagggccagtcaggaagggcctgggagctgcccacagggtgtgtcctgggccctgaggtcagaggacggtcatggccagatgtgcccttgggaaggccaccatgggttctgaggagttggatatggagtggcagggacaggaggcaggggctggtcagggggttgtgggggtcacagaggcaggcatggggctgcctgaaccaagtcagtggatgggatattgacaagcacaccaacaaggagaagcttccggagtccacattgattggttttagtgactggatattggcatgaggaagagggcaaaggagagcagaccccaggtctatgatgggacatcctgggatgagggaggaggaggctgtcacccactgaggacagggacagagagggtgaaaatggaaaaatcctccagtcatgaggctgctatgccctggggcaggacatggagaagtgggaaggaggtgaggaaggggaagaaggtggccaagacaggaaccagggtgaggggtgtgcagggaagaaccagctcggcctccttccagctgagtgttctcaggaaagccctgccacctctctgatcctcagtttccccatctgtgcaatgggatgatcatgccttcccctggggctgtggagatggtgcagttattgtaggacaagttcccacagaggcctgttctgtgagtgcagagccccctcagtgctgggagctggggggccccacaagaccccactcaggtcccagcaggatgctgtgagctcctgtctcccagggtgtcatctccaagagataggtgtcctgaggctggatggggcaaggtctgaggaggaggtggctcttggggccatggagaggcacagggcaggagtgatgaggaactgagggtcagtctgcagagggcggagagctcaagactcaccttcccagccttgctcctggcctcagtgaaggtgctggttcatgcaggctcttgagtcggcctactgaggagcatgtgtacaatgcacacatgcacacacatctgcatcctcagcatgcacacacacagcacacacatgtcacacatgcgcccagacggtccttctgtctcccatcccacaagatcattctccaggcttccagcccccagtgcccccactgagaagagcctctgaaagtgacagcagggctgaggatctcatggggctagcagctgatgaacatcagcaaggcgtctccaggatgagctgcagctcccccagccagggtctctgctgttgcctagaaggccgggtactccatctctggcttttctgttgcagccacaccaagagcccaaacctggagacctgattgagattttccgccttggctatgagcactgggccctgtatataggagatggctacgtgatccatctggctcctccaagtaaggactgatgaatatataattttcaaaatatttgttaaaaggataatgagagggccgggcacggtggctcatgcctgtaatcccagcactttgagaggccgaggtgggcagattacctgaggtcaggagttcaagaccagactgaccaacatggagaaaccccatctctactaaaaatacaaaattagccaggtgtggtggcacacacctgtaatcccagctactcaggaggctgaggcaggagaatcacttgatccccggaggcagaggttgcagtgagccgagatcgtgccattgcactctagcctgggcaacaagagcaaaacttgatctcaaaaaataaaaaaataagtcaatgagagccactgaaagacagttaagcaagggaaacttgagttaggagacacattcttcttagaggatgcttgatgagattgcacacacatatgtcccatgaagtagacacagtgcattccataggtcctggcagaacggaagaagagaccgttgcctcccgcagcgaagctgggctgcttcagcattgggatctctccagctcaaagtcagttaccttggcatgcagaatctcatacgacttaaaccagccaggtttcttaggtcttaaagaagaaagtttctcaaaaggaacaatgtttctccgtgccagatcctttgcctcatatgttttcacacaacaaggtgtcttgatattatatacttaagattccttactgggagcaattctcacaggtttatacatttttttaaaattctcatacaaatacacagtaagcaataccaatgttttatttaactcattaataacagaagcagaaatatgacatacccagttaaaagcagaatgaaggaaacgtatgtatggatagccaatgaaaggggaaaaaacgaacacagaggccaggcacagtggctcactcctataatcccagcactttgggaggccaaggcggacggatcacttgaggtcaggagttcaagacgagcctggccaacatggtgaaaccccgtctctattaaaaatacaaaaattagctgggggtggtggcaggcatctgtaatcccagctactcaggaggctgaggcaggagaattgcttgaacctgggagacggaggttgcagtgagccgagatcctgagacagtgccactgcactccagcctaggagacagaggaagacattgtctcaaaaaacaacaacaaaaatgcagaaatgagacaatgagactgccaaattaggtaggtgcaggcaagttcatatcctctagggcagtgccactacataacttctcatgttctcttttcaccaagcatttacattgtcactggacaaaaaccattcccatcactatcagggcaagacatttgcatcttatcagttttctccaagccatcatctcccaggcaggattgtaaaaatgtctgaattgatggaaaatagtaaatcaagcccacttaatccagatgatcctcagggaccttgtaagacaaagcatggcaatgaagacacatggtcctttttgtgcctaacttgcagtgtgtaaagaggctttttttttttttttaagacagagtcttgctctgtcaccgggatggagtacagtggtgcaatctcagctcactgcaacctccgcctcccagtttcaagcgattcccctgcatcagcctcccgaatagctgaggctacaggcgcatgccaccacagccagctagttttttgtattttagtagacatggggtttcaccatgttggccaggatagtctcgatctcctgacctcgtgatccaccagcctcggcctcccaaagtgctgggattacaggcatgagccaccgcgctcagccgtaaagaggctttttaaagacaatttttctctctttcctttttttttttttttttcctctgagacagtgtcttactctgccatccaggctggtgtacagtgatgtgattacagctcactgcagtcttttttttttttttgcataaacattctgatttaataaatggtatgaatatatattttgcatactttacaataaagaaaattttgaaagaaaattgatctaaaactgtttccctccaatttccatggtaaagtcaactgcatacagttctttccatgtataagttttacatttgtattttctacaattaaataaatctaaatgttaaattttagcacatatatccaattatgtacaaaattacaatgtcaatttataagtcaagcttacttaaaaatcataaattacaaaaaacacattatgaataattttgttctggaagtatcataccaactcatacgatctaggtgaacccaaaagtaaaaaacaatgattataaattacagtagtgtctgtaaaaccctgttataaaggaggtattcttttaaaatatgtaccttatatataaaagctcctgactccttttaaggaccaaaattattttcagtttaaccattttcattaaaatgcttatttaaaagtatcgccttataaaactgagtatataaaatacaatgcagcccttgataactaagaatctttataaatgctaattatttagtgacctgtttatcaaactatttctgtggatggggtgattttttttcttcctctaaattaagtggccctagactaatatatttatatagttattctgttttcttccgtactgtcatttcacatctctatcagtgagttcctcaggatttgcctttattttacaactatgaaagtcttcaatccaattccctgcttccacacataggacacagaaagcctaaactttccttttttctgggctccaatgggaagcagcatttacaacgtgtctggcttggtaggaggaagattgtcaattgaggtatcatgtgtgttcacctgcctatcttgccctatttctttggttgctgtaaatttcctgcttctcaaatatctggatttttggctacctatttggcttccgtctttggtgtttatatctgtctggttttagcaggtctctctgattcctgactcacagctcctctccttcactaatattcaagtgtgctgcttgcctaactcctcattccttctccttgaatttcactttacaattgcactaggttctatcatcgttggccacagattaccacaaaacataatttcttaaattctgcacatttctaatgcttctaatcttggtttcctacaagatctaacactaagcttgtgttatcctgattacagtgtatgtaaaacaatgcttgtggaaaactaacctaggagaaagcttataggggaaacctgataatgaattttattaaattaataacccttataaaaatttcaaatgtaatactacctggatttgaacttcaatacttttcttaagtaaaattcttaaccacggtagaagttatgtttgttgatgttcactcatctataccctccatattctcagcaaagttggcataaatctgacctgaataaatagggttataacattatcaggcttgtaaaatactttatcaaatcaatgcatcagttaaagcaggggtccccaaccctgggctgtgtgtggcctgttaggaatcgggccacacaataggtgagctgagaggcaggtgagtgagcattctgcctgagctccgcctcttgtcagatcagtagtagcattagattctcataggagtgcaaaccccattgggaactgcacatgcaagggatcaggctcactgcagtcttgacctccccgagttcaggccaggtgatcctcccacatcagccttctgaatagctgagacgagatgataggcgtgtgccaccacgcgcagctaatttttgtattttttgtagagacaggtctcgccatgttgtccaggctggtctcgaactcctgagctcaagtggtccacctgtttaggcctcccaaagtgctgggattacaggcatgagccactgcgcccagccaacaggattttcttaagagggttctaaatgcaaacatcagccttgagattagaaacggggcaaaagaggtaacacacctaattattgtgtgcattaggtactatccattttaataaaaataagataacacctggagtcactatataatggaattggggctccattggttgacagctcttctgtgttcctctctatgtgcctagaactgtgccagattgtaggacagaagacactttacaaaggattccctcagggtcagcccagtgcagtggaaggagcctgccctttggggcttaagagaagcagtttcacatcctgattctaggacttttcatagcacagaaaagtctcatgatgtctctcagcccaatattggtttttaaattgagatgataatattttccttgaaagttaaaaaggagattaaattaggaagtatgtgtaacagcacagcatggtaactgaaacagtgggtactaaacgaattggatctttttccgaaacacaagtgtacaaagctgaacaggtaataaatatgctttaccatcattgtttataatgatgaaaatttttccaatacctaaatgacggataacaggggattggccacagaagtgatgtacatgcatagcatggaatatggcagcagccactggcaatcatgacattcactgacttgaacgaacattcacaccttattttattaaaaaaagagagcaaaatctattagcccggcgtggtggtgggtgcctgtagtcccagctactcgggagggtgaggcaggagaatggcgtgtacccaggagatggagcttgcagtgagctgagatcgcgtcactgcactccagcctgggcaacagagtgagactccatcaaaataaaaaaaaaaagcaaaatctgtgaatccttcaatcacatttgtgaaaggataaacaccagtagttccttagtggagatttcaagcccttctctccctacttcaccttcccctgccagtgagagtgcctctgattgcaggtgagtaccccggggctggctcctccagtgtcttctcagtcctgagcaacagtgcagaggtgaaacgggagcgcctggaagatgtggtgggaggctgttgctatcgggtcaacaacagcttggaccatgagtaccaaccacggcccgtggaggtgatcatcagttctgcgaaggagatggttggtcagaagatgaagtacagtattgtgagcaggaactgtgagcactttgtcacccagctgagatatggcaagtcccgctgtaaacaggtaaggacctctctggataatccatctccctctgcttggggctggactcacggggctgtgcagccaggcgatcactgtgaatgatgcaaatgcagcctcttagagacctgctggctgagagtcaggacctctgagctccaatgccagatctgcttctaatccacagagggtctttggacagttcccttccccccaggcctctccatgtgcagaggagggggtggatggaggagctctgaggatccttcccctctaaaacctatcctgaaaatggctcctgaagttctgggggtcatcaggagaatctgggccaacccaggacaatgacaggtcctgcaaccccccaaagagtactcaggcaagggacgctcagggtccgtggacctgtgtaagagctcaaggacatttgtgtgtaagatctgggcacagcctccatcccttgccccttcacagtctttcacatttgttgccccaaaacactcaactaataagtggcagaaccgggatttgaaccccagctgtccctttctagagtctctgcctgtgatgcctactcagggcccctggcctgcgtgactgaatggttgggggcccttgatgagagagggatggtggcaggagtagaggctttgcggagggaaatccagagtttggcgtggcatgtgatgtctgaggtgccccattagaggcccaggtggagataaggcatggagtttaggctgaagtacagctggagatggaagtttccaggctgcagttgggaatagtacacagtgaccccagggcacgcatatggccatggcctccctaagtctcccctcagcttctgccacagccctccctgtgcaaaggtgtagctcagggaggacccagactgcaaaatagtccccagtctggcccctggagctctgaccctaggaagcgaggcacaaaccttcttccttgccccaaatcagaacaaatgtcctcacttggaagctctctcaaaaggacctcatgggcccattctcaggacaagcccagacaagtcgaacaccaagaagtggtcacagcccagaaaatggagtccctggggatacaaccaacggcttctctgggagaggattctgagccagccagctgggagagaagagaggagatgccaggccttaggggaggcaggagagaggggagagggagaggagttccaggcccttgggagggagaaagtgccagcctggcttgccgtgaacgctcaacaaaagctgcttgctttgcaggtggaaaaggccaaggttgaagttggtgtggccacggcgcttggaatcctggttgttgctggatgctcttttgcgattaggagataccaaaaaaaagcgacagcctgaagcagccacaaaatcctgtgttagaagcagctgtgggggtcccagtggagatgagcctcccccatgcctccagcagcctgaccctcgtgccctgtctcaggcgttctctagatcctttcctctgtttccctctctcgctggcaaaagtatgatctaattgaaacaagactgaaggatcaataaacagccatctgccccttcagaaaggacttctaccatgtttttatagacttctgaatcacaaaggaggaaggtaacattgagtgaacactcactgggtagttccagcaatttctagccgggtgactttagagaaggctcttgattctcagaacctcagttcttccatgtcaggtgatgtcaggaggatcacctacgataatgcatacacgacacccagcactatgtctgatatgtaacagatgttcaaggaattgtcttcatcattctacacagacataacagcgacataattgcatgtcattaattttactctcagggaggcgaaaaaaacctaattaccttccggtatcgtctcatgtggtgcttaaatcccctcacaacacctacacatctaccagcatcttcccagttaccttcctcagttggccctctttttagaaagttttttttttttagctcaaaggtctgagttctcacccacctgtgactactagatggagtaatattctttccatgcccagattgccatggctcaagctggtcctgggtggaatgctgagaattagctacctctaaatctccctccactacttccagcatgccctgggtatggctccagaagtgcccaggtccccatgtttctgtgcttcctcactccagcctctgccaccagtgaccctactcagtggccacttccatggtggtcactgtggccaccaccactctggcttcaggactgaggacatcaccctcccctgggttgtactttttcatgcatgagcaagctggttggtcccttaattccccaacacagtggagaccaggctgtaatgattaacgacactcccctggaagctcaaggctattggaaggttgaagaacaaagagaataacttatcattgctacaattagagggggctctgctcagattcctggctgaaataccaggctccatttggggattgcagaagcatccatgcctgccttgctccagggctacctccacagcagagggcccagctgttctacccagagtccaggcctaaaaggcagaaggcccagcaagagaagaaggctttctcacttcttgtgatctaaggctcacctccccagacttcattacctgtccaggatcaattgttccagggtgctggacaatgggagcatccaggcccttccaaggtgtgtttgacctccatgactaggtcagatccccattaggagtctcaggtgtccatgtgtctgcacttcatgtgattctcacagttgcaatgaacactgatccatgtggttattttactaatgtgcctttccctgccagtattttggggacagtccaagtttggtaccattgggactctagcatcaagcacaatgcttaacttactataaccactcgatagatgatggattacaagcatgcacctgtaatcccagctacttgggaggctgtggcaggaggattacttgagcccaagagtttgagatcagcttgggcaacatagtgagaccccatctctcaaaaaggaaaaaaagatagtggtttacttaattaataaatctattaactgatatgtagaaaaacagggccaggcacaggggcacacacctgtaatcccagtactttgggagaccaaaggaggatctcttgagcccaggagttcaagaccagcctaggcaacatagtaagaccctgtctctacaaaaaaataaaaattaaaaataaaaaaagattagccaggtgtggtggtgcatgacagagcaggagcatcgccatcttggacaaataccaacattctgtgttcctcttgattaaaaactgcctaaatccagccccagaacgtcagtcccagaacatcagggcatttccctatgctgggaaaccaactcccagcataaccagaaacattccaaccctaagataaaaccctttccaaccagaaacatgccaaccccaagatagcctcccctctgacgagagacattctaaccctacaataaactttccctcacatagaaacattccgaacctacaatgatcttcccacttcctaaactcttaaatatccttagtctgttagaacactcctgaccaaaatcaaccagaagcccttctcaggtttattctctaaataaacctgtctttggctgttgagcccctttttgtgtttctttcctctttaattcttacagcgtgtgcctatagtccctgctactcaggaggctgaggcgggaggatcatttgagcccaggatttctgcagtgagctatgatcaaaaagagtacaagtaaaaaataaaaatataaaacatgaccactgttctcaaaaaaataaaaataaaaaacatgaccactcttctcaaaaaaatgttgtggccaccacagtaaaggttaatgcccaccagaattgtgttgctatgaagttgagaaatacactgaaccagttccagacctctctggactgacttccatgaactagatttcactaaatatggaatatatatatatgtatatatacacacacacacatacacacacacatatataatacatattttatatataattatatatatatgtaacaaaagcatacttcattttttcataagttcattaaatggttgtaccacctctggacagtccttggtctcagcaaatctttttgctaagattaaaagtagctgaaggctgggcacagtggctcacacctataatatcagcactttgggaggccgaggcaggggcatcacctaagatcaggagttcgagaccaccctggccaacgtggcaaaaccccatctctactaaaaacacaaaaattagccagacatggtggcgggcgcctgtagtcccagctactcaggaggctgagatacaataattacttgtacccagtgacggaggttgcagtgagccaagatcgtgccacagtactccagcctggacaacagagagagacgttgtctcaaaaaataaataaaagtggctgaagagagcatgcatatattccttccacaagctgtttttcagcttaagaaatttttaagaaaactgattggtgctggagaaacaggaatcctgggctgtgtgtggtagtactcgattgtcctttgtcgtttgtgtcactctcgaagacagcatccctctccccacccaggagtgacgggacagctggcaggacacagagaagccctagtgctgccctcctgcctcatggacaatgaaatgttttgcttatgtgcatccaccagaaagtgctctgaaggtgtttgggatctgagacaaccaggacacagaaggaacaggagcaggggagctctcagtgctgcctgccctattgtcctctttcctgggtggcttaaagtctccttttggggtaagagaaaataatttaagacattagtagggagggtcttagttcctgcaaagatctactcaaaccatcaggaggtcccatggttggacctggcccttcctgcagagccctgacccttggcactcaagacacaggagaagaaggaagccgtcatgatgggccagggatagggccctgggatctgtctctagcccatcaaagaaaggtgagaggtgacagcgtgctggcagtcctcacagccctcgctcgctctcggcgcctcctctgcctgggctcccactttggtggcacttgaggagcccttcagcccaccgctgcactgtgggagcccctttctgggctggccaaggccggagcccactccctcagcttgcagggaagtgtggagggagaggcacgagcgggaaccggggctgcgtgcggcacttgctggccagctggagttccgggtgggcgtgggcttggcgggccccgcactcggagcagccagccggccctgtcggccccgagcaatgagggacttagcacccgggccagcggctgcagagggtgtactgggtcccccagcagtgccagcccactggcgctgcactcgatttctcgctgggccttagctgccttcccagggggcaggcctcgggactgcagcctgccatgcctgagccttcccccacctccgtgggccccagtgcaccccgagcctccccgacgagcgctgccccctgctccacagcacccagtcccatcaatcacccaagggctgaggagtgtgggcgcacgcgcgggactggcaggcagttccacctgcagccccggtgcaggatccactgggtgaagccagctgggctcctgagtctggtggggacgtggagaacctttatgtctagctcagggattgtaaacacaccaatcagcaccctgtgtctagcttagggtttgtgagtgcacgaatcatcactctgtatctagctgctctgttggggccttgaagaacctttatttctagctcagggattgtaaatacaccaatcggcactctgtatctagcgcaaggtttgtaaacacaccaatcagcgccctgtgtttagctcaaggtttgtgaatgcaccaatcgacactctgtatctagctgctctggtggggccttggagaacctttgtgtccatactctgtatctaactaatctgatggggatgtggagaacctttatatgtagctcagggattgtaaacgcaccaatcagcaccctgtcaaaacagaccactctgctctaccaatcagcaggatgggggcgggaggggcgggaggggcgggggccagacaagagaataaaaggaggctgcccgagccaggagtggcaacctgctcgggtccccttccacattgtggaagctttgttcttttactctttgcaataactcttgctactgcgcgctttttgggtccacactgcttttatgagctgtaacactcaccgcgaagatctgcagtttctctcttgaagccagcaagaccaccagcccaccaggaggaaggaacaacttcagacgtgctgccttaagagctgtaacactcaccgcgaaggtctgcagtttcactcctgagccagcgagaccacgaacccaccagaaggaagaaactccgaacacatcctaacatcaaaaggaacaaactccagacgcgccaccttaagagctgtaatgctcaccgcgagggtccgcggcttcattcttgaagtcagtgagaccaagaacccagcaattccggacacaaagggatgttaaacacagcttctcctgccatctctgttttggaaagcgtgctcaaattgaccacaacagctgttctgtttacacactccgaagtcaaaatcactagccgcattctcaggctacatgatctccatagttcccgggaggtgggcagttttaatactgtgtggacggaaactagattcagagtctaagccactgacccaaggtcacacagccactaagcaaaagctctggattcccttccagtcaatttgacctaaaagtcagttttctgggccaggccactggaatgttctctgatgagacttgcatgggcagtctcactcgcagccttgcttgatgtcccaggacagctcctgtctgcccactgcagatttcgcaggctcaggccttggagcagcatcactcagtgcaagcttgaagctgtgggcagaaaggtcaggagctgctcagccccccattctctcacttcctgtgaagaaattggtgggaccaaagatggcggatgcaccccggaagcatcctccagggggagacctgtgcttccctggggcggtggagggagtaagtgttcagggcagccacttgtcagggtgagagctatgctgagagcacctggagaatcttcctggctagcagacagccaccttctcactagatcctcacgtggtggagagagtgccagctctggtctcttccttttctttttttcttttttttttttttttttctgaaacagggtctcattctgccgcccaggctggagtacaatggcatgatcttggctcactgcaacctctgcctcccgggttcaagcaattctcgtgcctcagcctcccgagtagctgagattacaggcacctgcctccacgcctggctaatttttgtatttttagtagagatggggtttcaccacgttggccaggctggtctcgaactcctgacctcaggtgatcctcccaccttggcctcccaaagtgctgggattacaggcatgagccactgtgcccggtctagtctcttccttttcatataagaacactaaatccatcctagaggctctaccctcacaacctaattacctcccagtgaccccacctccaataccatcccacaggtgggttagagttcaacatatgaatttggagtgtgagagaaacacaagcattcagtccatagcagagcccaattgtgtctttaatagaattcatactaagctgcatttccaaatacattttcctgtgcttttaactccattaaaataaagattcatgaacacaaaacagtaaaatcagtaaaccaaactccactcctgctggctaaataatattcctccgtaagaattggtggttgttgggacaatttcttggatttattgcctttcccgcttgcttctggccagcaggatccccacaaggcttgcggcagccagcaggcctgctgccacacctactgtcgtgactgcaccagtgacctgcagcagaagagaagggagagcacactcagcatcagggcgggaccacgatacatacaccaggaaactacagctcaggaaagactcatctggcccagtcctcttcatttgaatcacagagggaacaaatattggctgggagaggggatgccaagaggtcaggccacccaggaaagaggagtggagatgtctggtgggcacagaatgaatggaagaatgaagccataggcgtgatatacacagagtcaaaggaggaaaaccagatgcacctgtgggtattaaaagcataataggtcgggctcagtggttcacacctgcaatcctcacaccttgggaggctgagatgggccgattgcttgagcccaggagttcaagaccagcctaggcaacatggtgagacccccatctctacaaaaaaatacaaaaaaaaaaaaacagctgagtccaggtggtgcacacctgtagtcccagctactcaggaggctgaggcaggaagatgacttgagcccaggaggcggaggttgcagtgagccaagattgcaccactgcattccagcttgggtgacaaagtgagtccctgtcttaaaaaataacaataataattaaagcaaaaagcatagtaaacccccagcaaggacagaggggcagtgccccaatgttctaggtcagggctggctgactggggcccttgaggcagatatgaagttgggaaatcacccctgggaactctcactacacaggcttgagggcagggagctcgcctggattggtctcaatgtcccaggtgctgatcccactgccaggcacagagtcggcactcataattcatctgctgaacaaatgctggcccatgaggagcattgagggtgtgctttaatgagtaagattgtctcacttatgtgctggcaggaaatggttctgcaaaaggaagaagaaactgaaaaaaccacagagatgtgaggccgacccccgagggttggtgtgctcggcacagcttttgggagctagccgagacagtctgctgcgatcctgtgggtctgccctgcctgggccactgtctctgagagactagcactggagcgactgggggaaacaacacggggtggggggtgggggtgaaaactgtgagaatggctgctttctagatatcagcactgtgctgggaactctccaggcccagtattttttttaatctgcctgacaactctaggaggtagtgattctaattcctactttccagaggagaagactgaggatggacagtgtaaagaactcacgcaaaggccgggggggcggtggctcacacctgtaatcccagcattttgggaggctgaggtgggcagatcatttgaggtcaggagttcgagaccagcctggccaacatggtgagacccccgtctccactaaaaaaaattagccaggcatggtggcgggtgcctataatcccagctacctgggaggctgaggcaggagaattgcttgaacccaggaggcagaggttgcagtgagccaagatcacgccactgcactccagccttggtgacagagtgagactatgtctcaaaaaaaaaagaaaaaaaaaaaaagaactcacgcaaagccacacagctgacaagtgacaaggctcagatctgcctgacttcccaacaggggcacttaagcccttcacagacagggaagcaagtatttaaaccagcgaccaaatagcagatttctgtggagtatcaatgaatttgaagcatgtgagtgactggggaaaagaaagggggaaaaaaaaccattttattcaaatacactcagaattgtttccaagtgtcaaagacaaacaaagccagacataacttaagacagcaaaaacagatttgattcagtctctactgacagcagggaaagagctgagctccattccaatttgtgcagaggtgactgacattgtaaagggagatggaggagtagggagacgggtgagcgagggctcatagagtcagggaggtgaaatattacaaaggattagtccctgaatatgcgatgaggccagctgtgtctgctagctggcaattatcaaagttaggattctaacctcccacggatattggggacagaggctctatccttcctgatgattatatttcaaaggactggctctcaggtccttgaggaaggcacttcagagttgtaagggatatacagtcagccctccatatccatggattccacatccatggatccaatcaattgtggattgaaaacatttggaaaaaaaattttttaaagaacaataaaaaataatacacatttttaaaatacagtataactacttacattgcattgagtattatgagtaattatgagtggctcatgcctgtaatcctagcagtttgggaggccaaggcaggtggatcacttaagcccagaagattgagaccagtctgggcaatatggtgaaaccccattgctacaaaaaagaaatacaaaaattagccgggtgtggtggcgtgtgcctgtagtcccatctactcaggaggctgaggtgggaggatcccctgagcccaggaaggttgaggctgcaatgaggtgagatcacatttcagtgaagcacctctgcactccagcctgggtgacagagtgagatgctgtctcgaaaataaaataagtacatgggaggatgtgcacaggttatatgcaaatatcataccattttatacaagggacttcagcatccatggattttggtgtcctcagggggtcctggaatcaatcccttccccacccatggataccaagagatgactgtatctatgtttcaaagggacagaggaaggattcataattataagtcctttgtaataaacagtctaagaaagggtcagggtctttgtcaggtgttcgttagaacaaatggtaaattctcctggcagcagagagctttcttaggcaggcatttatcggggggctagggtcatcctacggacacagccttattttgccagaagcagtgctagagcttggtcatctattagagcaggggctggatggcgttgttgtgtgccaagagtcctgcagctttcacaagtccactttcttacagagcaagagctagagacagacagaggagagtctttccagacagacagagtcagatgagaaggaaggagggagaggaagaaagaaaggcaagttattgggtgacctgcaggagatgaagttcaacaagagaggctccaggacaagggacaaactaaataaaactgcctcccctgagtcttccccattggcttgagttctgacccctcagaagcatagcagagggccaaccacttcctaaaattggggtcttccagattgattttgtggcttctgcacagcctatagaagagcttttagatgtatgataaggcagcccacccccaatccccttccgacacccctcccattcagagataggtctaccctcctcagctcaacagaggggagaccctgtcagcagggttcccactgagtaccagagcatgtcccaccgtgccccagtgcccagcatggcctggcagtctctcagttaatagcgtggtctccctcctggggtacttgtttccagaagttgtggattttccttacccatctcccctttttatcacctctccttctcctatcatacaacagaacagctaaatcctcccacaccctgaatctacggtgcacaggctaaggtgtaaacactcctagtcaccagtaagggaggattcaagaatgcattgctcctaaacaaagagggcttcagaaaggaatatgcaaccacgtcgaggctcctgcctcatctgtctgctgctttagaatgagaattctaaagtgagatggttatcatgaaactgtgcattaacacactcatttgaattgaaaaattgtcagtttttttctgaacgtcaaaataagcctgattaggctgattggtttgacaataacacctggctcggctatttaaactacacggaagacatttttccctaactgaatgagctaaatgtgcaactccaagattgtgaagaaaacatgtacacaaatatgtaatatgcaatataccaaaatccatcctttcctttacaaattttttacatttatgattttttaaagtgtttgatgtcatctaagaatgtatgaggggatatgtggttttttaagttatcttggactgagtgtggtggctcacacctgtaatcccaagggaggccgagtcaaggggattgcttgagcccaggagttcaagaccagcctggacaacatggcaaaacctcatctctacagaaaaatccaaaaattagccaggcatagtggcacattcctgtagtcccagccactcaggagactgaggtgggaggattgcttgagcccaggaggtcgaggctgcagtgagccatgatcgaactccacatgatatactgcagtctgggtgacagagtgagactctgtatcaaaaaaaaaaaagtttgtgagaccctgtatccaaaagttggccaactatggcccatgggtcaaatccaacctgtgaactatttttgtaaaaaataaataatacacttattggaagacagtctcgcctgttcatttatatattgtctgtggctgcttttgtgctgcaaactacggcagcagggtaataagacagagaacacctggcccataaaatcgaagacatttactatctggccctttacagaaaacaattgcccaacatgatctgggcttttccccttcctggctcacgctgttccctctgcctacactccttattgcccccgttccctggtaatctccagctcattttctttcagattaatcaaaataattaaatcaggctgggctcgggtgtgacctcttctacaaagccttccttgatcggggcccttggagagaacacatgtaggtttaactcccccgctcttcaccatggctgacatggactagagactcaataactaggagtttaatgaatttggacaagttacttaagcacggtgagcctcagtttccccatctgtaaagtgggaatcataaagccggcctctagggctgtggagggctgtttcaggctgtgactcccttctgtggccaccccccaacccactgcactggtctacattgccgacttgcctatctccccacccttgtccccaccccaaatgtgacaccctcaaggacaacagtttcatatctgctattttgtcttgctcatgtctatttccatcccaccctggccccagcagggacccagcctctggcagctgagggagtggcctggctcctgggaaggggatgcaggctgaagatgcacctggtcactgcgggagacgccatagcgcagatggttcacgaagtgctcgcagttgtcactggtcagcgaataaggcaactcctgccccaccaactcctctgcccgcttgacgattttgttggaaggcagtggtgtgtatctgtcatcgtgcttgttattgaccctgtagttgtctcccccagccaccacagacagcagttccttcttcactatggctttgttggtcagggcagacaggacactggccgcaccagctccagcaatttcacctgtgcaaacagtgagttcagtcctgggcagggcctggggggctcagagctggaagccaagcagcctcatcgccccgagcaccatcaaggaggagcagctgtggaaggacttgtccatcctgcctggcctcaaacttgaaaacagggaagacccaagcctgggtgactttggagaaggtccctaagttctggtttcctcatttctaaagtaaacaacctgagctctaaaggaccatgtgagttcagatatacctgaaagagtcaacagtcaaggcagtgtggtacagggcaaagagaggaggcagaagagccccaggccatagtcccaactgccgctcactagcttgtggcttagaaaaagtcactccaggccaggtgcctgtaatctcagcactttggaaggccaaggcaggaggaacacttgaggccaggagttggagaccagcttgcacaatatgctaaaactcctgtctctaaaaataaaaattaaaaaagtagctgggcatggcagcacatacctgtaattctagctactccgggggcgaggctggaggattgctttagcgccgaaattacaggctgcagtgagctgtgattgtgccactatgctccagcctgggcagcagagtgacaccttgtctccaaaaaggtaaagaaaagaaaatgtcacccattgccctgagccagtgctgtgggagctccagtaggtgagggtggcattttgaaacagtaggaaaggaaacagctgaacaagacagaagcctgtcccaggaatccagggtccccaggtcctggccgtggctctcttactgtgtgtcttcagaaaaagcccttctcatcttgggaccctggtttcatcattttcaaattagaggaactaggccaggggatgtccatgccctccagctttaaattctccaattggcctctaaaggggaccccagactcctgggaagctgaacttagtgatgtgaagccgcatgctcaaggcacacagtctgtaagcagaggagccacaattccaaactggttctgttgagttgggaggcccacatgctccttccgttatactatgtgctcagttgtacgctatctgaaggaagcaactgcttcttactcttgcttgtacctccataacaacaaatacataggagatcccacggagggatgctcaccaagtacagtgagttggttcagactgaaccccactctataatggaataaaggtcaatagtctctccaccaatttactgcaaaagaagaatagcagttgctacatctagcaggaaaaagcacaattcattcagcattatgtattgagtgcctactctgctagaccctgaagtgaggacaagcacgtaactgtgcatctcttcacattcttgatcttaacccttgtgcttaaaaagagaacccatccttacttgccggagccagatggaccacatagccatctcccacgtagatggcccagtgtgcatagccaaagcgagaaatctcaatcaggtctccaagtctcggtcttggtctggcctgcaacagaaaaaccagaaacaggcagaggtgagccatctgcaggaaacattctagggcctgacctgcaaggagccccagctcagcctgcagattccctgtgctcatcacctgcaggaaacaggaaggagggagcactcctcacatatgtaggaagcaccttcatttactggggctgcaggactgaaaagttgctcttcaggggacaaggaggagatgaagagagtatctttgagggagattttcatgcatgtgcagcacaggagtgtgatggagtgatgtgcccaggctgagtgtgagtgcattttatgcacagagtatgtttttgtcagctagtgactgcatgattccgaaggaagcctaaaatgcctctttaagggccacctgccatgagcctgggcccaagtgattcctacaagttctagaggtctgacttgcaacgcccaacatgtcagaggcaggcggacacttgacccacattacacaccactcctttgggtgaaaactatcattacccccacttgacaatgagcacatggagtctcaggaacgttaggtaacttgcctaataagtagaagagcaggaatgaagggtagggctgaatgtttccaacattaatgcctttaaccatcccagaatgtcctaggcaagcccagggcagctgaagtctgagctcaggctaaaattaaagcaagggatggcagggtgtgtttggagttggtggtagggcagtgcccctctggagggtgcatgggtgcgaggaatgttgccctggccacacccagaatgggagacagcccttgccacataaattctgtttccggtatgctctggtgccagccagcacccctcctccccctatctcagctgagccaagccacaaaggagttgaactgctgccgagggtggtgagagtgccagccaactcaaagtctggtggggagctatagttaaaagtaaagcctttcatttgaagtaatttggatggaattggagatcattattctaagtgaaataactcagtaatggaaaatcaaacatcctatgttctcactcgtaagtgggagctaagctatgaggacgcaaaggcataagaatcatacaacggactctgaagactgagggaaaagggtgggagtgggtgaggaataaacgactacacactggggctgggtgtggtggctcacgcctataatcccagcatttcaggaggccgagatgggtggattgcctgaggtcagaagtttgagaccagcctggccaacatggtgaaacccccatctctactaaaaatactaaaattagctgggtatagtggcaggtgcctgtaatcccacccacttgggaggctgaggcatgagaattgcttgaacccgggaggcaggggttgcagtgagcagagatcgtgccactgcactccagcctgggcgatagagtgagactccatcacaaaaaaaaaaaaaaaaaaaaaaaaaaagactacgcattgggtaccgagtacactgctgagatgataggtacaccaaaatctcagacatcaccactaaaaactaatttatgtaaccaaataccacatgttcccccccagaacctcgaaatttaaaaaaaagtaaagcctttgactagaggggtcaagagtcaacttgaccaaataagggacaatttgagcatcaaaaaaaaataataaaaataactgtacacaaactgaaacacatcaaatatgttaaaacccacgtgttcataaggatattttttaaaaacactaggcatctttggaggatggaaaagaatcaccctattattccaaaagctggtaaataaaggaaaagattcaagcatttcctaactgaattgtcctcacggaatgcaatttaaaactacaacaaaccccaaagctacaaaccaatacttgtaaggtagccatatatgtatgcaaaaacagaaaaatatttggaagaatacgcaccaggttgtacagaggggaaaggctgtacagatgggaaggatggtcaaaggggacattagtttttatgctaatagttttggtttttggcttttggctttttttgagacatgatctcattttgtcacccaggctggagtgcagtggcactatcacagctcactgcaggaagcctcagcctccccagctcaagtgatcctcccacctcagcctcccaagaagctaggactataagcacataccattatccttggctaattttaatattttttgtagggatgggatctcactatgttgcccaggctagagtttcggtttttcagacaaagtgaatgtgttcacgtatttctcctggaattaaatacattctttcttttttaagtcgaagctttagagtcagagcctcctaagttcgaattccctctctgacttttgggcagccccctctctatacttaccagtatatcattcctcctatccatgaagttggcagtaattatgcctacttcataggattgcttattaactacctggtgtggattaaataaaagaagtgtttagcatggtgtctggacccctgagcacttgggaaatgtggctgctattgggtctaaaggaagaaggaaactaagaaggaattggagggaaggagggaaagtagagggactggccctgcctggaggcgagggagacagagccctttctgacagcccccattgccacccacacagctggagccctttccctggaccctccctccccagctaatccctcccactgaggatgatgtgacagaggaggcggcctgtggggtaaaccaagggctgctctccctgagcccaccattcctgccttcaggaggcttagcagagccactggtagtttggccagaggagggcttggaaaagcataaacgcaaactttggccacagtagaaccagaccccatgcggcagctgaggctggggagcctccagggtcataacccagcaccgtggttccttcccacagtgtctgagagagccagacccccagaactcagcatgtgcccatgtgccctccatgccagagctgtagaccaacaagaatacacataatcatcactaatagggtggttgttcctcaaatcaaagctttaaaaccgtttctggggacttaccaaagccatccttccttcaagatgatgtcttgtgtgttgctgactctgtgtccagccttaaattagctctgagtttcactttccctgtgacccagcccatatacaactatttcagaacataggctgggtgcggtggctcacacctgtaatcccagcactttgagaggctgaggcgggaggatcacaaggtcaggagatcgagaccatcctgactaacacggtgaaaccccgtctctcctaaaaaatagaaaaaattagctgggcatggtggtgggcacctgtagtcccagctactccagaggccgaggcaggaaatggcgtcaacccagtaggcagaccttgcagcgagcagaggtcgtgccactgcactctagcctgggcggcagggcgagactcagtcaaaaaaaaaaaaaaaaaaaaaacagaacatagatcaaggttcatgtaaaattttccctgtcttcaaacaggggcagagcacatatcaagtaggcaaggcggcatgaaaatcagccagacagaagaggaatcagagctcaggatatagattgagaaggacttagtggcagtgtggtcaggggcacagctgacaatcaccaagtttcaggtggaacaagcaagatccagtggttgtgggggcaagggaggatatagagacagagaccatgggggaaaatttcaaaaaggagagaggagccccagagagactgagattcatgcctccaaattgggaatgatggttgccgggacaggcaaacatttccaccaacctcaaaccccatggccctagaaaaatcgtattattggaggcacattcctctaccctggaaacagagtgagcctgcttggacagcagtatagaaaccactcccctttctgcctctcacccacagttcagaaacactcattccacaccaaatggaaaccaaaacccagtactgggtgtgtagaggttgcttctttgaggcacctgcatgcttatctcacccaagctccaaataagtatctcttctgtcatctacatatagttgtccggtcctgagcaaactggacaggaaggggtgggtggggctggggggagctgagcatcctcactgtggggcatgggggcgaggaccaataacttaccctcttcaggctataaacaaacaaacaaacaaagagctttagtgtggggatgcagatggactggagccagaactggaaaactctttgggagccacagcagttctgcatgaccagctactccctcagctcacgtggtcatgtggtcttgctcccatggagacggcctctctcagcacctccactccattctcctctgagttgcagtgggacaatcttcaaagtattccttctggagggagacagtagggttggcttggctaattatctcctgccccattgtccagagacctctgggccggtcccactcaggcttgctgatcatctttttaggggctgacctccagtccagcaatctcagttcttcctatgcctgccctccccttgcaaccacatcacacccctgtttcctggggcaggaggacttccacgtgctgtctgctgaaaggatctcaggtgggttggcacaatgaccaaccagaccatgcagggcggagttggggaggaacatcactgtactcatgctggggcttgtggcttttcaccgaatccaagctgttcagagtgtcaggaaattatgtccaggagctataggaaaggagagtctgcaaatcaagggccagtggaatgagaattctgctgtctccctactgttcatgctgagcaggaaaggtgacaaagttctactgacagagaacagggtagggcaggccacacccagcctgctggtaagctctaggcctacagcctggaatacttacatttttgttcacatgcacgctctctatgtttgtttaattgtataaaaggctataaaaggaaagataagcctccattctccccacctccagcctccagcctccagcaacccagttcccctttctagaggcaatgttatctttctatgtacatgccaggaatatcttgggctacatataattttaatgggctttggccgggcacagtggctgatgcctgtaatcccagcacttttggaggccaaggtgggtgaatcacttgggtcagaagttcgagaccagcctagccaacatggcaaaaccccgtctctactaaaaatacaaaaattagctgggcttggtggcgcacgcctgtagtccagctgctcgggaagctgaggcaggagaatctattgaacctgggatgcagaggttgcagtgagccaagatcacgccactgccctccagcctgggttacagagtgagactatgtctcagaaataaataaataaataaataaaggattttattaaatcttatatccatatagaagaataattgcaacataagtataaaacactagaaataataacaaaacaggtaccaataaacctagttgaagaaatagaaaataaccaatttcttaaataagccctgtgtcccacaaaaacctgtccacagatgttcatagcagccgtggtggttaatttgttgtgtcaatccgacagggccatggggtgcccagatgctgtgtgatgtctgggcatgtctgttgaggtgcttccagatgagatcagcatttgaattggtggaatgggtgaagcagatgaccctcccttatgtgagtggggagcatcaatctgttgagggcttgattagaacaaagctagaggaatgagaaattcgtccccttttcgtctgcctcactacttgtgttgagatagctcacctcatcttctgccctcatactgggatttactctatcggctccctggattcccaggtcttttgacgcagacggaatgataccactgcctttcctgagtctccagggtctctagcctgcaaacagcagatggtgggacttctcagcctctgtgattgctgcagcagctaattttttgtaagaaatcttgatggggccgggcatggtggctcacgcctgtaatcccagcactttgggaggccgaggcgggcggatcacgaggtcaggagattgagaccatcctggctaactcggtgaaaccccgtctctactaaaaaatacaaaaaaaaacaattagctgggcgtggtggtgggcacctgtagtcccacctactccggaagctgaggcaggagaactgcatgaacccgggaggcggggcttgaagtgagccaagatggcgccactgcactccagcagaggtgacagagcgagactccatctcaaaaaaaaaaaaaaaagaaatcttgatggatagataacctcccattggttctgtttctctgaagaaccctgactaatactcagcattattcataattgccaaaaggtgacacccaagtgttcatcaactgacgaataaatgacgaaatgtggtatattcgtatgatgtgatattattcagccataaaaaggaagtactgatacatgctaaaatatagaggaagcttgaaaacatgataagtgaaagaagctggtcacaaaagccatatagtatatgattccatttatttgaactgtcaagaatgggaaaacacacagagacataaagcaaattcatgattgtaatgattatttagggatggaagggctaggggattcaggttgtgtttctttttaggtgatgagaaggttttaaagttgattgtggtaatagtttcatgactgtgaacatgctaaagggcatcgaattatatactttagtaagtgaactatatggtactgaggcaggatagatagtcaaggagatgaccacgtccttgggacatggcaaccacactgtcaacagcacaatgagccctgtaaccatgttcattgggacatagcaaccgcaccaacaacacaacaaacctcagcactcacattgtaatcaagctcatccaagcagaactaccttcactggggactttcccctgtagagagcatgtgcattttcactttgcttgtcctcagaatgaccctttgctcattataatagtaaaaaacacacccctgggtagagatttaagacggcaatgagacatgcaatgtatgaacaagcatgtacagcaactgctcatgtgcacccagaggaccacccagaacatgattactaggaacacacctcttcccacccactatgaataatcacataagactctcataaagggagttccctcagagccagtctttgctgactcactcttgatcagcccactctgacttatctttcagagtgtacctttcagagtgtatctttcagagttttatctttgcactaaattactttcagctgtttctttttacactcagctttcagagtgttctttctcttttgcaatacattgctttctgttgttcctctatggttgtgtctcttgttaaaattattttaaccaagaagacaagaacagaggtctcacaatcaccgtcaacagtatgtaaattatacctcagtgaagctattaccaaaaaaattaaccctgtgttcctcttcctcctaatgcagttgtagccactctcctgaattttgtctctattgtcctattgatttttaaatttttttataaacacatcccttaataatatataaatgtaatccttaacaatatacatttagtttataatttttaaagtttgtaaaagtagaatcaaacatcaagcattccataacaatatttttggttcaatattaggtttcatacccatgttgattggccatagctattcattcatttgcatggtactcccatgtggcaaatgggaatgtgccacagtttacttatcctgactcctgtcaacaatcactggaggttgtatatagtccattctcacactgctatgaagaaatacccaagactgggtaatttataaaggaaagaggtttaattgacccacacttccacattgctggggggcctcaggaaacttacagtcatgacagaaggcaaaggagaagcaggcaccttcttcacagggcagcaggatggagtgagtgcaagcaggggaaatgccagattcttataaaaccaccagattggccgggtgcggtggctcacgcctgtaatcccagcactttgggaggccgaggcaggcggatcacgaggtcaagagatcaagaccatcctgacccacatagtgaaaccccatctctactaaaaatacaaaaattagctgggtttggtggtgcaagtctgtagtcccagctactcaggaggctgagtcatcagaatcgcttgaacccgggaggcggaggttgcagtgagccaagatcgcaccactgcactctagcctggtgacagggcaagactccatctcaaaaataaataaataaataaataaaaataagatctcacaagattcacgtaccatcattagaacagcatgggggaaccacccccacgatcccattacctccacctggtcctgcctttgacacgtgggaattacaattcaagatgagattttgggtggggaccaccgccaaaccatattaggggtgttcccagtgtgtcaccattactgaacaggttactgttaatactctccatagtatgttttgataaacagatgttcttatctaatgtaatgaaatttatctctttgtaccttactttttgtctttattttttgtgcttatgaactacagtaaggtcataaagatgttctcctgtatttgcttctaaaaattgacatttggccaggcacggtggctcacacctgtaatcccagcactttgggaggctgaggtgggtggatcacctgaggtcaggagttcaagaccagcctggccaacatggtgaaacccatctctactaaaaaatacaaaaattagccaggcgtggtggtgcacgcctgtaatcccagctactcaggaggctgagacacaagaattgcttgaacccagggggcagaggttgcagtgagccaagatcatgccactgcactccagcctgggcaacagagcgagactctgtctcaaaaataaaataaaaataaaaattgacatctgtccttcacatgtaagtctgaaattctccccaaactgactttttctgtgcagtgcaaagtccatgtggttatatgtgaataccatttactagttagggatcaacaaactatagcctacaggcaaatgcaggccttcatctgtttttgttttgtttgtaatagacactgggtgtcactatgttgcccagttcaaataatcctcctgcctctgcctcccaaagtgctgggattataggtgtgaaccaccatgcctggtctcctttgcccgtttttgtacagcccagtagctaataatggtttctgcattttaaatggctgagaaaaacaaaaagaaagctaataactcatgacccatgaaaattatatgaaatttaaatctcaatgcacataaagttttattagaacatatccatgatcatttgttcacgtacagtattgtctatagctgctcttacaataccacagcagaggtgactaactacaacagacactgtgaacaccacgtaaggctgtctagcccttaccaaaaaagtttgccaatccctcaatagttcatcctttccccccatgatctgcagtactgtctctgttgtaaattagagtttcatttatttgtgggtctgttttggaaatttggctcaatccattggccaatttaactatctctacaccaaaaatacactatcttgatcacaataataatttataataagccttaataataacacaagtctccctgcctgatgttccttctttgttaatgaaatagctaaccctgcctctttacttttccaaatacatttcagaatctggcttccaattccaggaaagaccttgttgggatttggtttggaatcacattgaatccataggtgagttttgaaagaaactgacatacttatgccattgaggcttcctatccattaatgatatatctctctccatttatgaggtcttctttaatgtccttcaatattttctccatagaggtctcactcatttgttaccataatccttggtaaaactcacctacacgaccatccaggcacaccatttctttgtagaaaaagtgttaactactgatttatcctttaatgagcaaaggactgcttagatttttaaatattttcttggttcaattttgatgacatttttcttggaatatatcaattccatcaaaattttccaattttttataattatttatcaatatttgtttttgctggtttaatctctgcagcatctatagttgtggtctcttttttactcctaaatcatttgctgtgccttctctcttttatatgcttgtttttcttcatttatttttgctcatatctttgtattgtcttcccctttttctgtcttcttaaattggataattaactccttaacttgcacctctccttcctttctttctttttctcttcttcttttgctttctttctctttttcttttcttttctccaggctagtattgaattcctagcctcaagcgatcctcccacctcagccttgcaaagtgctgggattacaggcataagccaccatgccaagtcaccttttcctttcttaatgtaaggatttatgctacaaaattttttctaagcacccctttagctgcatggtccaaatattggtatctagtatttttgttatcattcagctctaaatattatctaactcccattagttttctttttttgactcataatgtatctagcagtatattctaaaattcctgaaagtatagggtttttctggttatctctcgctattgattcctgaattaattgctttacggttaaagaagattatttctacgttactaatctaaaatttgttggcttgctttaagactctcataaatattccatgtgtgcagttgaaaagaatctgtatttcacaattatattatatatggtcattaagtaagcttgttggtaaattttctatgtctttatagacttctatgtttccttcattcatcagttccttagaaaggtgtatttagatctcccactatgatgatgtttgtcctctccaaacttcatgttgaaacttaatcccaaatgtggcagtattgaaagatgggtcttttggcagggtgtggcggctcatgcctgtaatcccaacactttgggaggccgaggcaggcagatcacctgaggtcaagagttcaagattagcctggccaacttggtgaaaccccatctctactaaaaatagaaaaattagccaagcatggtggcacacacccataatcccagctactcaggaggctgaggcaggagaattgcttgaacccaggaggcagaggttgcagtaagccgagatcccaccactacactccagccggggtgacagagtgagactctatctcaaaaaaaaaaggaagaaaggaaaggaaggagaggagaggagagaagaaaagaggagaggggaggggaaaagaaaagaaagaaagagagagcaaaagaaagaaagagagaaagaaaggaagaaacaaagaaaggaaaagaaagaaagaaagaaagagaaagaaaggaaggaagaaacaaagaaaggaaaagaaagaaagaaaaagaaagaaaggaggaggaagggagggagggaggggaaggaagaaagagaaagagagaaagaaagatagaagaaagacagagagaggaaggaaggaaggagggagggagagaaggagggaggggaaggaaggaaggaagagagaaagagagaaagaaaggaagaaacgaaagaaagagagaaagaaaggaagaaagaaagagaggaaggaagggaaggaaggaaggaaaagagagaaagaacagagaaagaggaagaaagaaagagagaaagagagggagggaggaaggaaggaaaagagaaagaagaaaaagaagaaaagaaagacaggaaggaaagaaagaaaagaaaaggaaggaaggaaagaaaggaaggagggaaagaaaaagaagaaagaaaaagaagaaagaaaaaataaagagcctttaattggtgattggatcataaaggctccaccgtcatgaatggattaacccattcatggattaatgagttaatgaattagtggtttatcacaggaatgggactggtggttttataaaaagaggaagagagaactgagctaacacactcagcctcctcactatgggatgccctgtgctgcctccagactctgtagagagtccccaccagcaagaaggccctcaccggatgcacccccttaaccttggacttctcagcctccagatctataagaagtcaaatcatctctcattaattacccactttcaggtattctgttataaacagcagatgatgaattcctctttgcaatcagtcaaaaatttcattattttgagacttattaaatgcaagcaagttatatatttctagtgaattaaaacttttatcagaatttttttgtcctctgtctagtaataacttgctttaaagcctatattttctttttcttttttttttttttttttttttttgagacagagtctcactctgttgcccaggctggagtgcagtggcgcgatctcggctcatttccatttcagtctttgtgtgtgtgtgtgtgtgtgtgtgtgtgtgtgtgtgtgtgtgtgtgtgtgtgtgtgtgtgtgtgtgtgtgtgtatttttttagagacagtctcgctttgttgcccaagctgttctctaactcctagactcaaggggtcttcctgcctcagcctcccaactagctgggattacaggcagacaccactgtaccgattttatttatattttatctgtttttatattttgaatgtatcagctgtaaactgtattccctggatttgttttttaatccagtgtaatgtttgccttttactttgcaaatttagtccacttaggattacttatatatttggaattagttcctccattctatttttttatttctatacatgtcatctgttttatgtaatttttttctcatttattgtgtggtttggttttgggttttttttgttttgctttgttgttgtttttaattgaaccaggtgtttttgttttgccttcttgtgtttgtttttctcattcctttttcccccataattagtttggaggtttacattccatgtgtccccctcaccttataccatgtgagagagcgagcttccaaagacctactgcttgttgacctgtgtcccttaagtttggggagctcgagaactggcattaagtgctacatctaaaaagccggggcaaaaaaaaaaaaaaaggaaactgtactgaaagaaaatgattattctatcaacactaggacatgaatgggcaggtgtttaccctacaccagaagtggacccggcaggaaggagctggcatggagccctctgtaaatcctgcccaggcctccaaaagacagaattgtccccagacaacctggagatgaaggaaacattcacaagcaagtagggaagcatcgccctgtggaaggaaagaccgtcggccccaggggagtacatctgaggaatactcagaaaaaaacccttcagaaaaatggtcactttgaacacctgccaagcccagcaagcaacagctgcaagacctcaaatgaccagtcacacaacatggtaccttctcccagcctgacccgtaagggctcagcagcagggacgtcaaccatgagcccagccacatccctaatccactaagctctcaggcaacatttgcaccatgtgacccaccatcaggcataggcgataggtctagtggagatcacctgacccaaaggtagccaatgggaaagttgagttatctggcgaactgagccaatcagattctctcctggaggtgccactgggagtgtggacccacagacagcggggaaagaatctgagccaatgtgggaggagaggagcaggcaggaaggtgggtcagagacttggggatcatggcaagcagaagcagtgaggaagcaggagtgccaaggagatggaagcaacaaggcaaaggaaagacgtgtagagcaaaggaaaataagggaaattttagtaagattggcaagcatctatactaaatttccttatagccgaggactttttttttttcaactcagctgaacatctacagactccagctgctgagtctcagaggccatcctagatctagttccgggccaagggtcctggctgtctgctgctttctgttcttgtgtattatgtctttctgtctcccttccgccccgcatgtatcctgacgaccagaaacgccctctacttgagataactggagctggactctgcctcctgcaatgcaaagaacacagcacgcaaaaagaaagtgaaagacaatccctgaccaggaagacagcccggctgttccctgaacagacttcacaccaggcagttcttgctgcacttcccccaataaaatcctccctcgttttgctttattttattctgtgaaaataagccttattataaatcacaatgaaatccacaaaccaaaccccaaactctctagcaaaacaagacccccttgatgtataaagtcatcgctgacaggacagtctttttcagttattgcttttgtcgcttgtttcttgagaacatgactccaataaggctcatggctgccaagcccattcctgcaacgcttgcagcgatgatgacatctctgacctgcaacaaagaagagggtgggtcacactctgtgtcaggatccagagtacaggctgcacattcagcagaaacattcagctcgggatacctcacatgccccttggcctccctggccaaactaaggagtcaacaaacattggtagggaagaggggaggagagggctggacgggaaaagaattcgtggctggagccagctggcctgaaatttacatggaaccaaagatggaaaactggattcaccgtgtgggtattcaaagcatataaatcctcagagcgtggctgtggaaaggacagggagctgatgccaggatggtcaagatcttggctggccaatggggagctctagaagcaaaggtggagtcagggaggaattgttattgagtagtcagtaacctgtgacctccataagagcaaggaactcggctgtcttgttcatcactgtatccccagtgcctggtcctgccaggcatggaggatggaggtactcttcacatgttcttaaataaatgactcaattataaatagtagtgatgttatgcttagaattattaggatatctgacttgtttgtagtaggaaaaaaagtgtttcaaaagtaaaagtaaatgtccaggtaaaaattgaatatatgtccaattttactgcctcctgaaactcaactaaaagtaaactaaggcatttgtttaaggcataattccacaagaatacagaaagcactaaatcctaaggcagcaaaggaaaaagatgaggataaaccctaattatataaaagaatactccaaaaggatcacatattaaacccaggtacctctggaagtgggaaagaatgagagagagctttagctggtccctgaacctcctccctgacccccaaaagaagtctgaacgtttattctttgcagagggtacaatagaaggcttaggggcctagaaacctagaagcacatgtgagaatgtgggtatcataccacaaacaagggattgagagattgtaaacatgctaaatgtgagactcccagacctcctactcctctgttcccagaactttacgctccacacaagagtccagaagacttttctggggaatctggcccaaatgcaaacaacaaaagataccaatactgggaattcccaaacagcccacccagatcatcctgcagtgcaactcagagtcagcaaaccactgcccctacacccacccccactcactcagagctccatccagtagcaaacccccactttttttttgacagactgaaaactgttcagcacagtatgaaagaggtgagatgctcagctgggtgtggtggcttacgcctgtaatcccagcactttgggaggccgaggcaggtggatcacttgaggccaggagttccagacaaacccagccaacatgcgaaaccccatctctaaaaatcacaaaaattagccaggcctggtgacacgtgcctatagtcccaggtactcaggaggctgaggcagaaaaaaatcacttgaacccgggaagtggaatttgcagtgagcaaagactgcgccattgggctccgtccttggcaacacagcaagaatgaggtgaggtactgtttatataaatcataattaagtgatctcaacaatacaatgattttacagtatacattagaggccagtatatatagagggtaagagaatagtaacaaggaaaacataggtagaaagaattagcatctctttcctaacctatgaagttgaataataaatcttggtcaaaataatttcctgatagtaagacagtgagtatattaagtgtataaaactgaaaaaccaaagtgataaaataagaaaggtgcctttacacaagtaccacttgacagaagtgttatttgtaatttctcttggaaaaaaagaaatgtttaaaatgctttaaggaatctaaaataaaaagaacaaatacatatttagcttaacaaatttaagaggagaaattgtatttagatgttgtaatttaaaaacctagggcaacaacatttaacaaacagacattgtttttaggatataatttgttaactattttagtttacactaagtaatgtgagttggttttctttgaattcaactgaacatgatggttggcaagtgcactttttttttttttttaatctttgagatggagtttgctcttgttgcccaggctagagtgcaatggcgcaatcttagctcactgcaatctccaccttccagtttcaagtggttctcttgcctcagcctcccgagtagctgggattacaggcacccgccaccacgcccagctaatttttgtatttttagtacagatggggtttcaccatattggccaggctgctctcgaactcctgaccacttgatccaccagcctcggcctcccaaagtgctaggattacaggcgtgagccgccgcacccagccaggcaagtgtacttttaatcatgagcatacaaccaacacaccaaacatctgaagaagtcctctaaaattgaagacagagacaaaaaaaaaatagcaatctggagaaacagaaactatatctagaaaagaaaacatccttttaacaactatagcttctcagtcttttggctaagatcaagtataaaaattaccactggagaataagacagcatattgcatccaaaaggaaacgtccttttaaaaactatcattagatcgcttctcggcctcttggctaagatcgagtgtaaaaattatcactggagaataagacagcatattgtatccaataaataagaacgtggtactataaaaaataatgcaatattgagaaaataaaaacggttcatagaaaataaaaatgtgaaaaaacaactcaacagaaaagttgaaagataaagctaagttaaggaaatctctcaaaaagaatagcaaaaaaataaagaaatagaaaccaaagggaaaaaaataaaataaaaaacagaacaatccggctgggtgcagtggctcaagtctgtaatcccagcactttgggaggccaaggcaggcagattgcttgagctcaggagttcgagaccagcctggcaacatggtgaaaccccatctctactaaaaatacaaaaaattagccaggcatggtggtgcgcgcctgtaatcccagccacttgggagactgaggctgaagaattccttgaacctggaaggcagaggttgcagtgagctgagatggtgccactgcactccagcctggacaacagagcaagactcagtctcaaaagaaaaaaaaaaaagaaaagaaatagtgctctgagtcccatcttaatggataaaagtagacctacacaaaggcacattactatgaaattttatagcattgggtaaagatattacaacatttagagcagggagaaaaacaggaaatggagaaaagatcaggaatcaggatggcttcagatttctcaaagcaattctggaagcaagaagacaatggagcagtactggtaccaaaacagagatatagaccaatggaacagaacagagccctcagaaataatgccacatatctacaactatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacgaaagccaaaattgacaaatgggatctaattaaactaaagagcttctgcacagcaaaagaaactaccgtcagagtgaacaggcaacctacagaatgggagaaaatttttccaatctactcatctgacaaagggctaatatccagaatctacaatgaactcaaacacatttacaagaaaaaaaacaaacaaccccatcaaaaagtgggcgaaggatatgaacagacacttctcaaaggagacatttatgcagccaaaagacacatgaaaaaatgctcatcatcactggccatcagagaaatgcaaatcaaaaccacaatgagataccatctcataccagttagaatggcgatcattaaaaagtcaggaaacaacaagtgctggagaggatatggagaaataggaacacttttacactgttggtgggactgtaaaccagttcaaccattgtggaagtcagtgtggcgattcctcagggatctagaactagaaataacacttgacccagccatcccattactgggtatatacccaaaggattataaaacatgctgctataaagacacatgcacacgtatgtttattgcagcactattcacaatagcaaagacttggaaccaacccaaatgtccaataatgatagactggattaagaaaatgtggcacatatacaccatggaatactatgcagccataaaaaatgatgaattcatgtcctttgtagggacatggatgaagctggaaaccattattttcagcaaactatcacaaggacaaaaaccaaacatcgcatgttctcactcataggtgggaattgaacaatgagaacacatggacacaggaaggggaacatcacacaccagggcctgttgtggggtggggggaggggggagggatagcattaggtgatacacctaatgttaaatgatgagttaatgggtgcagcacaccaacatggcacatgtatacatatgtaacaaacctgcacgttgtacacatgtaccctaaaacttaaagtataataaaaaaaaaaaaaaaaaagaagaagacaatggagcaatgcctccaaaactctgaagtgaaaccatttccaacctagaattctatacccagacaaagtatcaaatcaagtgagagggtaaaatgacaaataattcagacacacagggtctcaaagaatttacctcccatgcatcctcttacagaaagctgctgaaaatggttccccaaaaacaggggagtaaatggagaaagtagaagacatgagatagagaaaatgggccttctactactagagagactggaagggaatctccccagaatgacagtaaagggagattccaggataacaacttagtaccaggtgtaaagaataactggtaggcagaatgataagccccaaaaggtgtccatgtcctaatttcaggaatctataaatatatcatgctacatggcaagtgagaattaagcttacaaatggagttaaggctgctaatcaatttaccttaaaatacagaaattatcggccaggtgtggtggctcacgcctgtaatcccagcactttgggaggccgaggagggtggatcacgaggtcaggagttcgagaccagcctggccaacatggtgaaaccccatctctactaaaaatacaaaaattagccaggcgtggtggcacatgcctctaatcccagctacttgggaggctgaggcaggagaatcacttgaacccaggaggcaaagtttgcagtgagctgagatcacgccactgcactccagcctgggcaacagagcaagactgtctcaaaaaaacaaaaacaaaaaaaagaggaaattatcctagattattcagatgggcccaatgtaattacaaagttccttaaaaggtagaagacagacagaagagttagtgtcacaatgatgcaatataagactcaaccagccattgctctagctttgaaaatagatggggactataagccaaggaatgccagtatgttgtggaaagtcggggaccccaaacggaggaccagctgaagccacagcagaagaacataaattgttaagatttcatggacatttatcagttcccaaaattaatactttcataacttcttacacctgtctttactgcaatctctgaacacaaattgtgaagatgtcatggacatttatcacttccccaattaatactcttataatttcttatgcctgtctttaatctcttaatcacgttatcttcgtaagctgagaatgtacgtcacctcaggaccactattgtacaaactgattgtaaaatatgtgtgtttgaacaatacgaaatcagtgcaccctgaaaaagaacagaataacagcgattttcagggaacaaggaaagataaccataaggtctgactgcctgcggggtcgggcagaatagagccatatttttcttcttgcagaaagcctatagacagatgtgtgagtaggagaaatatcgctgaattcttttccgagcaaggaacaaccctggggaaggaatgcattcctgggggtaggtctatagacggccgctctgggagtgtctgtctgatgcagttgagataaggactgaaatatgccctgtctcctgcagtaccctcaggcttactaggattgggaaattccagcctggtaaattctagtcagactggttgtctgctctcaaaccctgtttcctgttaagatgtttatcaagacaatgcgtgcacagcaggacacagaccctcatcagtaattctaattttgctttcaccttgtgatctttatagccctttgaagcatgtgatccttgtgacctactccctgtttgtacgccctctccccttttaaaatccgtaataaaaacttgctgattttgtggctgggggttgtcatcacggtcctaccaatatgtgatggcacccctggaggcccagctgtaaaatttctctctttgtactctttctctttatttctcagcctggccaacacttacggaaaatagaaaagaacctatgttgaaatattagggactggttcccccaataccagtaacctctagaagttggaaaaggcaagaaaattgattttctcctacagacactagaaaagaatgtcaatgctttgattttagcccagtgaaactcattttagacttctggcccacagaactgttgataataaattgtggagtcttaagccactaactttgtactaatttgttacagcagcaataggaaaataatgcacttatcaatccagattggagcattgtgactccagagcctagcatgttgaggactgccataaccactatcctctcccattgtactgtgtttctaacctaaagcaacttctggaggatgtgatctacctaaataagagaaagagcaaagaaacagaaaactaagagatcatagaatcagagaatgcaatccaagagaaggaaaggaaatccaaaggatgacagccaaggggagtccaggatgacagccatgcaattggccaaggagcaaccagcacagagggaagaagggccatctctgggatagacgtgtccaagcaaaataaacaagaacttgtaggttacttgacatggtttcccttgtggagaactgtactgagagctaattggatcatgtgggaagaattgacaacaggtacaaagaaaactcggcaatgaaaggaagtaataattatcataaagaaaaaagaactccctccacttccctcccaaaacagaaaggaaactatcacaattcaccacgacactcagctgtgagttttctcatcatgagttctggctgctgagaaatcagttctgggcaccttgtgttaattacactgctgtgtttcctgaggttaaacacaactatgtgtttcctgacattaaacacatttatggcccagataagcctcagtagcatcaagatacgtatatatttttaaccactgaagatccccaaactcttctcaacattggtcacatagaagttttaacagatagccaggcacagtagctcatgcttataatcccagcactttgggaggccgaggcaggcggatgatgaggtcaggagttcgagaccagcctgaccaacatggtgaaacctcatctctactaaacatacaaaaattagccaggcatggtggcacgcacctgtaatcccagctactcagaaggctgaggcaggagaatcacttgaaccgggaggcggaggttgcagtgagccgagatcacacctctgcactccagcctgggtgacagagtgagacaccatctcaaaaaaaaaaagtagttttaacagacagaattcatgatgaccaaagtttggatggagctaccaacctgaggtttgactgctgctaagtctttaaatgctcctctaaaagataattaggcatggttttgtggcagccatggttctgttgggttaacttgctagggaacctgcataaaatcacttgtatccagcattttccttgctaagctctgtgtcagggtaggagaaatagtctgcagataatggaggaggaacaatatgtccctagttctttatagaacctcatggtgtgaaaacaaaagctgatgcaactggttcatacaaaagatactttgtcaaggaaaacaacaataacctcattgtttgtggccatgctttgtacatagtcaaagagtatgattaaacacaagactgttggaagctagttagtcctaatagtgcaaacttgatgggaaaaactctctctccaagagtcagtgctaccttcagatgccattgatcattttcatgttgcaagactgaaaggtccaatccagctgctgtgttgttattacaggatttctgatcatgaaaatgggctacctggtgtgtgtcacaggtcttaaatcaggatatcaggatattgtgaaagagaaaagctgtctctcattagaaatattaagaagactgttttttttttaagtgggcaaacaaattctgccagactacagacatttagacatttatactacaaagctcttctgagttaagccttgatttagggaaatctaaatcatttctggaaaaaagaaagtgctaatgtgctgccttcactttcaacaatgttataggtggattaaagaagaagtggagatagtagtgttattctgaaagcaatccaattgagactgttagaggttacaatataagaatggttatgaaatagttgtatattttccaacagtgatcaagtatacaaaaaataataaatcatttaaaaagaaataaaatatttgcataaaaatttggtttcatttacagtaatttcaaaataataccccacaatttatccagatttatgtaatatatgtattgccgccagacacatcttcaatttctatttaccttaatattttctctcactcagactagacttcattgtgagtatagcttctggttgctttttttttttttttaagtactgttcagtatgaaagtttctttacaaaaccctactaaaatatatgttttttgaaacctaaatatttttaggtaggtggaaagtaggagaatcttttttttagaatattcttaggcatgtaaagcacaaattacgttttagtttaaattcattgtttcccttctcaggaaatttgattaatcataaacttttttttttgtttttttttgtttttttttttttgagacagagtcttgctcagtcgcccaggctggagtacagtggtgcaatctcggctcactgcaagctccgcctcctgggttcacgccattctcctgcctcagcctcccaagtagctgcgactacaggccaccacgcccagctaattttgttttgtatttatagtagagacggggtttcaccaggttagccaggatggtcttgatctcctgacctcgtgatccacctgccttggcctcccaaagtgctgggattacaggcgtgagccaccgcacctggccataaatattcttttgaaggaaaatctagtctgcttcaaagagctcagcacaaatataatgactggtcagattctttaaaacacacaaaaatatcctcatgagttaaatgaaaaggagagtcactgcactgacagtgcttacaaagaaaaatactggtggacattttctgatatgtactaaatctatcatctctagcaagatggggcatgcatcgaagttctttttttttttttttgagatggagttttgctcttgttgcccagcctggagtgcaatggcgcaatcttggctcactgcaacctccacctcccgggttcaagcaattctgcctcagcctcccgagtagccgggactaccggtgcacaccaccacgcccagctaatttttgtatttttagtagaaacggggtttcaccatgttggccagtatggtctcgatctcttgacctcatgatctgcccgcctcggcctctcaaagtgctgggattacaggcatgagccactgcgcccggccagaagttctatgttaatttgactcacagcatgtgtcagtgatcattactcacctaagtcactagttctcaactggagacagtttttccctgtggggggaattgtctacagacgtttttggttcttacatctggcggtgggatgctactggtatctagtgtgtagaggccagggatgctgctaagcatcctacagtgcacaggacaggacttgacaatgaagaattatctggcccataatgtcaatagtgctgaggctgagaaacccctatcctagaccaagaaatgaaagaggaaatctttagaagcagtagagatggcacctctgtttttgttgtagaatattctggcttcattttctgtgatgggatcaagtagaattgttcatgctgtttcactgttgtgttatcattgttttgcctctttcaagtgaatgggtagatgggtagggccaaagtcccaggaagaaaagtgtgatgtgttcaatttgcattgtttcattttgcaagtgttaaattattgtttacaaaaagaataatggtataagacatttcttagttattttactatctcaagatttggaattttatttaattactccaaatagcatttatggccaggcgcagtggctcacatctataattccagcactttgggagactgaggcaggagggttgctagagaccaagagtttaagaccagcccagacaacaaagtgagaccctgtctctacaaaaaatacaaaaatcagccaggcatggtgatgtgcacccatagtctcagctacttgggtgtgtgtgtgtgtgtgtgtgcacgtgtatgtgtgtgtttgagaaggagtctcgctctgttgcccaggctggagtacactggcgcaatcttggctcactgcaacctccacctccagggttcaagcgattctcctgcctcagcctcctgagtagttgggactgcaggtgcccgccatcacacccagctaatttttgtatttttagtagagacggggtttcaccatgttggccagggtggtctcaaactcctcaccttaggtgatccacccaccccagcctcccaaagtgctgggattacaggcgtgagccaccacgcccggccagccccgttctttattctgttaataactgctgaaagaataactaaatgagatgattaggatatattttgtaaacctaccaaatattcttaacgtagaactctgaatttcaaaaagtatcttattgcttcccaaggttgtcttgtactctgtatttggagtttattgctgcataggagcatgagttttaccaagagtaagtaaacaccttgatagtgatgcaagatcaccaatgatgaaactcaatttgttatcatgtttgtctttcttatgctaatattgtcactgctaattcaaaaaaaaaaaacttctattatacctaaatctgtcaataaatgttcattttcaaatttaaaaagatacataaatgggccaggcacagtggctcacgcctgtaatcttagcactttgggaggcagaaacaggcagatcacttgcagtcaggagttccagaccagcctggccgatatggggaaaccacatctctaataaaaatacaaaaattacccaggtgtggtggcacatgcctttattcccagccactctggaggctgaggcagaagaatcacttgaacccaggaggcagaggttacagcgagccaacatcgcaccactgtgctctagcctgggtgacgaaacaagactctgtcttaataaataaaaagatacataaataaaaaacaagagagagaagataagaaaatcagcaaagcagtctagggatccaatagcctaataataggagtgccagagaatacaaactggaaaatttccaagaactaaagaaagtgagtttccaagtacctggcacaatacatgaaaatagacccgtgcaaggtaataaatttcagaacactgaggatgaagagaagattctatacagttctgaaaagaaaaaatagatcacatacaaacaataaaaaatcagaacagcttcagacttctctaccacaataacaaaagctagatgacaataaaccaatgccttcaaaattctgaaaaaaaaaatattatttctaacctagaattctatacccagccaaatgattaatcaaatgtgaggataaaataaagatattttcaggcatgcaagatctttttttgtttgttttttgtttcttgggtctttttttttttttttctgaccaagtctcactctgtcacccaggctggagtacagtggcgtgatctcggctcactgcaacctctgcctcctgggtccaagcaattctcgtgcctcagcctcaccagtagctgggattacaggcgcatgtcaccatgcctgcctagggatctttttaaaatgtaccatttctcagtaaactattaggggaagtagtctaccaaaacaagggcataaaccaaaaaagagaaggatgtgaactacagaggataaaagcattaatatagcagggaactgaaagaaatttctaggatgctagtaaagagagataccaagatgacagcaatgcctcatcaagtgtgacaagagacaaatgtggccgggcacagtggcttatgcctgtaatcctagcactttgggaggctgaggcgttaggatcatttgagctcaggagttcaagaccagccttggcaacagagtgagacctcatctctattaaaataaaaaacaataaaataaaaaaaattttttttgagactgggtcttgctctgtcacctaggctggagtgcagtggtgtgatctcggctcactgcaacctctgcctcccggattcaagtgattctcttgcctcagcctcctgagtagctgagattacagatgcccagcaccatgcccggctaatttttgtatttttagtagagatggggtttcaccatgttggccaggctggtctcaaactcctgaccgcaagtggtctgcccgccttagtctcccaaagtgctgggattacaggtgcgagccactgtgcccggcctaaaataaaattgttttaagaaaagaaaaacaagacacaaatgttttgaaggctgttatccccaagagatagatgtagtaagtgccaccatcccctggtctcctgctttctttcactgcatcacctttttaacctgacaatattcaggcactaatgaagttcttctcatggccctgcccactgattccccagaagaaagctcttatcaactctcagggaagttgaagccagaccatgaccaacagactgcaatcttcacaaacattggcaatattgccctttctttacctagttagctatgtaccacctactcaatttctaagttgatcacctttaacattcatatataaatagttgttgaacatgaataacccaactgatcgaagaaaaaaataagaggatacccattcaaaggtaactaatatcccactgtagacaggtataggaaccgcctaacaaacatgagggttggtgtagtaagcacagctggttatcagcagtatgaagagagtaagagtgattcctataggtggtgttagtcagtgtcttcccattcaagtggctgtggcccacagaggccaggggaccaggcaatggatgagccaagcaaaaaaaaaaaaaaaaaaaaagaggaggataatttaaaaaaaaaaaatgaggataatcatgactatttttactactacaatgtattcagtgtgctaagaataaacatgctcttatttaattcacaaggtaatcctccaagatgagtattatcattcgtactttaccaaagtgtagggagctggactaactctcctgaggtcagacagccggcaaaaggcagagaccaggtccagcccacgttggcctgactccaggagcccaggctcttaaccaccacactgaccagggaagaagaaattggatctcaaaaaaaataataataaaagtgaacagcctgatggatcttaagctaatcattcactgaaaaaaatatgtattcttttgcatcaacagccatgtaagaaccttcccaatgttcttttcacctatgcaaagaaaaaaaaaaaaaaaaagatggaagtggctgaaagggagggggaagaagtgcaaggaaatgagaagagaaaaagagattgaaaggagaggaaagacaaaaataaaatcaagtaaatgaacaaaactgcatcccctagggtctcccagattcacccttagggttcagccaggctgaagacagtgctgtttataagcacgatcaggctatgccacacagacctgggcttcaaatcccaactctgctaattatctgcacaggaaaagacaggtaccaggtctggagactcaacaaagatttttttgatgaaatgaatggctgtagacaagttacttaagctcagtttcccaatctgtaaggtagtgggtcctaaaacctgcctttagggctggggagggccatctcagggacaggtggccagggagggcttggcaatgggaatgatcatcatgtctgtgactcctttccttggccacccacccccgcccccgactacactgatctgcattgccaacttgcctctctccccacccttgtccccacccttgtcccaactgtgacatcctcaagggcagtaattctgtctctgctattttgtcttgttcatgcctccatagccatgcccagcctccgtcagcagagggaatggtctggttcctggggaaggcgacacaggcagaggacgcacctggtcactgcgggcgactccatagcgcagctcattcacaaagtgctcgcagttctcactggtcagcttgtagagcacctcctgccccaccagctcctccgcccgctggatgattttgctgcagggcagcggcgagtacttgtcatcatgtttgttgttgacctggtacttgtcactcccggccacatcatacagcaattccttcttcacgatggccttgtcagtcagggcggacatgacactggctgcaccagctcctgcgacctcacctgcagatccacaaagaggaaacagagggattggtcctgggaagggccacggaggctcagagctggcccccagccgggcatctgcccttggctcatccacaaaggataagcaacaagtggaagggtcagacgcatggctgtgggccttggggaaggtgtgtgtggtctctgggccctggtttccttatctaaaatgaaagggagtgaagttccatgatttactgtgatttttttcttactctagagaaggtggtcttctatacctcatgacacttaagtggcccccttggttatgcaaatatgagccaagagcatactcatccacctgggaagataaggtgggagacttttatgatggcatcagggctacacctacttgaccacacaaagctgcttactgcagaaaacatggctgggttttccagagtcccagcccttctggaaacagacccaccaaaacgcacagctgtccccctagctgtgatggatgctaaggaggcttagtgggtacatgggcacagcccaggccaaggcccagggcaaggaagggccacaaagctccagaaatgaaatgatcttgaagacaaggagtccaggttcaacatgaagaccaggatggtggacagggaaagctgatgccaacacagactgggcattcctcccaactcaaacaacctgtgtggcgcagggagaggcaggcactgagtatgatgattgaaaaagtggggatgggctgggcacagtggctcatacctgtaatcccagcactttgggaggccaaggcaggcagatcgcttaagcccaggagtttcagacaagcctgggcaacatggcaaaactccgtctctacaaaaaatacaaaaactagccgtgtatggtggtgtgcacctgtgatcccagctactcaggaggctgaggcaggaggatcacttgagccctggaggtttaggttgcagtcagctgagattgcgccgctgcactccgacctggacaacagagtgagatcttgccttaggaaaaaaagaaaaagaaaaagtaggtatgcactcaagggatgggcctacgcacccagggagcatgtcaaaggaggttcactctcactctcctcaaacagccactgtgaccctgtcagggtcaaggcccccagggtgccacagcagcaccctgttaaactgggtaggaccagtcttcaacaatgacatccgtgtgacagcaacagcaggagaggccgattagatttcaggtcctgctcttctccgctttccaaagaccaataaaccttttcagcctgcatgcaatgcctacatgcaatgccaagatattagaaatttagggaattcagacttgataggaaaagggcacgtgaagcttggaagattcattgaagtaaataaaagagagggtgccttattggagccctgcgtttgtcgggaggatgagctcctggggcccacccagcctcagctcccaggcaaagtgggtgacagcgcagggactcggaagaggcaagcaagttgcctagagcccaaagtttaaggaggcaccaaatctcagggccatgcaagtgcagagtcaacaaccaagagtgaggacttccttaaacttatatctagatgccacccaggacaggggtaccctgtgctcaagctggcggtgagaagctctgggttcgaccccagcacatcaccaaccagctgagtggtctggacctgtcacttcactttgctccagaaatccccaaatacacactaaaattgatgcacaaatacatatcaacacagtaatttaaagttccttcttttttttttcttattttgagacagagtctcactccattgcccaggctgaaatgcagtggtgtgatcttggctcgctgcaacctcctcctcctcagttcaagcgattctcatgcctcaacctcctgagtagctgggactacaggtgtgcaccaccatgcccagctaatttttatattttcagtagagatggggtttcaccatgttggccaggctggtctcgaactcaagcctggtccgagctcaagcaatccacccacctcggcctcccaaagttctgggattacaggtgtgagccaccacacctggcctaaagttccttcttttaaaaagtgagtctactgaagaaaatatgaagtgaacaatcacagaaagagcatgtggatgtggcaatccatcagcgactgaattttgggatagcttggactgggcagtgcagcattgtggttaagtgcacagaatcaagtcagactgcctgggtttgggtcctgcctgcaccccttaccattatgcaaccttgggtaagtttcttaacttctctgagtcccccattccttgtaggatagaaacaaaaatagtccctactgcacaggcagctgtgaggattaaaggggttggccagaaaacatgctttcaccagtgtctggcacaggacaggcacttcagcaagtttataagcttccttccagctctaatttctacagttttctcagcagcagaaggtcagtcctccttgcctcatctatcccacatgactcctgtgaaactcaagtgagatgcaggtagaagcatcttttcctttgaaggagtatcactgacctgatggtctgtgacacacctgtccacctgtccacccgggtgcttgtcatgccttccccaaccctctatctaccacacacacctgctcagtgcagccaatcaatactgaggccctactgggtgccgggccttgtccaaggtgctgaagtcagtgacgtgatctggacagcaggcctgccctcaagcaattcccatgctactgagaagacgctgacaatgaacaaatacacaaaataagatacttgcaggtaccaacagacactatggaaagacagagtggagtgacatggcaaggatgaccagcagaggctgctgttgctcaggctggggaggccaccccaaggaaaaggcatctttgctgaagcttgaatgatgaagcatctagaacagaaggaacagcaggaatgaagtctgcagggaggagagagcttggcatgccaagaggcagcaaggaggccaacgttgctggagtctagagacccaggaggggagaagagaaagacgaggcccaaagtcacagaccaggccagaccaggccgggccctacaggccacagtgtagactttgatgctttgttttggtttggttttggtttgtttttttgagacggggtttcactctgtcacccaggctggagtgcagtggtgcaatcttggttcactgcagcctccgcctcctgctcgtgcctcagcctccgcctcctgctcgtgcctcagcctccaagtagataggactacagtggcgcgtcaccatgcccgactaatttttgtatttttaatagagacggggtttcgccatgttggccaggctggtctcaaactcctgatctcaggtgattcacccacctcagcctcccaaaatactgggattacaggcatgagccaccgcacctggcccttgatttacgctttcaaacaatcacaccacctgcccatgaatgaggaactggccgtgagtggcaagaggcagagagaccagccagaagtgacactgccaccaggcgagggagggtggttgctcataccagggcgctgcagtggggatggtaagaagtggtcagagctggggtctgtttcagagataaagccaacaggattccctgatagattagacatgggttggaaggaacggagaatgactcctaggctttaggcctgagcagctgaatggtgtcttccactggagcctcccatttggggcagatcaagttcaagatgccaggtagacacccaagtggagttaccaagtagtcaagaggttatgcaagtctgaagctgaagggggatgtaaattgagggtttgggcttaggagatattgacaaatagaaggtattggaagctaaggaatccaatgaggtcatctgagctcgatttagggaaatgagagaggaggaggagcccacacaagagaccaaaaaagaagggcccagagggagaggaagaaagtcaggtgccaggtggagagcaggaaggtcactcacatcaaatgctgcagagaagccaagtcagctgtgatgggacttggctttaagctttggcaagatgtggaagcttttccctacccttgagaactgctctgtcaggggggcaaaaaaagagagtctgagagcaaaactccatctcaaaaaaaagaaaaaaagaaaaagaaaaaagaaagtgtgggtataggggatggaaggcagaatgggaagcgaggaaccggaggtggccaggcagacaaagctgtaatgagatctgctctgtagggcgttaagcagagaaggatgtgaggccgggcgtttgatcaacgggatatattacagctgtctctatgtcaatacgaatgatccagttgaaagggagaagatgacaatacagaaggaggtggggaatttgaggagcaaagtgcttatgaaaggaagaggagggggtgggggtacatgggtaaggggctcagggtggggaagatgacatctactctggttactactgatagggtgaggccactagttagaattaaaacgatatgcaaaagacatgttcaagggccgtgcgcggtggctcacgcctgtaatctcagcactttgggaggccgaggcaggcagatcacttgaggtcaggggtttgagaccagcctggccaacatggtgaaatcccatctctactaaaaatacaaaaattagctgggcatggtggtgcgtgcctgtaatcccagctactccagaggctgaggcaggagactcgcttaaaagcaggaggtggaggttgcagtgagccaagatcatgcccctgcactccagcctgggccacagagcaagactccgtctcggaaaaaaaaaaaaaaaaaaaagagtgtctataacagctctattcatagcagtcaaaacctgcaatgagtctgatgtcagaaaaatggatgctaaattgtagcatattcatataacagaaaatacacagcagtgaaaaagaattcctgctactcacagcagcatggatgactcacatgggcatgatgttggctaaaagaagccagacacaaaagagcacgggccgtgtgatacctcttccatgaagttctagaacaggcaaaactcatctatggcaggaaaagctagaatgatggttgcctgggcgaggcgtggggaggcatattgtagaagcatgagagagcctttcagggtaagtggcacagtgggaatgttctagatgtggatctggggcactgttacatggatggttttttttaattcactgactgtatactttactatgcttgtacattttacaatacttatgttataccccagtttaagttaaaggcttaagagaagggtgaggaattctcacaagagttctccaagttaagtattcatatcctcagtttgcaaaaaaggaaatcaaggctgaagaatggaaactggattcataaccaagtctctctgcccaaacacctgcactcttcccaggagctttacgcttaagagttgagtgtgttgcggccgggcacagtggctcacgcctgtaatcccagcactgtgggaggccaaggaaggcggatcacgaggtcaggagatcgagaccatcctggctaacacagtgaaaccccgtctctactaaaaatacaaaaaattagccaggggtggtgccaggtgcctgtagtcccagctactcaggagcctgaggcaggagaacggcgtgaacccggaggcagagcttgcagtgagccgagatcgcgccactacactccagcctgggcgacagagcgagactctgtcaaaaaaaaaaaaaaaaaaaaaaaaaaagagttgagtgtgttgcatacaaagtcacggcataaaaaacacatcaaaacagagcttcgtcctcagatgccaccttggtccctctacagcagcggtccccaacctttttagcaccagggactggttttgtggaagacaatttttccatggactcggcagtggggagggatggtttcgggatgattcaagcacatgacatttattgtgtactttatttctattattattacattgtaatatataatgaaataatcatacaactgacgataatgcagaatcagtaggagccctgagcttgttttcctgcaactagatggtcccttctggggtgacgggtgacagtgacagatcatcaggcattagattctcataaggagtgatatggtttggctctgtatccccacccaaatctcatgtcaaactgtaatccccatgtgtcaggggagggactatatgggaggtgactgaatcatgagcgagatttccctcatgctgttctcatgataatgagtgagttctcacaagatctgatggtttagaagtgtggcactccggacatggtggctcatgtctgtaatcccagcactttgggaggctgaggcaggtggatctcccgaggtccagagttcaagaccagcctgaccaatatgatgaaaatccatctctactaaaaatagaaaaattagtcgggcgtggtggcaggtgcctgtaatcccagctactcgggaggctgaaataggagaatcacttgaacctgggaggtggagtttccagtgagccgagattgtgccatggcactctaccctgggcaagaaaagcgaaactccatctaaaaaaaaaaaaagtgtggcactcccccgcctcctgccaccatataagacctgccttgcttccccttcaccttctgccatgatggtaagtttcctgaggcgtccccagccatgcagaactgtgagtcaattaaacctctttctgaagggccgggcgcggtggctcacgcctgcaatcccagcattttgggaggctgaggcaggtggatcacgaggtcaggagatcgagaccatcctggctaacacggtgaaaccccgtctctactaaaaatacaaaaaattagccaggtgtggtggcaggcacctgagtagtcccagctactcaggaggctgaggcaggagaatggcgtaaacccaggaggcggagcttgcagtaagccgagattgcgccactgcactccagcctgagtgacagagcaagactctgtctcaaaaaaaacaaaaaacaaaactcttttctttataaattacccagtctcgggtagttctttatagcagtgtgaaaacagactaatacaaggagtgtgcaacctagatcccttgcgtgtgcagttcacagtagggttcatgctcctatgagaatctaatgccgctgctgatctgacaggaggtggagctcaggcggtaatacaagcgatggggagcagctgcaaatacagatgaagtttcgctcacttgcccaccactcacctcctgctctggagcccagttcctacccagtaccagtccatggcctggaggttggggacccctgctctaaagaaccccctgaggttcccaggagcagaccttgaaaaccagtgccccacaccaaactgccccatatcaaacttcttgtaacattcagagacaactgccagttgggaagcaagaagaatgttggggtcacctgttacccacagttccccatcccctctcttcccagcccctggggcccatcacagtggaggtcccatgtgttcttacttggaggggccagatgaaccacatatccatcgccaacatagatggcccagtgtctgtagaaagggcgaaaaatctcaatcaggtctccaggcttaggctctggctgcaaaaccaagaacagggctgttagagggagcatgagatcgtggaaccaggacagggctcagtgaggaaggtgcagctgagtggtccccagctatcagctcagcagaacatatgtcctgagccctgctctgccaggtccaatgccagtccaacttcacaagcttgtgacccagacctgcaggcaccatgggcctgcccttctgtcaatacaaattgccaagtgcaaacctaaaaggtttcttcatgagctggagtctctgccttattatttctaggaatattatttattgaactcttactctgagccaagcactccactctccatgttttacaagatggctcaataaatccacacaaccatccaatgatgaaccccattttatggatgaggaaatcaaggcctagaaatgtaaaagaatttgtgcaaagacatataactcatgagtgacttggccaggactgaacgcccagttggctgattcccagcccagtctgaccatcaggaaacaccaccagttatgtgactagagctgcccacctggggtccatgccagaggctgccagatctggagggcattccacagacactccccaacacctggcctgggcctaatggagaactggcatcagtctccagcagtaatgtcccccggctgctcagcctgatgctaaggtgtgcatgttcacattgagtgagtatgtgtgtgagggtggatgcatgagtgtgagactacgtgtgagagtgagtgtgcgtatgtgagaaggggaaggtagggagggtgcagtaaatgctctcaccctgttaggggagcatggggcagagtttgagaaaacttcagagaggttcaagatcccatccattcaacattatccacgtccattcagcattaaccacatcccagaatcagaccctgcactgagtgctgggggaggggaagttccgactctcactagaatcaggggtaaagaacttctccaggccaacctttaaacccctttaatgagcaaagaaatcaacctttcagaacacctagagacagagcccatcagaggctggttctggccccttcatcctttgctggagtcttcagccacagtcagggctaaactgccctcagcacagtgaagatatggggtgaggactccggcttgcttgcaccttgagtcagatccataggggttttcccacatctcgccagcaagcttggtggccctaccagagacattccatcaaggatgaggcatggggaggactcatcctcggctgacctcccctgggcgcaaatgatgggcagtggttaacagccaatcacaactctacaacgcctatgaaggcgggtcaaaggccagtttgcttattatttcacagaaacattaaaactacaaacaggtagcatgtgtggcagggaattttacagataaatcatgttcttttgttgcagtaaatataatttcttttccaaaatagagggcactcagttcttactgagaacctatttcagaacaatggacaatggtcacaatttatgaatcccattgttttccaggaaaaaaaaaagagtattaattgtttggtcagagtttggggattcaagaatccccaaaaaggaatttaaacagggatctcctcaaacagacaaggacataaagactgggtgggtacccatccctgagggaggctgcaggttggaaagagatggtgtggacatcagtaagaccatgttgagtaataagcagctggcagtgtgcagagccaaagagctcacctgctccacataaacaccaatgagaggagccctcacatagaacatgctgcctttattttttctttttaagacaggatctcactctgttgcccaggctggagtgtagtggcatgatcgtggctcactgcagcctcaacctccccaggctcaggtcatcttcccacctcagcctcccaaatagttgggagcacaggtgcacaccaccatgcctggctaatttttacatatttttagtaaacacagggttttgccttgttgcccagctggtgtcaaactcctgggctcaagggaacctcccacttcggcctcccaaagtgctgggattacaggcacgtgccatcgcgcccagccccatgctgcattttttaaaacagaagttattacgatgacaaaaaataatttaaaatattataatggttcagacagaaaaagtattccgttatctaaaaaggaagagtgaaaaagtcatacccaaaaagccacatactgtatgattccatctatatgtcattccagagcaggcataactacagcacggaaaagtgatctgtgattgtcacaggggttgaggagagggactgactagcaagaggcgtgagggaatttcaggggtaaaatttctatactcttctacatcttcatggtttttttgttttttttgttttgttttgttttgttttgttttgtttgagacagactctcgctctgtctcccaggctggagtgcagtggtgcgatctcggctcactgcaacctccacctcccgggttcaagcgattctcctgcctcagcctcccaagcagctgggactacaggcgtatgccaccacgcctggctaattttttgtatttttagtagagatggggtttcaccatgttggccaggctggtcttgaactcccaacctcaggtgatccacccgtctcagcctcccaaagttctgggattacaggcgtgagccaccacgcccggcctactcttctacatcctgaatgtggcaaccattctgcaattacatgtgtttattaagactcacagaagtaaacactgaaagggtaagttataacttaattttttttaagaaactaaattttaaaaataaataaaaattaaacaaaaaaaaaaatttttttttttttttttgaggcagagtctctctctgtcacccaggctggagtacagtggcacgatctcggctcactgcaagctccgcttcccgggttcatgtcattctcccacctcagcctcccaagtagctgggactacaggcgcctgccaccacatccggctatttttttgtatttttagtagagatggggtttcaccatgttagccatgatggtcgcgatctcctgaccttgtgatccgccagcctgggtgacagagtgagactccatctcaaaaaataataataataaataaattttaaatatttatttacagtttagaagggaaaaaagctgtaatttttttttttttttgacattcagccaatctgcctattctttgtaagggcaagagatacatattcccaagctcaacacataattacgctcaagctcaacacataatctcactcaagacaacttctttttgaaaatgaagtaaaagacagtgggctcacctatggagccctacacactagttaggagcaagggtttgatggtcacttggcaagttggatatctttaaaagacactgcgaagtggaaaaatggggatgagctctgtaacaaaatgccacttatataaattaaagatacatggccggatgcagtggctcacgcctgtaatcccaacactttgggaggccaaggtgggcggatcacccgaggtcaggagttcaagaccaggctggccaacatggtgaagccctgcctctaccaaaaataaaaaaaattagccagacgtggtggcgtacgccagtaatcccagctactcgagaggctgaggctggagaattgcttgaacccaggaggtggtgggggttgcagtgagcagagattgcaccattgcattccagcctgggtgacaagagcgaaactctgtctcaaaaaaaaaaaaaaaaacaaaaggaggccaggcacagtggctcatacctgtaatctcagcactttgggaggccgaggcaggcagatcacgtgaagtcagaagtttgagacgagcctggccaatatggtgaaaccccccgtctctactaaaaatacaaaaattagccaggcgtggtggtgcacatctgtaataccagctacttgggaggctgaggcaggagaatcacttgaacccaggaggcggaggttgcagtgagccaagatcgcaccactgccctccagcctgggtgacagtgaaactgtctcaaaaaaaaaaaaaatgatgattaaagggaacaaataaacacagaagacaggggagtcttgtagggaccagcaaggacagggcgctatgaaatgaagatatgaataattcacctctaccactaagatccacctagaaaaacaagtacttatcattatacacgtcacccatctcagctgaatcaaaactaagaatccaaaaactcatgttctaaatttagaagtatgaaaactgcagttcatgggccaaatttggacctctgcctgcaagaggtctgcctgcaagctaagaatggtttgtacttttttttttttaatgcttgggggaaaagtcaaaggaggaatagtattttgtgacacatgaaaattatatgaaattcaaatttcagtgtccataatgctttagtggaacatcgccaggctcatacatttacattgtgtctaccctggctcctctctacaacagcagggttgaatagttgtgacagagaccatatagcctgcaagatctaaaatgcttactatgatggccaggcgcagcggctcatgcctgtaatcccagaactttgggaggccaaggcaggcagatcacttgaggtcaggagttcgagatcagcctggccaacttggtgaaacactgtctctactaaaaatacaaaaattagccacgcctgttggcaggctcccgtagtcccagctactcaggaggctgaggcagggagaatcgcttgaacccagaggcggaggttgcagtgagctgagatcacgccattgcactccagcctgggcaacagagcaagactctatctcaaaaaataaataaaataataaaatgtttactatctgtccatttacaggaaaagtttgccaacccctattgtaaaagaacctacattgattccaggaatgctactgcactgccttgtcaggtagttctctgttccaggatcaaggtcagggccagcagagtgcctgagaagagaactgcctcctccatggcaaagttcaggagaaccccagcccacacagtgaccaaggctctcccacacagctcacgcaacaacaatggcagagttgagactctgcacccacgggatttcagaacaaaaagcctttatctttccacaaaagcagtgttaccaagagctgcatagcaaccattttccttagcaagcaaactgaggagcaatttctggtctctgaaattcacattgaaaaaaacagcttggatgccgggcttaatacccaggtaatggggttgatctgtgcagcaaaccaccatggcacacttttacctttgtgacaaacctgcacatcctgcacatgtaccctggaacttaaaataaaagttgaaggaaaaaaaagaaaagaaaaaaaaaccctaacaaccatcaaaaagggctagttaagtaaattatcctacacacacacacacacacacacacacacacacacacacacacacacacacagacagagatattagagagagtaaggtgaatttacatgagcaggcatggaaatattaattgagaaaagcaagttgaaagacattattattccattgttgcttaaaatacatttttaggccgggcacagtggctcatgcctgtaatcccagcactttgggaggccaaggtgggtggatcacttggggttaggagtttgagaccagcctggccaacatggcaaaaccctgtctgtactgaaaatacaaaaattagctgggcatagtggcacatgcctggagtcccagccactcgagaagctgaggcaagagaatcacttgaacctgggaggtggaggttgcagtgagctgagatcacgccactgcactccagcctttttcaataatatatatacatataatagacttttttatacatttatacagaaaacgtattatacactacatatgagctaaggaaaataaccaagctgttatatattacatacgcaacagtgcgtggttgggattcagaacttttatatttcatgttatattattttattgtttgaattttattaatatgaattactttgacaataaaaatgttaaaaagtatttaaagggaaaaaatactcatgttgatggacttgcagtttttaagttgggaaatgtagatattgtctgttgccaaacctcatgaaactgcctctcaattgaaggtattaattttctttttaattatattctaggccgggcgcgggggctcacacctgtaatcccagcactttgggaggccaaggaaggtggatcacttgaagtcaggagtttgagaccagcctggccaacatggtgaaaccctgtctctacaaaaaatacaaaaattagccaggcatggtggtacatgcctgtagtcccagctactcaggaggctgaggctggagaatcgcttgaacctgagaagtggagcttgcagtgagcccagatgatgccattgcactccaatctaggcgacagagcaagactgcctcaaaaaaaaaaaagtattttctagttttccaaaatgtttaaataagcatgtgttcattttagaaccagaaattgagctaagacttgacagaatcagtggtaatccatacaatcactatcatgtaaaaatagcaaaacagacacaagcaaaaagactagaaagctctataacaatatcctaatggacattccctctggtttctgggtgctggggctaagcgtggtttttgtgataatttttgcttccttctatttttctatatattccaggtcttctgcaatgagtatcttttaagtttacagcatgcttctcaacattttatcacgaaaaattttcaaacgttcaaaattgaggccgggcgcagtggctcacgccttgtaatcctagcactttgggaagccaaggtgggtggatcacctgaggtcaagagtgcgagaccagcctggccaacatggtgaaactccatctctattaaaaatacaaaaaaaatgagctgggcatggtggagcacgcctgtaatctcagctactcgggaggctgaggcaagagaatcgcttaaactcaggaggcagaggttgcagtgagccaagatcacgccattgtactccagcctgggcgacaagagcgagactgtctcaaaaaacaaaacaaaacaaagttaaaggaagttttttaatgaacgtctgtatacctgccacacagattgtgcaattatgtgactgtatttgcttcatcacaaacatgtccatctattcattccctctgtccagtgtcttttttgttctttgtttttgtttttgtttttgtttttgagacggagtctcgcactgtcgcccaggctggagtgcagtggcgcgatctcggctccctgcaagctccgcctcccgggttcacgccattctcctgcctcagcctcccgagtagctgggactacaggcgcccgccaccatgccgggctaattttttgtatttttagtagagacagcgtttcaccatgttagccaggatggtctcgatctcctgacctcgtgatccacccgcctcagactcccaaggtgctaagattacagacatgagccaccgcgcctggccctttgtttgtttgtttgtttaatttaagaactaacgcactgagggagtcccaagcgatgtcagggcaatgacaacacagccgacccgcgctctgtgctcaagttcacggggttcctgactccaagcctgcagtcttgatccgcagctgtggttctcagacctgagcctgcaccaattacagaagagggggttgctgacatgcaggatcactatagctttttggcaattcccctcttccgccatcaagagcgcggtgtaagcggccaacgacacccctggagaaccccttcaccttgggaggatgcccacctctgctttggagggcctagaaacccatacactggctgagctgtgcgcccggcaccaatctaggcacctgggctctgtgatcagggcgtggagctttttgttcagtaacaggagacaaaaggtttttaaaaaaataccttagtaggccggcgcggtggctcacgcctgtaatcccagcacgctgggaggccgaggcgggtggatcacctgtcaggagttcaagaccagcctcgccaacatggcaaaaccccgtctctactataaaacacacacacacacacacacacacacacacacacacaccttagtaaataagtaaataatctagaatatgagaagagatccgaaaccaacagaaagaaacaaaaagcagagcggagcagggtcgggagctgagcgctggtggggtgggggcacggggtgcaataggaattagagagtcagggagactcccagagcagcgagctggaggcggcctcgcctggaggccggagatgagccttgcagatggctaacacctccggcagggggagcagccgagcaaaggccccagcggggcgcgtgtctgagcaacagcaaggaggccaacgaggccggagtaggcgtgcggggagggcagagggtgggaagcgggggtagaacggagggtccaagaaaagcagccggtccggaaggcaacgcagcacctgacagcgctacacctttgcctctgtcactggcaggggccactgccaagtttagaacccaggagactcaggatccaacttgggttttaaaagggtccctctggctgctccgttgagaagagatgagatgtagggtgcaaggaggaggcgggagcctgctaggaggcaactgcagagaggggggatctgggcatgagtagtaatggatgctggatctcctttgaagctgcagcccaccgactgtgctgatggaatgaggtggggtgtgaaggaaagaggagtcagatgactccaaggtgtctggacagagcaactgggaggcgggatggggctgtttagagacagagtaggctgggggagaaccaggcactcacgctgggcagcgggtatcccaacgagaggcggggacacagcgcacacatcagtatggagctaggggtcatggtttagaatgaggatcatccgtgttccttatgagatcagctcctcctgagagttggaggcaaaagcctggctgaaatgtgtttgagagaatggggacacagtggcatgtgcctgtagtcccagctactcaggaggctgaggctggaggatcacttgagccaagagttcaaggccagcctgggaaacatgtgagaccccatctctaaaatttaaaaaataataataataataataaagaaaagagagagaatgggagaagatgaactggaggtgatgtcaaagagagcacctgagcacctgagatttttgtttcggtcttgaaagatgagggaaacttgtatgtggtagagacataatttaaacccagatctaaggacatccaaatcctacacaccgtgctgcaatcatagaagctggtggggaggaagtagcctttatggagatgtacggagagaggcaagcaggagataaggaggaggcggaaggagagggcaggcagggcaggggcttccactgtggtgagtgggaatctcaaggtgcttttggggtttggtcagaagcagggttcttggggtggagcccaagcctggaattttttttaaagttcccaggtgggccgggcacagtggctcacgcctgtaatcccagcactttgggaggccgaggcaggcagatcacgaggtcaggagatcgagaccatcctggctaacacagtgaaaccccgtctctactaaaaatataaaaaattaggcgtagtggcacgtgcctgtagtcccagctactcgggaggctgaggcaggagaattgcttgaacccgggaggcagaggtcgcagtgagccgagatcgtgccactgcactccagcctgggcgacagagcaagactccatctcaaattaattaattaattaattaaaacaaagttcccaggtgattctactgtgtagcctggagcaaggccacaggagaagggttgtctaaaagggagaggtggggagactgaagagttgggttaagatggcagtcatgcctcatttcacaggtggggaaactggagctaagggaggtaacatcacctgcccagggcagcctgaaagtggcaaccagcctcttcctcacccctgcaaagaaaaagaagacagccccaccctacagcggactttacctctctccaatcaaggtccctccagatgcacccatgcaactctgactcagtccaagacccccggctctggcactgtgcgggaccagggaggacagtgaggatgctttcagaatactttttaacccaagggttgaaacaaaacaaaaagaatgtttttctttcactcaaggctatgcaggaagcattccaatccacctacgtgccatttgtctcatcagagtttgagggtttggggttgtttatgacatatttcaggactacaaaaaatacagaaagtgggataaagagcatgagtgctctgtttttaaatcaagatgaatttaattttcagaaacagcatagcgattacacacttgggggccctgtgttcaaatctgagctctactacttactaactatatagtcttggccaagttacctaattactcctaacctcagtttcctcagctgcaaaatggggataggtacagcacctgatttgtgggattatcctgaggatgaacagagttaatatctaaaaaacactcagtaaatagggcttgataacgtaggagccattcactaactggcagcttttactgccaccgttccccaggatgttgtcattatttttgatttggaaaggtcacagaccgctctcggaccaggtggagacactgtggaggctgtgaaacccagaatgaaacgaattctccatgtcccaaaaccacattctgtggtgagtgtggaaacccctaaactcacccccttcacttctgacgccctggggggaaagcctgtgataaatggaaaggctaaagtccaaggtgggtactgagaaaagacttcccagttgggagttttggtgccaaggttttaggaaaagaaaaacccataagaagctaggtctctattttctgaggctgcattcccagaaacagggcccagcccacctccgggggcctcaactgagcccctctgtactctattgctgtgtgatctccaaggatcacttcacctctctgaacttctctggtaaacagggctaagacccatctggcagggtttgtgtaaagaatcattgaaataatggaagtgaaagctgtaaaagcacttatgcctacgagagggttgagaccccatgccgcacgcaggctgggtgaggacagggaggagaaggaggcctggctgcccagattcccagcctcgggcagagagagaaggaggaggagggatgaacagcagctggcctgacacattacactttcccttattgccaccctgtgcccaggcctcttagcaagtgggggaaagatactggcagctctggcaggcaccaggcccagcctcagcagcccaaaggtcataaacatcctggaaaaggaagcaaaactcatccaccctcccagactttgaccaccaggcccaggcctattctcctacagggcaaacctcaccttctggtgagtcagaactgcccctctactcacccccaccactaccaccaagcactactgggggttttcacctgttacctggaatccttataagagccccatgttaccaatcgggaaactgagctcagagatgggaattaacttccctaaggtctcggagctccccgaaaagtagcaccaggattccgcagcagatctgcctgagcttaaaggtgaggttcttcccaccacaccaagtaattcactccaaggtactgacgttcaacaactgtgctcccatggcaaaactggcctctgcctcaccgcactctcggcctgaaatgcccttttgccgttcacctggaagattcctactcatccctcgagatgggctcaacatgtccactcctcaatgcatcccctgatgcctcagcaaagcgagttgctgctgcctccacagccaagccatagccctattattggatgattcattgttaagcctagcctgtgggaagaagcgatcaatttccttgcccagcctgccagcattccaaggaccagaattccgtctaattcaccattatccagcctggcactgacaatgttctcagcagaggtgtatggtggagggatgcacggcttcctcctccagcccctctcagcccgtggctgaatagggatgaaaccctggaaggcctgaagccccaactgctatttaagaagggtcctcttctcttcttctctcccctcccctttgcaccttaactagttccacacagatccatcagaaaatcaagcaaactcagatcacagagcagtcaatgacggagtctagactcagagaacagggaaggcctatcaatttcctcatattatggagcctcagtttcactttggggtttcatttccttggcagcagctgctcaacaagccacagattcaaggatggcgcaggtggaggagggaagggaaaggctccccgcccactcattctagcaaatttggaacacagagaggagagaaataatcacagcaggaggcatcacaggctgaactaaagggctcaggaaactgtggacacaccctcttcgatcccccaggaggctcctgggggcggctacaacaactaacataaaagccgcaaaagcccacagtggggaggcaggatgtccttccccactgtagacaaataggagcaagattgctgtagaggatagttttgtttggagttttttgttttattgtgttttgtttttttctgcaggctctcgctctgtcacccaggctggagtgcactggcgcaatctcggctcactgcagcctcgacctcccgggctcaagtgatctaccaccttggcctctcgaagtgctgcaattacagacatgaaccacacgtctggcccaaagggaattttaaaacaataataaaacctatcaaaagtcggtctgccttttattactaccatgtgctggccattttaaacaatgtcagtgataaaataccactcccccaaaaaatgtcttattcacctaaattctaattgctgcagttaccattgagatttaatcatatacatgtgagccaccaattagcacatttttatttcttatccttctaaaacttttgtcttctacaagttaaatcagagaacacgcagttatcagttcctgaaacacacagactcagccataagttctgtttcaacaatcagttcctaaaggctcagaataatttgaactccatttatacagtttatgtagccaatctctgtggtcctgcattttcctgtgtttaaacataaaacagcctgtctcccagtgccaaaagaaactaaaagaatgatgtttgaaagcctgggtgattttcatcatttctaaagcaatggattaaataaatgtcaaggttcactatcactcagccattttctctgatttttgcagaagaaaaacttggggaattttgccaaatataattgaaatgtatgatgggccgggcgcggtggctcacgcctgtaatcccagcactttgggaggccgaggcgggcacatcacctgaggtcaggggttcgagaccaacctgaccaacatggagaaaccctgtctctactaaaaatacaaaattagccaggcgcggtggcgcatgcctgtaatcccagctacttgggaggctgaagcaggagactcgcttgaacccaggaggcggaggttgcagcgagccgagatcacgccattgcactccagcctggacaacaagagtgaaactccatctcaaaaaaaaaaagtatgatgaactgtctggtgaagattttgttgttgttttgtttttagagatggggtcttgctatattacccagggtagtttcaaactcctaggctcaagtgatcctcccaccttggcctccccaagtgctggaattacagtaatgaatcactgcacccagcctgtcttagtgaaaatgtctctaaaaaggagatatttaagctgtagaactgattaaagaaaaaaagatttaggcagtattgcaatgtctggaatttattatgaaatgggatttttataaatctctgccaaactaatcctgatggttaaggcttttcctttgtctctctagttttatatgaaagcagcttttgaaattaaaattaataaaaagtgttcttcaatcaactgggagcaaagatggactagtagatatagctcccctgaatactgaccatgaatatgcaaagattgattttgacaatgtcatggacaacttttcagaagtttcaaaaacagaagttgtagtgttactattattcatctctgataccatcctacatctaagtttttccttttttcaaaaatacattaatgtgattaaaacctactaatccattttttttcctgcttttgcactcacatttactttttcatttttaatttttttactctcatgattacatatataaggtttttactgtcatgattacatatacgaggttcaataaaagaaaatgctcactgtgtttctttctggacattattactattcattgcatgattattgctaaaaataatgttatcagatagagaatgatattaaaaagtgaccactccaggtgtcaaacaaacatgccagatacaccctgacaccaggcaaaactctttatatggactgagataataacaacagtgaattatggttgagcactcaaaatgtgtgctaggcattgttctgggcactttctgagtattaagtgatataatcttcactctgcggcagggctcggtggctcacgcctgtaatcccagcactttgcgagaccgaggcgggcggagcacgaggtcaggaagtcgagaccatcctggctaacacggtgaaaccccgtctccactaaaaatacaaaaaattagccaggcgtagtggcgggcgcctgtactcccagctactcggtaggctgaggcaggagaatcgcttgaacccgagaggcggaggtcgcagtgagccgagatcatgccactgcactccagcctgggtgacagagcgagactccgtctcaaaaaataaaaataaaaataaaaataaataaataaaacaaaaccttcactctgggaaacagtggatttgaacttgatgagagtctcacaaccagatgctcaacactaggagggtccacctccaaatcccatcctctgaatccctctgctgcggtccggccaggcggaaggggggcagtcgccaagcacagttaacgctgggactccgctggcagggctggtcatgggatgagtcagctgacatagcccccaaggcctgtcccgctgtccgggtgtggctccggagggcagcgccagatttctgcggacagacctgccctggccacctccctcctgagggtcccgccttccgctgggcgcgtttcaggcagggcgcccccacaccggcccccggaaggacgcgccgagacaactcccaacaggtgcgcgccgacccgcagctgacaccgatgcctcgcagctgacagaggtgcgggccccacatcctcgaggctcctctctcggaagcagtaattcaggctccgagacaacgagtccccactaacagggggctcccagccccgcccagccccgcctcgccccgcacttacaatgggcgcacgcatcttccctcgcggtgtggaccctcaaggccaggctcgatttcgctgcgtagatgtctgaggcagggggagcagggatttattgtcattaacaggaaactgcgtctccagaccccacgggactgcggcttctgttgggcagggcgtgagaggcgcgcctcggaccccaggaacaaccacctcgctccctttaacaactttctcgccggggcccggcgggcgcccaggaggctgcaggtgccagcgggcggctcggcaggctagtctacacccgccctacccaattagatctcttcctcgcggaaggggagaagcatcccaggcacctcgcccggccttatcgcacccttccaggaagacccgatccacccacctcgcggtctcggaggcagcgctgcagccccagcaattggaccgggtctaatggccgcggtggccgggccggcgtgaggtcacccggcccctccccgcgccgccggctaatgagagcctcgcagagcgcccggccccggtcccgagcccggcgactgcaggacgcccgcgcccccggcaccgcctcttcccgcctcacccatgccctgcgcgcccagcatccaggagtcgcacacactcgacctctgcacacacatcacactgcagggccatgatgggtttactttcgccttcactcaagaatgggcttatagtttaaaaactgaaggagttaaaaatataccaccaagggccgggcgcggtggctcacgcctgtaatctcagcactttgggaggccgaggcgggcagatcacgaggtcaagagatcgagaccatgctggctaacacgatgaaaccccgtctctactaaaaatgcaaaaaattagccgggcgtggaggcatgcgcctgtagtcccagctactcgggaggctgaggcaggagaatcacttgagcccgggaggtgggggttgcagtgagccaagatcgcgccactgcactctagcctgtgcaacaaagcgaaactcagtctcaaaatatatatatgtgtgtatatatatgtatatatatgtgtatatatatgtgtgtatatatgtgtgtatatatgtgtatatatgtgtatatatgtgtgtatatatgtgtgtatatatgtatatgtgtatatgtgtgtatatatgtgtatatatgtgtgtatatgtgtgtatatatatgtgtgtatatatgtgtgtatatatatgtgtatatatgtgtatatatgtgtatatatgtgtgtgtatatatatgtgtgtatatatgtgtatatatgtgtatatatatgtgtgtatatatgtgtgtatatatgtgtgtatatatgtgtgtatatatgtgtgtatatatatgtgtgcatatatatgtgtgtatatatatgtgtatatatgtgtgtatatgtgtgtgtgtgtgtgtgtgtgtgtatatacacaccaccatggcatattggctgttttgaattaaaggcatttaaaactcagcaggtgcaagaagaccccttttctgtgtcttaaaagcagatgaaatttccatgttgaaggacaccttccttatactagaagaaaaagcaacatccttatcctcaaagaggagatgttgagacggaaagaattctgtacagaccttgttgaaataacttttttcattttttactttttggggttttttgtttttttttttttgagacagtctcactctgtcacccaggctggagtgcagtggctctatctcagctcactgcaacctctgccttccgggcaagcgattctcctgcctcagcctccggagtagttgggattacagacgtgcaccaccgcgcccagctaatttttgtatttttagtagagacagggtttcagcatgttgaccatgctggtcacgaactcctggccccaaatgacccacctgcctcagcctccgaaagggctgggattacaggcgtgagccaccactcggcccattttttactttttaattgacaaaaattgccacgtatttgtcatgtacaacatgttgttttgaaatatgtatacattgtggaataactaaatcgagctaattaacatatgcattacctcacatacttcttttgtggtgagaacacaaaacctctccgtaattttcaagaacatagtacattgttatttactataatcaccatgttgtgcaatagatctggtgaacttattcctctattcctcctaacagaaattttgtaccctttgaccaacatctccctgacacccccctgttccccccaaccgccgtaactgccattctactccctactcgtgggttccatttttttagattccatatataagtgagatcacaaagtatgtgtctttctgtgcctggcttatttcactgaacgtaatgttctccaggaaaataactgttatctggtaagcctccccacataatttagttgcatctttttaatttttatttttatttaaatagagacaaggtctcaaactcctggactcaagtgatcctccctccttggcctcccaaagtgctgagattacaggcgtgagctaccgggccccgctcttagttgcttcattacaacttactattctttgtccaattcggtgtagaagtaactgacaccaactacttctttgggtcttcatttccttatgagggctcctgtgttgcaggacgcagaggagtagagagaccagtataggccgggcgcggtggctcacgcccgtaatcccaggactttgggaggccgaggcgggtggatcacgaggtcaggagatcgagaccatcctggctaacacagtgaaaccccgtctctactaaaaatacaaaaaattagccgggcgaggtggcgggtgcctgtagtcccagctactcgggaggctgaggcaagagaatggcgtgaaccccggggggcggagcctgcagtgagccgagatcgcgccactgcacttcagcctgggcgacagcgagactctgtctaaaaaaaaaaaaaaaggagagaccagtataggtgaatacaggaggatatttattttaaggtgcacaccagctcagtgggttcacatccaaaaaactgagccttgaacaaagaccaagcaggatttttataagcaaatttacagaagcagcaaagcaaaggcagttaatcatataatgacaggtcacataatctatagcataactgatgacatggcataacttgtggccttgcatagctggtggccttgtagctgcattgaaagtaaaaacaagaactggctaaatttcttttagccagatattttgtccttttttttttttctttcacctttactccggaggtggggcatctggagcctattcctttggttttgacttctcaaacagcattatcttataactgtccttgaagtgagcttgctaggcagaggaaaacttgctcttcttttctttttaaccattgccttgccacattctgggctttggcttttacttttcttggagtgaatgaatgcagtacttattattatttttaaatttctgcctcacctatgccagtaaaacttgtattaaagaaatgtgtatgcttttctcctgttaatcttttttatttttttgagacagggtgatatggtttggatctgtgtccccacccaaatctgttgtcaaattgtaatccccaatgttggaggtggggcctagtgggaggtgactggatcacaggggcgaatttccccctcagtgctgctctctgatagtgagttaatgcttgggagatctggttgtttaaaagtgtgtagcacctctcccctttctccctttctcttgctctggccatgtgaggtgctcactcccctttttccttctgccatgactgaaatgtcctgaagcctcccccaggcttcctgtacagcctgcggaaccatgaaccaattaaacctcttttttttttcttttttgagagggagtttccctctgtcacccaggctggagtgcagtggcgcaatctcagctcattgcaacctctgcctcccgggttcaagcaattctcctgcttcagcttcccgagtagctgggactacaggcatgtgccaccatatccagctaatttttctatttttagtaaagacggggttttgccatgttggctaggctgatctcaaactcctgacctcaggtgatccgcccacttcggcctcccaaagtgctgggattacaggtgtgaacgaccgcaaccgacttaacctcttttcattataaattactgagtctcaggtatttatttatagcagtgcaataacacagtgtctcgctctgtcacccagggtgaagtcagtgatgagatcatagctcaccactatggccttgacctcctgcactcaagtgattctcccaccttagcctcccaagtagctgggatgacaggtgcccactgcacaactggctaatttctttttttatttaagcagcagtgttttactatgtcacccagcctcgtctgcaactctggggtcaagtaatcatcccgcctcagcttctcaaaatgctgggattccaggtgtgagccaccacacctggccctgttgatctatcttatgtcaatgtagttcttaggcccagctgagaccctaagaggatggaggtggggctcacaaaactgtattaaatttaaagctattcaaaggcaaggatctagcagaaagtgcttttaactattgggtcttaatgtcatcacatatccccaaatccttgcacaaaacctagcacatcggctgggcatggtggctcacacctggaatcccagcactttgggaagccgaggcaggcagatcacttgagcgcaggaaatcgagactagcctggccaacacagtgaaaccatatctctactaaaaatataaaaattagccactcatggtgctgggcacctgtaatcccatccccgctactcaggaagctgaggcaggagaatcatttgaacctgggaggcagaggtcgcggtgagctgagattgcaccactgcactccagcctgggccacacagcgagactccatctcaaaaaaaaaaacctagcacaccataggcattccatgaatgaaagcatgaatgaagaatgaatgaccaacacaggctctttctctgcactgggatatgacttcacacgagtagaaccagctcttgttcatctctgtattcctaccactccagtgccagtactgagccttgcagtcaggatgtccggaccaaatcctgaccctgccacttactataatagttgtagggcccaggccatgttttcttctctgaactgtttgtctgtaaaatagggccttagtgatattgtataatgtttaagaatacattccctggcagggcgcagtggctcacgcctgcaatcccagcactttgggaggctgaggcgggaggatcacgaggtcaagagatcgagactatcctggccaacatggtgaaactccatctctactaaaaataggaaattagccgggtgtggtggcacacacctgtagtcccagctacttgagaggctgaggcaggagaatcgcttgaacccgggagatggaggttgcagtgagccgagatatgccactgcactccagcctgggcaacagagtgagactctgtctcaaaataaaaaaatgtaaaaaaaaaaatacattccccaaagacagagcaacaaatgaaatgatgcttataaagtgctgagccctcagatcacgaggtcaggagattgagaccatcctggctaacatggtgaaaccccgtctctactaaaaatacaaaaaattagcttggaatggtagcagcgcctgtagtcccagctacttgggaggctgaggcagaatggtgtgaacccggaaggcggagcttgcagtgagctgagatcgtgccactgcactccagcctgggtgacagagggagactccgtctcaaaaaataaaataaaataaaataaaataaaaataaagtgctgagcctgacgtctggcacgtggtaaatcctcacacaacacacggtggctgttattaacatgagaataggtatgtgcccatcaacatcacatgatcttcaccagctttctgacaaggagactcagaggcaatataaataccatagctttatgtgccttatcactcatcaaacaaattacggagcaccctgagccagggactgactataaggtcatccaaacccaggatggacaggttcggttttgaggcagccgggctgacttctgcctttcctcaccctctgcttccagaagcacccagatgtcacctcccttatcttttcctgttgctgtgccagaaaaaaagcaaaacaaaaccaaaaaaaaatcatactgggaagggggaacagtactgagggctatgtattttcacttctcacacagttctcaaaagaggagctctctaagaaaggccccgggacttactgagaaactgccccatgatgccacaccatcaccaacaagacggtccttaccccccgcacagagcaggtggacaggtggactgtgatgccaggatccaactagtgtccacctccaaagcttccaggcttttctgcatagcatggctatgaagccccattcctcttgtgataaggaggaaactattaatttttttttttttttgagacggagtcttgctatgtctcccagactagagtgttggagtgcagtggcatgatctcagctcactgcaacctgcgcctcccaggttcaagcgattctcctgcctcagtctcccaagtagctgggattacaggcccacgctaccacgcctaatttttgtatttttagtacagacagggttttatcattttggccaggctggtctcgaattcctgaactcagatgatctgcctgcctcagcctcccaaagtgctgggattacaggcatgagccaccatgcctggccagtttttaagtatttgtaatctctccattctctgccttctaaggaggatagatggatcctccagaatccattgttttgctgactctctgaggaggaatagctgagcaggtgggagaaaattgcacaggctaatttgctttgcaggcctaataggcccaatggggaatctgagcaagctgggtgacacacaggaaggccagggcaggagaaagaaagggtgcaagggtgacgagagaaagtgaacagggaaactgcattttgtttttttttttttttttttagggaaactgcatttaaagggaagctgtttgcaatgcttctttgcacacaaggaacagaatccacaaagttcacaacaaggaacagaaaccacaaatttcacaacatgacaacattcaaaatgggagtatgtctcaagtgctccaccagccagctgaatgcagggttttcacaggtgtaaaacatgtgactatgccaattttgatagtttcctctgaccagaaaaatcaggcttttatgaaagaaaccaaaagtgaagtataacttccttctgaatcccctttgaaacccaagtcctactgaagaggaaagagaacaaatccctattgaaatgccctgaagagcttccactgcctaaatgtgcagcataaccatctctaccttctctttaaaaaaaacattctagaggctgggcacggtggctcacgcctgtaatcccagcactttgggaggctgaggcgggcggatcacaaggtcaggagttcgagaccagcctgaccaacacggtgaaaccccatctctactaaaaatacaaaaattagcatggtggtgcgtgcctgtaattccagctactcaggaggctgaggcaagagaatcgcttgaacccgggaggcataggttgcagtgagccgagattgagccactgcactccagcctaggcacagagcgagactctgtctcaaaaaaaataagataaaaataaaaataaaacattccagaaggccaggactggtggctcacgcctgtaatcccagcacgttgggaggccaaggtgggtggatcacatgaggtcaggagttcaagaccagcctggccaacatggcgaaatcccgcctctaccaaaaatacaaaaattaactgggcatggcagcgggcgcctgtaatcccagctactcaggagactgaagcaggagaatcgcttgaacccgggaggcggaggttacaatgagccaagattgcaccactgcactccagccttgacgacagagcaagactcagtctcagagaaacaaacaacaacaacaaaaaaattccagaacctttaacctgggaaatgtccaggttttgtgtctcttgttgttcaatggccattgttaactggaattggttatctgtaatggattatttgttttggtctgcccagcagtctttcatttggtgactccatgtggttctggtggagctgtcagtcatagcacgtggtcatcactctgactacagacacctgcaccctaggtctggctggttataatgcctcagaggccaggctagtgttgaccatggaaggagcatgactcaagccaaacaaatcagaagccttctctggaatggagatatacacacgtgttttttcataggtagctcaaaaaaaaaaaaagcctgtttcctcagggcacattaaagtgggatgacataaacctggaaccactggtgcctgtcctcccctggggcatggaggaaacctatctgcaacagcagataaataggtcactgaacactgaaataagagccctgttgacatttgagttcctccagtgcctgatgtcagctttacccctatatgtccgattacaagaaactttttcccagttaacaattttttccttctttaagctaattagagttggacttgtcttttgcaaagtgatatatgataatcaaaagcaagaatgtcaatgcgccaaagacaagccagcttgcttgactgctccccatctatacaggaccgcattcgtcaccctggtccttccttctccccagtttatgctgagagcgtctacacatcagtgtagatggtggcacccaagtcctgaatctttgttttcaccatactcttcacatcatcagcctctgagtttgccccttccctgctaaactgtgatgaactcaagggcagcacctggcaaagcacctgacacatggtaacaaccagggatggatggttggatagagaaagtctgctgatcccacccagtgtttccaacttgggaagaaatctttttactgtagggctaaatggggtatgtctagctatttgtcgtatttgagaagttcaattcaatctcctcactgtgtccatcagtgaaagagaaagctttaagtagagatttacgttccctgcccccacccctgaagagcaactgtttaatcagctggctccagatggggcaactaaatgaaagtgctacaaattcagaggtcttcacaagtccatgttactgtaaatgaaatttgcgtaattttttttgagagacagggtcttgctgttgcccaggctgcagtacagtgatgggaccgtaattcactgctgcctccaactcctgggctcaagtgatcatcctgcctcagcctccagagcagctaggactacaggtgcgcaccgtcatgcctgggtttgttttttgttttttccagagacggggtggaaggtgtctccatatgttgcccaagctggtctcaaaactcttgggctcaagtgatcatcctgcctcagcctcccgagtagctaggactacaggtgggtgccactatgcacttttattttgtagagacagaggtggaaagtgtctccatatgttgcccaagctggtctcaaattcctgggctcaagcatttctcccacctcagcctcccaaagtgctgattacaggagtgagccacgacacctggcccttgtgctcacttttaagcaaccctgccaacaatagagccttctccaggactatgctagtaagacacttgttcagtgtcgttttgtaggacagagaaagctaactcaaaccacattgccactatcccgtcagaagtcttattcactttgccaagccaaactatttcacagaacctcccatattaaaaacacagagaaagaaaacacagataacatggtgttgtgatctttattccattaaatgatcttacaaattggagtaaaacagaaacatgcttttaatatactaatagcataatctcatcccattgcactttttaaaaactatattaagtttcaaagccactcaaaggcaagggtctagcagacagtacttttaacaaatcattttttaaaataaaaaaacctgaggaaaatttgtgtatgtacaagattagtattaactcctttaaggcttacatccatgacagcatgtatctaattagaaagctatgggaatcaatgctaccttcccttgctcataaaaacatttaaactgtagttctggcacacgaaatttgccccaaagaaaaatgtctttcaaagcccttctgtccctagatctgttttgcaaagtttctgatatggggtacttaggtcactaatgacaggaattaggatcttgtcttctttcttgttcattatttttatttgtggcttaatgtttcacctgtatgtgaaagatttgggggttcaagtcacagtgctgaattttactttttaaaagaaaaactatcaaaaattgcttttaaaaaatcctaattacattagaaaataggatacctgtacattcatttttcagagaaggcactatgacaatggagaaaaacagctttaaagagcttagataatcctctgaattaaaggcattcttactacttctgaacacagaaaacgcctggggattgtactggcaagagaccacctattctaaacctcaggtacaaagtgtccacttgcctccagacaatactgaattgtactttctccttggtacttcccattcgatgaagcagtctctctctgtggtctctgaaccactatttataaaagtgatgactccaggaccacagcccataccacctgaggcaatccctgggtacaaagctaggaatctgaactttttaaacaagcctgctaggtaagtcttatgcactccaaggtagatgagaaccactaccctaaacatagctacaacaggacttacagcaagaaaaaccatttgactgcaaatattattttacaatgggcttcttaatgtcatttttaaaaattaatcacacaaatagtttgtactttcataactgaagcttgtcttcattatgcccttatcccttgactagaattttgttaaataaaacatatgtaagccagaatgacacagccatgttgacaacttgagatggaagatcaaatcatcctaaattacatttcaatagttccaggaaagaaaaaagtcctgtgaagacttccatgtaagttacatcattttttaaaagaacctagcaaaaaattaaaaactgttttattaaagttttaatttttaaaaaattaaaaaattaaaactgttttattgcttttgcatggacttgattcaatctacttaattttgctataactcatacatacatacatacttatccaaactcaccctatccaaggcaccattttacaagccaagtagaacactgtgtgtgatccactaatgaaaccaaccaccagtacaaggcagtatttttgtgtgtttgaccaaagcgctttacttcatgtaagagaaaaaataaagcaaaacaaggccaggttccagtggctcacgcctgtaatcccagcaccctggaaggccaagacaggcggattcccagaggagttgagaccagcctggtcaacatggcgaagccctgtctctactaaaaatacaaaaataagccgggtgtggtggcacatgcctgtaatccctgctacttgggaggctgaggcaaaagaatcacttgaacccaggaggcggaggttgtagtgagccaagattgcgccactgcacttcagcctgggtgacagtacaagagtccgtctcaaaaaaaaaaaggaataaagcgaaacacaggcaattttaccaagtataaaagaggtgttaaaacgtaaacttccatagaacatttcttggtatactacgaaaataaggcatgactcagctgggcggggtggctcatgcctgtaatcccagcactttgggaggctggggggagtggatcacctgaggtcaggagtttgagaccagcctggccaacatggcaaaaccccacctctagtaaaaaaacaaaaattagccaggcgtggtggtgtacacctgtagtcccagctactcaggaagctgagacaggagaatcgcttgaacctgggaggtggaggttgcagtgagcgagattgcaccactgcactccaacctgggcgacagagcgagacctctgtctcaaaaaataaaataaaataaaacaaggcatgactctgaaggtgttttatcatacatagtagtttgtctcattttatctatgagccaatcttacagaaagatttctcaaagaatgaaaactctgattctaccatttttactataagcagctcattgaaattattttttcaaattatcaacacttaatttatcctgaaatattttaatagaaaattttggaagcctccttttatatattcataggaatgagttccatatattgttaggattgtgtaaaattaaaaatgcctgcatggaaagcggcagagcaacagacacgacgcaaacaggcacagtctgagcatctgaaccacaagtaaaaggtgagagaagtaaaagatattatttttaacctggttataaatctccccaggatgatttatagccagtaatgataatgcatcttttattgaaaaagctgatataaaatcatcaatttactgttgagagaaaagaggccaaagaaaactcttaagaaccctcactgagaaaactttataaaacactttccagaagcagaactaagaaaaaaaaaaaatggtgaagaggacttcctctggataattaaaccaaggtctctttataagaccaaaacagaaatggtgaatttaaatagtaactgaatcttaagatttcattaaatcatacattatcactttttttaaagtgacctaatactttagtatgagttttcgacacatcaccccttcttaccattaaattttttaagttattctgaaatctataaatttacttatagaatgtattaaaagctaagtatgtcaatatttacagagcctgctaataggtatgaactttcagagagataagaggtcacctgaaaatgcaccaacatttcagaagcaagctttcaagttaacagtcaaagcttggttggcatcactgataaatgcaagtaaacaagctggaatttttctaaagtgtaacagcagtgaataaaatagcaagaactatttgcaagatggcatataaatatgaaacaatatgctgcgaatttaggacttacaaaaatacttcagtggtaaagtgtcaaaagaaaattctttgataaagagattacatgcgaaaagggactttttttctaccttccattcatacttcatgtatgtaaagtttacactcagatcttaccttcatgtatataaaatttacactcttacctccctcccataacaaaagttaaattatcttagaaattaaggcttatatacctgaatgtttatataaatacttgcaggcaagttttaagttttaaaatccacaataattccaaaaggaaaagcaactaacagataaaacttttatctcctaatcaaggtaaatagaaaaaaagaactcttagatacttctagatattttttatatttgggtaggactttgatccttgctaaggcaaagctatcttaaagctaccagactagccaaagtaaaattaaatagataattcactaaataaaatgggttaattttagcttcattattaagaacattagacacggcagagaatgcaaattaacattctgaataaagaccttaaatcaggttattaattgctgctaagccacatgaaattagacatcaattaaacgcagtaatatttgtatcttccctctaatccttaataaagttctgttcttatgcagaactctcaaaaacaaaacccctcaaatgacaattacaagagttgtgtaaaacatacatacatatgtaaacctacagtgaacctgaccaaggcacaagttcaagtgacttatcagaggtcacatggttcatttaaacttagcttttttcttgaagtatctagcgcattccttttattatgagccactctggcttttcaaggcacgtttgcctctttttctagaaagaagctatagggaccaaaaaaaaaaaaaaaatagagcaagttgcaacaaaactgtcagcctactgggtaaaaacctcacatttcagagtatggtatatttaaatatgacatgatttttccacactatgtggcaacaggattccctattgtaaattttttttgagtgtaatgacatcattttcagttagtctttagttctgaagtttctccaagttctgtaaacttttaaaaaaggaatccttcttggccgggcacggtggctcacgcctgtaatcccagcactttgggaggccaaggcgggcaggcggatcacaaggtcaagagaccaagaccatcctggccaacatggtgaaaccccatctctactaaaaatacaaaaaaattagctgggtatggtggcgtacacctgtagtcccagctacttgggaggctgaggcaggagaactgcttgaacccggcaggcagaggttgcagtgagccaagatcacaccactgcactcaagcctggtgacagagcgagactccaactcaaaaaaaaaaaaaaaaaaaaaaagaatccttctcaaaagagtaaagtataaaagaaatgtcaagtttcacccgaaaacggcacctttcatgaggttatcctccatcccctccccatcgtgtgtgcaaaaccatggaatcaatcttaaaaggcactaagtggcacataaagaacttaaaagctgcatttccatttttcctctagcttcctcctccataaagtgcacaaagcagagtaatatgaaaatagacacaggcttgcatctataacagcaaggaaaagaaatgcttccaagagaaatggaagtgtgtttaataatttgaaaccacaggagaggtctgctcatttattacagggccatgttttagctcttcctggatcgtctcagatctgccattcctctggatatgaacctgtggccgtggcagaaacccagaaatcagtaggggcttgttgtgttcttgtttgatcttcacgttaagatgctattgagcttttttatccatggatggtcttccaacaactgcatccctcacagtggcctgagtggaattaccgatatgagaagaagcctgcaaaagtccatttattcaacatataagttaataaaatacaacacagcaacaagaaagtaagtccttaaactttcaaaaacctgtctccatcatcggcatgttacagaaagcagttgaatgaaaatgcagggatacagagaggctgtggcagcagctaactcccaagagagccaggggaacatctgctctgtggctagggtaggataggcagctcctgtggcttcacaagctgctaacccaactcacctgttcatgttactcagaaaaacaaatgtatcatctcaaagatctacaaaacttgtgaccatgtcaatgtccaagagctactgggttagtcaggtgtggtggcactcgcctgtaacaccggctgcttgggaggctgaggtgggaggatcacttgagcccaggagttttaagttacaatgagctaagataccagcctgggtgacaaagcaagacctcgtctccaaaaaaaattttataaataaataaataagcaacccaataaataaataaccaagccactggcttttggaagatttttaaataaaaaagataccatccctttcctaatccagtaggactcaaaaccgaacatttttcgttaagttcataattttttcaaagttcttgcttttcaatgaagtaaattaatctagagggggtgagaagtgagaatcacataaaaattatgtctgaagagcatgtaattagaagttgccgaccaggcgcaatagctcatgcctataatcctagcactttgggaggccgaggtgggtggatcacctgaggtcaggagttcaagaccagcctagctaacatggcaaaacactgtctctactaaaaaaaaaaaaaaaaatacagaaattaactgggcatggtgtcaggcacctataatcccagctactcttgggaggctgaggcaagagaatcacttgaacccagtgggcagaggttgcagtgagccaagatcacaccacttcactccagcctgggcaaaagcgtaaaaatctgtctcaaaaaaaaaaaaaaaaaaaaaagttgccaaaggggaacacaatcagtatgtctaagttggaatgtttttgcattaaagggctatttttgggctgggcacggtggctcacacctgtaatcccagcactttgggaggccgaggcaggcggaccatgaggtcaggagttcgagaccagcctggtcaacatggtgaaaccctgtctctattaaaaatacaaaaactagcgggccgtggtggcacacacctgtagtctcagctacttgggaggctgacgcaagagaatcacttgaacctgggaggcggaggttgcagtgagccaagatcatgccactggactccagcctgggcaagagagcacagcgagactttgtctcaaaaaaaaaaaaaaaaagcggggcgggggcctttttagacatggaaacaaaatattaagaataaatattaatatcctaaaggataataaaacatacagtctatcagaaaacaacagccaacggagtggccactgtctcatgtcttcactatgaaattcttccaaactgagatattttacaacagaagcacaaatatctgcccattatcaaccctcaggctcttcagcagcaccacttacctgctccaacacatatgcggcaccaaaatcaatagctccgcccagctcacgatattgaccagaatacctgatgtagccccaggtgaggagtgctattaacagtagtccaaccatacagttgaacaactgggctacaacctcaagacctatgaagccagtgaggcctgaggctatgtacaaagctacaatgcccgtgaacagcactgcaggggttcggaaggtgctgaagacgttcttgctaccattgtgcttgcagaagttctcatataattccttgatttcctcctccagctcctgctggtaacgaaagctgaaatccttcccacccatcttcttggtcttcttaaaatggtccagagcaagttgtttgaattcacagtgcttctcctctagaatgtctggagacaaataaggtttctctcccccacaaacctaaaaagaacaaagaaacaatatgttaaaagatctcttcaaaaacaagtgccaaataaaacatgaaaagataatgaaaggattagaatgttttaagatgttaacaatgtattaataagttaacttttaaaagatgactaagaccaataaagtctagtttcacttcctctgaaaagcacacttaaaaaaccagggtgataatatcaattggaaagagcagtgacactgggacgggtgcggtggctcacgcctgtaatcccagcactttcggaggccagggcgggcagatcacttgaggtcaggagtttgaaatcagcctggtaaacatggtgaaactccgtctctactaacacaaaaaaaattagccgggcgtgatggcaggcacctgtaatcccagctactcagaaggctgaggcaggagaaccgcttgaacccgggaggcggaggttgcagtgagccgagatcgcaccactgcactccagcctgggcgacagagtgagactccgtctctaaaaaacaaaagcaaacggtcgacttctgcagggcccaggtgagaaaggcccacctgtgtcctggttgagggtcctcagggttctttgggacccgaggattcctgaaatcatggatcacccacatacgctttgagacatgctttaattttttttttctggaagccctgcgacttccctaaaaattaaatgaattatagaacagatctatgaccaatggtggcagagtctacatagaactatgcttcgtggtgctctggggaaaccttctgacttgttggctatgctattcagtatggctgtatagctcactgtgcttctgaatacgttggtggtgttgtcatgtgttctggaccatcaatggagcctacaattcaaaattcagatactgtctttgcacaaaatcttagtcgacattttgatagtatccaaagaggtgacattgtgattgcaaaaagcccaagtgatccaacatcaaatatttgtaaaagagtaactggtttggaaggagacaaaatcctcaccactagtccatcagatttctttaaaagctacagttatgtcccagtgggtcatgtttggttagaaggtgataaatctacagaattctacagattccagttactatggacctattccatatgaactaataagaggacgaatcttcttttaagattcggcctctgagtgattttggatttttatgtgccagccttaatggccacagattttctgatgattagtaagcatttattcttttgacttgattattgtctcctgctcatgtgaatttattactcccattgaaactatgtacttaccaataaactatttgctattcaaaacaaaacaaaacaaaacaagaacaaacaaacaaacaaagaaatggtaataattagaaggcccccgttaccaggacaacctgaatataagtttattgcctcatcacttaaagatacattaagtaggatcaagttgggcttttgaagtcagcaacaatgcccagattatagatatttcagaataaggcgtatgtcccacgtacctcttccatgttgttataataaatgtccttggcagaggctgcagctgctaagttgttggcttcagcagtggccttttaagagagaaaaacgtgaactgtaaatccttcctcttttaacattcctccacaaataacctaacaaaaatcttctctattccccattcttccttttttattaaccttctatttttctagatttccatatagttcaactgatgaaatagaatacactttttctgccaaattttctaccaaaaaaaggtagaagttcatatacatagaaatatgtattcttatacataagaatctttagcaaaaattaaatctccaaaattcaaggaaaatattatttccattgcatcaatttattttttaattgtttaaatttttctttttttttaagacagagcctcactctgtcacccaggctggagttcagtggtaatctcagcacactacaaccttcgcctcctgaatgcaagccatcctcctgccagtgcgtgccaccacgcttggctaactttttaagtttttgttttgcagagctagagtctccctatattgcccaagctgatgttgaactcccaggctcaagtgatctgcccacctcagcctcccaaagtgctgggattacaggagtaagccaccacacctggctccattgctccaactttaagaaatagatgtgagtcaaaaaaaaaaaaaaaagaagaaggaaaggttgggcgtggtggctcacgcctgtaatcccagcactttggcactttgggaggccgaggctggcggatcataaggtcaggagttcaagaccagcctggccaacatgttgaaaccccatctctaccaaaaacacaaaaaaattagccaggcgtggtgatgtgcgcctgtagtcccagctactcaggaggctgaggcaggagaactacttgaacccaggaggtagaggttgcagtgagccgagatcacgccactgcactccagcctgagcaatagagcaagactctgtctcaaacaaaaaaaaaaaaaaaaaaaaggaaaaagccgggtgtggtggcttacgcctgtaatcccagcactttgagaggctgaggtgggaggatcacttgagtccaagaattcaacaccagcctgctcaacacagctagatcctgtttctatttaaaaaaaaaaaaaaaaaagaagaagaagaaaaaaaagggggctgggcgcggtgactcacgcctgtaatcccagcactttgggaggctgaggcgggcagatcacgaggtcaggagatcgagatcatcctggctaacacggtgaaaccctgtctctactaaaaatacaaagaaattagccgggcgtggtggcaggcgcctgcagtcccagctactcgggaggctgaggcaggagaatggcgtgaacccaggaggtggagcttgcagtgagccgagattgtgccactgcactccagcctgggcaacagagcaagattccacctcaaaaaaaaaaaggaaaaaattatttgcaatgtcaatcccaggctctagctccctttatgaaaattttctgctacaaaataaatcaacacttggcaataaatccccttatgttcaacatatgaaagtcaaaaattatgttttaaccaaatgacattctagttgcaaattaaaaacctgattagtgaatagtaaacaggtgtgtcaggacatgttccactaaagtaaataacaggtcaggcacagtggcttacacctgtaatcttagcacttcgggaagctgaggcaggcacatcgcttgagccaagtttgagaccagcctgggcgacacagcaagaccacatccctatttttttcttttaattaaaaaaattatagccaggcatggtggctcacccctataatcccagcactttgggaggccaagacggtcggattgcttgagtccaggagttggagaccagcctgggcaacatggctaaaccgatctctattaaaaaatacaaaaattagccaggcatggtggtacatgcctataatcccagctactcgggaggctgaggtataagaatcacttgaacccaggaggtggaggttgcggtgagccaagattgtgccactgcactccagccttggcaagagtgagactcttgtctcaaaaaaataataaattagaaattatataaaaataaaaaaaataaacaacagatgacaagaacttgcttgtctaacatggtgggtatgtttcaaccacgtataataaactgtgcttcccaaagtgtgtttggtgaaaagactaggcccagtgaggagaggccatttcgttttaactgtaccaccatgaatacaaacaagtgaactagaaaaggtcgccacactactgcaaaatgtgctaaaaaaaaattaacagacctcagcatgatgaaaaaggagaaaaagtgcattctcttcctaaagaactctgcttattgtatacaggtcaactcaagtaatttaagggtagcgtttaggatgtcaaatcattgtttacctgaagcatggacttggggtgaggcagatcttctccttgataaattttaatatatgccttaaaatataaacataaaaactgctataaaatgttattcagtcatatcttactcatatttaatttttagaaagtgaccatacaactgcattttcctaaagacttaggtcaacaaccaggaattagcaaaaacacaccacacacctttgagtgcatgttagcatttttagttaactaaaaatgttctcaagcagcacaagcctacagaggctaggattcccatccagctccccatgcacgctggcctcaccactacctgtgggcagagtgaccatccgccttgaggtagtcgtgtcacatctaggtgccgtctcctcctactcacagcaacttcctaaccacctcctgtccacaccatcttccttgaggaacaatcttcctttagtcacagctaattgctcctctaagagagtgcaaagaacatccatttggttcttagaccgatactgccacccaatggcccactcctggaaggacaccaaggtctctgaaaatgcctctcaccatctcccccagaaaatttttaagtttcaaaatatttaaattcaagttgatttacgagtgagatcagctttaccaaaaatcaaacattttaataactaaaacccatatttaccttaaaatactccagtagtccccgacaggtgacctttgagccattgatctccttttccattaacttagatgggtttaatacatacggtatcagtgcctgtaactgctctttgaattcaccagcaatatctgttcacaggacgacaaagaagggaaaaataagccaaacagccttattcaaccaaggtgaacacacaatgcagtcttcccagtctagtgcttttaacattggttgttaaaagtgagagagaagccgggcacggtggctcacgcctataatcctagcactttgggaggccgaggcaggtggattgcctaaggtcaggagttcgagaccagcctgaccaacatggtgaaaccccgtctctactaaaaatagaaaaactagccaggcgtggtggcaggtgcctgtaatcctagctactcaggaggctgaggcaggagaatctcttgaacccaggaggaggaggttgcagtgagccaagattgcaccattgcactccaggctgggaaacaagagtgaaactccatctcaagaaaaaaaaaaaaaaagtgggagagaagaaggggtctgagactatgttttgacactttctggctatgaccaagttgctgacagatctctgtcccaatgtaccttcatttttctccttccccactgtagtagaaagtcttctctagttcaaaatagaatactatatatgcagaatatctttaccttggttttcattctgggatatctggtctactccctagcctttcaagaaatttcactttttaaagaatttgatggccgtgcgtggtggctcacgcctgtaatcccagcactttgggaggtcaaggcgggtggatcacgaggtcaggagttccagaccagtctggccaagatggtgaaaccccgtctctactaaacatacaaaaattagccgggggtggtggcgggcacctgtaatcccagctactcgggaggctgaagcagagaatagcttgaacccggaaggcagaggttgcagtgagccgagatcgcaccactgcactccagcctgggcaacagagtgagactccatctcagaaaaaaaaaaaaagaatttcattaacagggtcttcaacaagtcaattttcaacctctcaagttgtctcaggcctttgccatgccctcacactactactcctttaaatcaattagaaatcactggtcattgatttattcttgttaatttttttaatgttaaaagaagtagaagtacctgtgcctcattatatttattttctattatctcctcagagaccctcggaaccaccccaaaatgaaaagaccactaactcaagaaaggtgacagattctctgcagcttctacaaggttcccacagagggatcagtacagccattaaatagagctctttcctcaaagtaagaattattagctggtccaactatgaagacacaggagaattaaaatacagaaaagctgatttacataatcttctaacatcttcctgggttcccagctatacactgaaaaaaagcaggtaggagcccacatcaaataagaactctttaatactccaccaaccagactataatatgaaaaatgaaactaaaatttcaagaaagcatgggaaaaatactttataaccttgcagtgaaaaagtataaaagtatacataacaggccattctgtacacattcacatttgctttcatatactaaagaaactctgaaagactacaaaaatggaagagagacttttcactgagtactttttaatcctttttaaaattttaaacatgtgaatgtattacatatccaaaaaacctttttgtatggtttcaatttccatcacactgaaagatggagtgtttcaaaaaatacctcacacaagtagcagcaggatccagatgctacacttgtcactttaacaagctgtacagaccctatatgctactcatgtttctatgaaggctacaccaaaataatagttttaaaattagaatagacaagaactatctcataacagaaacaaactcaatctttagtggtgtcaaagaagactgtgccctacaaagcctcctgtgttaatttccaactaaacaactcagtagttactgtattaggtctccctgtgacagtaagtaggaagataacaattttctttatgctgacaacacagtcatcttgcatctgatgaaaagtattctcaaaaagcagctattctaggcctagcgtggtggcccgcacctgtaatcccagcaccttgggaggccaaggtgggcagattgcttgaggccaggagttcaagaccagcctggccaacatggtgaaaccccgtttctactaaaaacacaaaaattacccaggcatggtagcgcactcctgtaatcccagctactcgggaggatgtggcacaagaatcgcttgagcccgggaggcggaggtggcagtgagctgagatcgcaccactgcactccagcctgggcaacagagtgtagacaagactttgtctcaaaaaacaaaacaaaacaaaaaaaaaaaaactcagcagctattctagctaattacttcaagaaacagcagctcagcatcagttataccaaaactaagatcatgtttggcaggcatctacctctaaataagtggttgatctttaaaaataaaataaaaccactaaaataattcctaaagtatctgggggaacatttgcagaaatagtttcagaatgtagttcttatgaaatttaaatgttctacaaaaattacactttaagttccttttatggattagccctaacaacctcaggctaatgtcttttccaagttacacagaacaggactgcagaatctcaaccatggaactgcacaagtatatatttgagaaaatataatgcctacccttttttttaaattctgaaaactacgttagttctactaacaggtctcctacaataaactgtgtgtggttctcaagctagcacttgccaaatacaaatcacccgctatttgcaatttagcatccaatttactcttcactcaaaacccttcaaaatcttggttaagtggttccctaaaattaaaaaatatccatctccaaatctaaaatgtacataaacctttgcagagctagtaagaattcttcatgaacaatcctcataataattgtagttccttaaataaacacagagggcaggcttttaacatatttttaaagttaggcaaaaaagcaaatttttgtttttcaaatctttccacttaagaaagtactggctgggcgtggtggctcaagccagtaatcccaacactttgagaagctgaagtggaaggtgggaggatcacttgaggtcaggagttcgagaccagcctgggcaacatagggagaccctgtctctacaaaaaaataaaaagattagccaggcatagtggtgcatgcctgtagtcccagctactgaggaggctaaggtgggaggattgcttgagactgggagttagaggctacagtgagctacaatcacgccactgcactccatcctgggcaacagagcaagaccctgtctctaaaataaataaataaatacatacatacatacatgaatgcatacaaattttaaagtacttattttttttaaataaataggatcataccacatatgctactccactatctttctgcatttaataatatatcacaaacatctttctgtataaagacacacagattcaactatctaccttatctttttttttttgggacagagtttcgctcttgttgcccaggctggagtacaatggcgcgatctcagctcactgcaacctccacctcccgggttcaagtaattctcctgcctcagtcacccaagtagctgggattacaggcatgtgtcaccatgcccagctaattttgtatttttagtagcgatggggtttctccatgttggtcaggctggtctggaactcccgacctcaggtgatctgcctgcctcggcctcccaaactgggattacaagcgtgagctaccgcacccggcctctaccttatcctttttaatgactgcattttattcctttctgcagatgtaccttaatttttgtttttgtttttgtttttttgagacagggtctcactctgtcacccaggctagagtgcggtggtgcaatcacagctcactgtagccttgacgtctggggctcaagcaatcctcctacctcagccttctgagtagctgggaccacaggggtgtgccaccatgtccagctagtatttttttttttttagcgatgggggggatctccctatgttgccgaggctgagatgtaccataatctaaccaactccacataaagacacatttgtgttgtttccagttattctctatgataataatgctaccatagtatctttttttttttttttttttttttttttgagacagggttttgctcttgtcgcccaggctggagtgcaatggcgcaatctcggctcactgcaacctctgcctcccagattcaggcgattctcctgcctcagcctcccaagtagctgggattacaggcacctgccaccatgcctggctaatttttgttttagcagagacagggtttcaccatgttggccaggctggtctcaaactcctgacctcaggtgattcgtccaccttggcctcccaaagtgctgggattacaggcgtgagccactgcacccagccagtatacatatttttatccacttatttaaatagttccttaggataaactcctagaagtgggatagtggatcaaaggacgtgaacattctgaattctgatgctgccacgttacaattcataaagatgatcatttattaccaatgcttttgtgctttcctgattattgtgatgctgcacatattttcattaatatataatgaccatttgtatttcttctttttggacttgccttttcatgtaagaaaggaagatttaagacttaccagtgcattttatatagctctatcttgatgaggaaaccaaatagtacataattatgagactaaagattgctcatacagaatttgttccctattttataaatgttatatatgaaacttgacacgcttaatatttagtgattaaaccattcataatctacatatatgtatagtgagttgaacagcatccccctccccaacaaaatgcatgtccacctggaacttcagaaaatcttatttggaaacagtcttgcaaatgtaattagctgaaaggaggtcatactggattaaggtgggccctaaatccaaagactggtgtgctcacaagaaaaagacagaacacacaaagaaggcggtcatgtgacaacaaagaacctggaggcaactaaaggtacaagtcaaagaatgccaaggactgctggcaacttccagatgctaggagagagtgtgggacaggttctccttcagagtctccgggcggaaccaaccatcattttggacttctggctccctgacttgcgggggaataaatttccgttgtcttaagccacctagtttgtggtaattggttaaaggcagccacaggaaattaatacaaccaaaagtgacacaaatttcaaaagccagggttactgaactttaaaaaactctgcctactccctgaatgataaaaatgaaaatgaactttaaagcaatgcattggaatactaaaactgaaactatggaagaatgccatgtgtgtgtgtttatactggataatcactaggagtcactctaattcaccctctcctaacacctccatttaagaattccactggacacattccctatcagtgatgaacaaatctgagttcaggttgggaaaagtacaaccaataatggagcattataatcctaaacaatatattacctagagacatacacatacacacttaactttctctccctactcagctctgaaaactcccttgaaactgcttttcaggtaaaaggttctaggtccactgcttgccaagcggatttctctccccaagcaataatcttagatttttcaattgccatgaaacaggccagggaagtctcctcctcaggaaagctgtcaatcacgtaaaagtatcagagaagtgacaaataaaaggtaaaggttaagtctctttaactcagtttctttgcaatattaagaccagctagaatgaaaatcttgagttgaacattcattttcttggatcaactaaatcaaataggttggaaatgatgcattttatatttaatatgaggctatgaaaaccattcacttcaaaaccttttagtagtaactaaacagtacatatcctctaaatgatttcctccatataacagaagaacccctattttagcccagtatgggtttggagcaacaagaacttggatgtagatctacgcctcaccacttacttaactagctgagcactttgagcaagttacttaactttcctccttttccttaactatttttgccattttcctcacatataagataaaggaaatgacatcaaagtcattggaattactgggagcataaatatcaaagtacctagcatagtgttgcaaacattaccaggaatctgagagactcggataagcttattaacaagtgctcagtttaacacatgtataaattaagggctagccatttaatgactcaaggccttaatgaaaaaggaacaaagataagataatggagcccaagagtcccaactacgattcctctcacctaccatttagttagcacttcctgatattagcacatgacccagcgtcaggttttgctataatcacaaataagatgaaaataatagctctgccatgcatcatgctgccttcccttaggaagttaattttacttaatattagctgactaatgtttagtcttcctttatttagcatttgtatctcttgtaaaccaagaaccataatgagtctctttagaaagactactaatggatatgaacaccaccatttcaggtggagaagtcaaggtaaactaattctgatggtctcagtaagtcaggagcaaaatctgaactagactttaaatactactctttctaagagagcataccatttttcttaagcattcacttgatttgtaagtgattcattatttttaattccaaagatcgaatcacaggtttaaaataacacctggaacacaccttttaatttcccatcaaagtcagggcttgtggccacctggagtcctggatgtggtaagagaaagcaggtgacatcggagaaacatgagtgaatgtgatttcgaacattctgaatttcttcatgttgatgttccttcacctgccaatgaagaccaagaatttaccaaccaaaagtcatttggttttcttcactagggacaactagtataaggacaaaggaaagaagactcctcaactctgatggatcatagtggccaaatgagaaaactcagaaccctaagaagcaataaacacacaaatctgattacctacggcttgactcctatagctagcaaacaggtgcataagagtttcattaaaatgagtattacacaagagatggtttgtggggatgaaggaggatctaaccaattagtagtgacagacaaaggattcctgtgttttggtttgggggaacaggttaggcctgtttatatctatcccaaaataagtaaaaattttgaagaataacataactaaaattctgagtatgatttctaaagacacatatagaacttggtttaaaatgtaaaatggaaattataatcaaagcttgggcactggcccagagttttcttctacagttcctgtgtactgtatatacaggttctttaatcttgtcaagaataaatattagcttgtgttaagattcatatatagttaatgtattcaatatcattttcaataattgctttaaacacaatagccaaaagcaaatgagaaagctatcactactttgagataattcatcagaagattatagtcccacttacctgtaaacgcttatccaaaaatgccattcctccttggagtccatagctatattcataagggaaactccaatctctaaccaaaaacatcagtgtctatttaagaaaagagcggaacatattttaacatgcataaacacattttcaagagaacaactgcaatacatctttgcataatgccagcttctacaaagggggtaaagtagaaggatttaccttttttttttttttttttttttaaagagattgggccttgctccgtcactaaggctagagtgcagtggcatgatcatagctcactgtagcctagaattcctgggctcaagtgatcctttcacctcagcctcccaagtagccgggactacaagcacatgccactactcctggcttattttttaatttttttatatagacaaggtcttgctctgttgcccaggctggtcttgaactctaggcctcaagcaatcctgtggccttggcctcccaaagtgctgggattacaggtgtgagccaccacacccggccagatttatctattctgtaatgtcttagaagttttacaaacactggagggacatgtttaagccaaatatgaggtcaatatatcctatctgctatttttgttcccacaggttagtaggaacagaaggaagacattaatgagaaaatggtaaatttgggactctgccttaaagaaatctatggggaatacagtaaaggacaaaagagaaaaccacatggcaccagctaatcataaaatcagatctgtggccgggcacagtggctcacgcctgtatcccagctacttgggaggctgaggcaggagaatcacttgaacccaggaggaggaggttgcagtgaggcgagatcacgccactgcactccagcctgggtgacagagcgagactctgtctccaaaaaagaaaaaaatcaggtctgttttcagcattagaaaggaaggccagccaccgtggctcatgcctataatccctttactctgggaggccgaagcaggtgggtcacctgagctcaggagtttgagaccagccggtcaacatgatgaaaccccatctctacaaaaaatacaaaaaattagccgggcgcctgaaatcccagctactcaggagggtgaggaaggagaattgcttgaacctgggaggcagaggttgcagtgagccaagatcatgctactgcactccagcctgggcaaaattttagaaagaaactccatctcaaaaaaaaaaaataaattagaaaagaaaagaaataaggcttacacactgaaagcacctctaatcccattgactgaggctgctgtgcttcctcattctcaagaaacactgaactgaggcataggtcagcaaagactttttgcagagagagagagagagagagagacagagagagacagagagtgagtgagtgtgtatgtgtgtgtttgtgttgagacggtcttgctttgttacccaggctggagtgcagtggcacaatcatggctcactgcagccttgacctcctaggcttaagtgatcctcctacctcaaccccaccgagtagctgggactacaggcgtgcacgacctttttattttattttatttttgtttttttctttttttttgagacaaagtcttgctctgtcgcccaggctggagtatagtggcatgacctcggctcactgtaaccttcacctaccaggctcgagcgactctcctgccttagcctcctgagtagctaagattacaggcacccaccaccacgcccagctgatttttgtatttttagtagagacaggttccatgttggccaagctggtctcgaactcttgacctcaggtgatctgcctgctttggcctcccaaagtgctgggattacaggcatgagccactgtacctacccccatttttttaagagatgtcttgctatgttgcccaggctggtctcaaactcctgggctctagcaattcttccacctgggtctccccaaagtgctgggattacaggtgtaagctaccacgcccaacccacagagcttactttttaagcgattactctgccgttgtagcaggaaagccgtcacagacagtacaaagacaaatgagcatggctgtgttacactaaaattttacctacagacaatgacacttgaatttcaggtaatttacgtgtcataaaatagtactgctcatttttttcaaccatttaaaaatgtaaaaaccattcttagctcacaagtcatataaaaacaggtggcaagctagatttggcctatgagctgtagtttgccaatctgtgaaaacaaaaacaaaggtatgaattatatttaaaataaatattctaacctggaaaggcttttggaaaatttcatccattgccagacgaccgtattctgtgaagagctttaaaaaagaagcattatggtttgtaaagcaaaattacttaaaatagttctatggcctttttagcaaagtattcattatatttatactgataccagacttctacagtttcaaaagcccacaggagtcatgaaccttaaaatcatcttggttattccctgctcacatcccacatcccaattcatcaacaaatccagaatccagccactcactatttccatgtggcttggaatactgcaatagcctcctaactgcctcagcccatgcctccctatgggctattctcaacacagcagccacattgactcttttataatatggttagttagatcatataatggctttgctcaaaaccccacaacctcattcagtattaaagccagtccttacagtgtgatgcagccacactggccctccttcctgttcttcaaatacacggggcacaccgctgccttaggaccttcgtactggctcctcccactaactataagttcttctcccaaatttcctcatgatctgctccctcacttcttaaggtctttcaaatagctccttctcagtgaagacttccatggccatctaccgaaaaagattacaagtttgccaataatatttcctacttcgtgtctttaaaaaaaaatttttttttttgagacagagttgtgctcttgttgcccaggctggagcgtaatggcgcgtggctcatcgcaacctccgcctcccgggttcaagcgattctcctgcctcagcctcccaggtagctgggattacaggcatgtgccaccacacctggctaattttgtatttttagtagagacggggtttctccatgttggtcaggctggtcttgaactcctgacctcaggtgatccacctgcctcggccttccaaagtgctgggattacaggcgtgagccaccacacccagtcttaaaagtttttttcttaacatttatcattatctaatatactatacctcttcttgatttgatttgcatctgtctttatactagcatttaaactccatgagggcaggaatatttgtctgttttgtgcactactggatttccagcagcaagaaaagtattaggcccataatatttatgtcattcaaatgactgaattctttaaggttaaggtttacatgtatatttacctctaaatcttcaggaagcctcactaaaagcataacaaaacaaactttaaaagtaaataaataaacaggacaaagcagccagcagaaaagccctgtcaaaaacattctggatggaaaatagacaaatgagaactgtctcaagttttggctttctctgttctgctaagaaatctggaagagacaggggccaacaaggaagaagcaaattatctcagtagaaatccctgaaatgctcagaaattataagcatacagttaccttacaggaggaggtgtaggagtccagctgacaactaggaaatatgtgagtcttaggagaaagtacctacacttccaggcacccctctctaactgccgtatttttcctgcctccatagaagatgggaagtgtactatctggagaagataaatccaaaaaaaaatctagacttagataccaaactcagctgaggttaggagtaagtctcctaccttcaaacaggtacttaaatcaaagtccacatagtgagcagtgggactccttagccctctcaccctactggttgccacagcaagcttctacccaccaaggcaggaatttaaagaaattttttccagggaaactaacaacccaagaataaatatctgcaaaaaaaatagacatttaggagttggcaacaaaatagctagataaccttgccaaaccacctacctcattgtgatccaaaccagtacacaaggcctatcctcttatcaaagctcccagttggattgttagtggctctctcttaaataggtagtcaaggaccaccagctagacatttgagaaaagcctcttagcagggctggccgctctaatcccagcactttgggaggccaaggcagggagatcacttgaggtcaggagttcgagaccagcctggccaacatggcgaaaccctgtctctactaaaaatacaaaaattagctgggcatggtggcacatgcctgtaatcccagcttctcaggaggctgaggcaggagaattgcttgagtccgggaggtggaggttgcagtgagccgagatcgcaccactgcactccagcctaggcagcagagtgagactctgtctctaaaaaaaaaaagcaaaaaaacaaaaaggccaggcacggcggctcacatctgtaatcctggcactttaggaggctgaggcaggcagatcatttcaggttaggaatttgaggtcactctgaccaacatagtgaaaccctgtctctactaaaagtacaaaaaaaattagccgggtgtggtggcacgcacctgcagtcccagctactcaggaggctaaggcagcagaatcacttgaacttgggaggcggagattgcagtgagtgagccaagatcgtgccactgcactccagcctgggcaactgagggagactccatctcaaaaaaaataaaaaaagtactaaaaatccaggttaggggggaaacttatttggaaacaaaacctgccttcaactgacatgaagctttttataggcttatttaccccattttattggttatatatttcactgaagaaatattaatgtgtttaatcagaaggctctgcatgaacatcaacacccagctaatttttgtatttttagtagagacggggtttcaccatgtttgccaggctgttctcgaactcctgacctcatgattcacctgcctcagcctcccaaagtgctgggattacacgcatgacccaccacacccagctgtgatttctttttttacatcaaaatatttaatctatctggtctatctggaatttttgtatatagtacaaggtagaaatataattttattttctttttttttttttaaagacagagtctcactctgttgcccagactggagtgcagtggtgtgctctcagctcacttcaacctttgcctcccaggttcaagtgattctcaggcctcagcctcccgagtagctgcgattacaggcatttgccaccgcacccagctaatttttttttttgtactttcagtagagacagggtttcaccatgttggccagactggtctcgaacacccaaactcaggtgatcagcctgcctcagcattcccaagaggaatataatttctaatttatctaaatacatagccaactgtcctaacaccatttattgactgatctatgctttatggtatatgtgtatatattcttaagtagaataaaatatatgaaaatgtagtatatcgtaagtacactgcattgatctattttttcctgaaacaatgccatgttcttgtaattacagatttataatatgtactaagtcaattatctcatatttcccctgtaatttttttttttggctgttttacaatttaactttccaaatgaatttcacaacaattctgtcaagttcccaaaataatgcctttatgattttgtttagtggggaagaactgacaagtttataattctcattctaaatgagataatgtttataacacaccgcagtatctagtacagagtaagcaataaatacacgttggctattatcatccccatatggaagaaacaaggcatatttctgcatgttaaatcttttatatgcctcatacaattctgaagtgctccatatagatcttttttaagtttattctgttttcaatattttgttgctaaagtcaattttttccattacatttttaaactggttattgttagtagagaggaaaacctaatgattttgtatctgtattttgtaatggagaccttaattattttttaagttccaaataattttctagttcattcttacggatttccaggcacacaaacatattactttctcctctgtaatatttatattttacagttgctgagtctaccaacagccttgtcatgtgagacaaggtgaattacataactgcatcataatctacttactacttcttatgggttgaattgtgtcctgaagaaaaatatgctaaagtcctcgcacctggtacctgtgaatgtgaccttacatatatctatagcacttggccctctacctcacacaaggtaagcattcgaaaaatggttgaaaggaaggagcttagaaaggaataaatttcaggtgaaatggtgaccaactcaagttgtgatcgaagttttacagagcaacagctctcaaccactaagccatggcactggtacagaactaccaattatgaagtacagacaattgccataagcaacattaaggatcgaggtttaggaggaattttccttgttttttaaaataaacataaaatagaactaattcaaggtaatccctataataatgacacccttactcactcacattctgatgctttcttgaatgtcagtgggagaagtagcattagagtaacataccagaattgcatccaaccctggaatactcacaaaagagcattttgtgggaaaaacagataagacctgctgctataaaaaaagagaagaaaaaggccgggcgcggtggctcatgcctgtaatcccagcactttgggaggccgaggcaggcggatcacgaggtcaacaatttgagaccagccggaccgacatggtgaaaccccgtctctattaaaaatacaaaaagtagccgggcatggtggcgcacacctgtaatcccagcttgcagtgagccaagattgcatcattgcactccagcctggggacaagagcaagacttcgtcttaaaaaaaaaaaaaaagtctattctgaacatagcagccagaatgatccctttacaacaggtcagataacatcattgctgacgaccctcccatggctcccaccttccccagaggaaaagacccagaatgagtgggacctcactgcctctctgacttcatcacttaaccccttcctgtcacactctccaatcctacccaccggcctccctgccattccttgatcttgccaagcacactcccctcagggtctgtcttccagcagctgctcctctcctgtaatagttttccgcccaaatgtatctgaaggactcacttgcccactttctttcattctctgctcaaatcattaaggccttccccgaccactcctgctccaccccaccaatggctatacatagtatagaattactatgaaccaaaaaccttcctctacatttcaatcttttgctaaaaactactcagttgtaaaatgttccttaatcttaaaacttttaaataatatgatgttaaaattgttatgagaaatatatacctgcagctgttgaagatcatcttcttgaatgttctgagataaattataaatctagaaaacaaaaatccagattgatactactctggcttacttcaaacaaatcccaaataagcctaaagggctgacagaagctttgaacaattaaagacttgcatataagaacatgaggcctgttcaaacagcaatatgatctgtcttttggaaaactatgcacataagattgaaatcaaaaattcctcctttacagtttaaaacagttttcctaagctcttatcaaatctgtattttctatatgatataataaatttccattttttggacttttcttggaacatattatatataattatgaccaaagaggaaaaattctttggctccttctcaaacttttaaaagtttaactgcatctacagtttaaaaataatatttacatatcatcctagaaattctgttaacagaacaataaccaaaactgtatttcctccctttatcttatttcctttgcgagcttttttctgagtcaagtggtttttacctgaacagaactagtcatagtgcttagagcaaagatggtagcacagtctttcacagttgactggctgtcaaatgccccctgggtatccatcagaacaactgcaacctaaaaaaaaggaaaatacaaacaaaagagattaaactaagaaggaggaaaccgtaaaggagaaattgaaaagtacaggtaatatatacttaagtacaggtaatgtttatgtgagccttaagcacctgcttgtaggttctgtacaactatttaggtgctttgctttgactacagcactctactgaagattatccagcgttatacagagcaatatggaaggcaaaaattgccccaccaattgaaacagacaaaagttgaaagcaattagcttatcacccagccaggcatttggatgtttcctgttgttgaaaaagaaactaaaaaatattcatcttggccaggtgcagtggctcacacctataataccaacagtttgggaggccgtggcagcagcagcacttgagcccagttcaataccagcctgggcaacatagtgagacccagtctctacataaaatttaaaaaattaggtcaggcgcaatggctcatgcctgtaatcccagcacttcgggagggaggcaaagtcaggtggatcacttgaggccaggagttccagaccagcctggccaacacggtgaaatcgtgtctctaccaaaaatacaaaaattaggccaggcgcagtggctcacacctgtaatcccagtactttgggaggccaaggcaggtggatcacctgaggtccagagttcgagaccagcccggctaacatggcaaaatcccgtctctactaaaaatacaaaaaaaatgggcgtggtggtgcacacctgtagtcccacctactccagaggttgaggcaggagaatcacttgaaccctggaggcagaggttgcagtgagccgagaccacactactgtactccagcctgggtgagagagcgagattttgtcccaaaaaaaaaaaaccaaaactctttggtatatacccaaaggagctgaaaacttatgtctcaacaaaaaccaacacatgagtatttataggagctttattcttaattgtcaaaatttgaaagcaaccaagatgtccttcaacaggcaaatggatgaacaaactggtgccttcataatgtagaatactattcagcaataaaaagaaatgaactatcaagacacgaaagagttgcagaaatcttaaaattgcattgctaagtgaaagaggccaatctgaaaaggctgcatattgtatgattctaactatatgacattctggtaaaggcgaaactatggagacagtaaaaagatcagtggaggagtttgtggggagggaagagaggaacagataggtacattacagagaatgtttagggcagtgtgactattccgtatgatacagtaatagtgggcatgtgtcactatacagttgtcaaaatccaatgtacaacacaatgagtgagccctaaagtaaactatgtatgggttttagctaatgacaatatattggttcaaatattaattgtaacaaatgtatcacactattacaagatgtaaacaacagagcaaactgaaggagaatgtgggaactgggcaggttgcaattaattttcctgaaaacctaaaacaaaataaagatacaatttgttttttttttttttttgagacggagtcttgcgctgtggccaggctggagtgcagtggcgcgatctcggctcactgcaagctccgcctcccaggttcacgccattctcctgcctcagcctcccaaatagctgggactatagacgcccgccaccacgcccagctaatttttgtatttttagtagagacggggtttcactgtgttagccaggatggtctcgatctcctgacctcatgatccgcccgcctcagcctcccacagtgctgggattacggagtttcactctgttgcccaggttggagtacaatggcacgatcttggctcactgcaacctccacctcccaggtccaagcgattctcctgcctcagcctcccgagtagctgggattacaggcatgagccaccatgcccggctaatttttgtatttttagtagagacagggtttcaccacgttggtcagactcgtcttgaactcctgacctcagatgatccacccacctcggcctcccaaagtgctgggattacaggcctaagccaccatgtctggcctattttttttttttttttgagacagagttttgctcgtcacccaggctggagtgcaatggcgcaacctcggctcaccacaacctccacctcccaggttcaagcgattctcctgcctcagcctcctgagtagctgggattacaggtgcacaccaccatacccggctaatttttgtatttttagttgagcaagactgtctaaaaaaaaaaaaaaaagttgttttctgttaattttaatatctgtgttagttctgagacagttttgattgatttttctcctcatttgggttatatttttctgcttcttttatgtctgcaaatttttgataggatgtagacttgtggattttcccttgttgggtgctggttatttttgcattcctataaaatatctagctttattctgagatgtagttaagtaatttggaaactctggttttttctgttcttgctgtttagatttgttaaatggaaccagagtgttgttattcctcattactgaggcaagactgagtactcttcctaatcccactgcaatctccgccgcccaggttccagcaattctcctgcctctgcctcccaagtagctgagattacaggtgggcgccaccacgcccagctaatgtttgtatttttagtagcaacagggcatcaccatgttggccaggctggtctcgaactcctgacctcaggtgatccgcccaccccagcctcccaaagtgctgggaatacaggcgtgagccaccgcatctggcctttttttttttttttagatggagtttagctcttgttgcccaggcggaagtgcaatggtgcgatctcggctcactgcaacctccacctcccgggttccagcgattctcccacctcagcctcccaagtagctgggattacaggcatgacccatcacacccagctaattttttgtatttagtagagatgggttttcaccatgttggtcaggctagtctcaaactcctgacttcaggtgatccacccacctcggcctcccaaagtgtgagattacagacgtgcgccaccgcgccggccaaagaattttaaatgaacatcttgtggaacaacttcaagcagcaagaggcacatgtaataggagtctccaaagggagtaacagaccaaaaaaacttgaagaaataataaccttaaaatgtccaaatttgataaacattataaatctgcagattcaagaagctcaacaaaacccacatacaaataacatgaactacatcagcctggcgcagtggctcacgcctataatcccagcactttgggaggccaaggcgggcagatcacgaggtcaggagatcgagaccatcctggctaacacagtgaaaccccgtctctactaaaaatacaaaaacttagccgggcgtggtggtaggcgcctgtagtcccagctccttgggaggctgaggcaggagaatggcgtgaacccgggaggcggagcttgcagtgagccgagatcacgccactgcactccagcctgggcgacacagtgagactccgtctcaaaaaaaaaaaaagaactacatcaaaacacataataatttgctcaaaaacagtgataaaatcttaaaagcaaccagacataccctataaatatatatacctatgtacccacgaaaataaaattttttttaatttaaagaaaaaagcaaccagacaaaaaagacagattaggtacaaaagaacaaaaataagaataacagtgtatttcttgtcagaaacaatgtcagcagactgggcacagtggctcatgcttgtaatcccagcactttgggaaacagaggcaggtgaataacctgaggtcaggagtgcaagaccagcctgaccaatatggcgaaaccccgtctctactaaaaatacaaaaattagccaggcgtggtggtgcgcgcctgtagtcccagctactcagaaggctgagacaggagaattgcttgaacccgggaggcagaggttgaagtgagccgagatcgcaccactgcactccagcctgagcaacagagagactccctctcaaaaaaaaaaaaaagaaacaatgtcagcaaaaaggcaaaggggcaacacctttgaagtactgagaaaaatacgttggcctagaactctacactaagagtaaatattttccaaaacaaaggcaaaataaagatttttcagatgtatgaaagctaaaagaattcagtaccaacactccagcacttcaaaatatcaaaggtggccaggtgtggtggctcacccctgtaatcccagcactttgggaggctgagacaggcggatcacgaggtcaggagttccagaccagcctggccaacattgtgaaaccctgtctctactaaaaatacaaaaattatccaggcatggtggtgtgcacctgtactcccagctaatgaggaggctgaggcaggagaattgcttgaacctgggaggcggagactgtagtgaccaagatggtgccactgcactccagcctgggcaacagagtgagactacatctcaaaaaaaaaaaaaaaaaaaggacaaacaggtgtgaaggcatgcttataggattgggctaaaaacagaagtaatggatgaaagtctgtataagaaacacatgacttacccctcccgatccttacaaagaaatctgtggagaggctctatgcccatagcttacaaggcatagatgagactggggctaagaagccctactgatagctaggggatagtgaatgcccaccttctgaacagtgagatccccaatgccatttccctgctcaactcccagaacaacagccaggtctgtgccacccatacaggagtaaggaagtaaagaacagaagtggtaacacataagagcatcagcctctgggaagtgaaaactgggtagagaggagaataacacacatgacagctgctttctgttagaagccttacagtagtacctgaccttttaaactatattcatgcattttatttaagaatcttaaaaacaatcaatatgtattaattttaaatcattcactttgataaaaagttgttttcacatcttccttccttttattgaaaaaaaatttcagaaaataacagttcataaaagacacaaacaaatcaacaggtatataccagtggaaaacacaatatgaaactaaaaatgccattggctttttttttttttttttgagacggagtctcgtactgtcgcccgagctggaggacagtggtgtgatctcggctcactgcaacctctgcctcccgggttcaagcgtttctcctgcctcagcctcccaagtagctgggattacaggcacccaccaccacacccagctaattttttgtatttttagtagagacagggtttcactatgttggccaggctggtctcaaactcctgaccttgtgatctgcccaccctggcctcccaaagtgttggtattacagacgtgagccacagcacccggctgccactggcttctttaattggttaagagcacaaaatgtaacaggcagaaggtctgtttcaaacaaattaaaaagctatgtgttttttaaattctccccaagttggatatacacacacccacaaaaatagtgtgtgaaggaaagctgtcatacacagtaagttgtatcctgaattattcaaggaaacacatgttgaaataggaattaacagagtcagcaacagattaatattttttaactgagtctaaaaatgctacatagccctaaggaatactacataaagtactgctaggtacaaacaaaaaagtctgtatagcttttagcaaaaatgtttttccagaaaagaaaattaaaataatgcaatcagcagaccaaggagactacagctagacatcagagctacaacttcgcatacctgtgtcagaaaatcctatttatccacaacagactaaaatttcaggacaaaacagggactttttaacttttcttactttacccattttaaattctttgataaaaggtttttaattgggttaacacagtacatgctgaagttcatattttgttgttgttgttgttaatctgtaaggtcattttcatccttaccttcttcccacctggcttctccacagtgaaaacttcactccagatttgaatcccagtggtttctggatcagatccccctctccaggaaaatcctgttaacggttcttctgggtcacccaaccaatttgaatggccactttccttctacagaagtaagaaatttctattaaatcttaaattaaaaattttatgcatcaaggataatctatgagcttatttcgcttttttggacattaaagtctcactttttacttgaaataaaataattctatcttacctgagaatataagtatcgtagcataaaatccagaatgaaggacttgccctttcggaaggcaccagccactgaaaccaccaccacatcaagatctcggatgtggtcctgcaagaggatgctggccaaggctttctcatctagctcaaaggaatgttgatctttctgaaccaaaacaacctgcactggaccaggcttgctgctctccatggcatcatctatgttcatgcagagaaaaaaaatcagtgtcaaatatttaaaatatgtttttgaatatagggaaaacaaaaacttcttaaacaggggacagggccaggctcaatggctcatgcctataatcacagcactttgggaaaccaaagcagaaagattacttgaggccaggagtttcagactagcctgggaaacggtgaaacccagcgctatgaaatttaaaaaattagccatatgtagtggtgtatacctgtagtcctagctacttgggaggctgaggcaggaagactgcttgagcccaggggtttgaggttacagtgagctatgaccacaccactgtactccaacctgggtgacaaaactaaacaaaacaaaaaacggacacaaaaatactaaccataaaagggcagggcacagtggttcgcccctgtaatcccagcactttgggaagccgaggtgggtggatcacttgaggtcaggagttcaagaccagcctggccaacatgacgaaaccccatctctaccaacaaatacaaaaattagctgggtgtggtggcacgcacctgtaagtcctagctactcgggaggctgaggcacgagaataacttgaaactgggaggcagaggttgcagtgagccgagatcatgccattgcactcccacctgggtgacagataagaccctgtctcaagttaatgggtgcagcacaccagcatggaacatgtatacatatgtaactaacctgcacattgtgcacatgtaccctaaaacttaaagtataataataataaaaaataaataaaataaaatgttgttaaaaaaaaaaagaccctgtctcaaagaaaaaaagtactatccataaaagaaaataaaatgacaacacagacttcattaaaattaaaaactttgttcacttaaagacttcaataagtaaaaatgcaagccatgggctagggaagagtattcacaatatctgtttccaaaggacccacatccagcatcaacatagcaatccataagaaaaaaataacaggcactttgtaagaaaaagatatacaaatcctattaaaaggtacttccatatcattacttaacagggaaatctaaattaaaaccacaataagataccactacctgcccatcagaatggctaaaatttaaagactgacaatatcaactgtgggacagggtatgaagcaaccgcaattctcacacattctgataggagcacaaaatactaaagccacttcaaaaaactgtttggctgtatctacaaaaattaaatatatctgtgatccagcaattctactcctaggtatacacctaagagaaatgaatgcctatgtccaccaaaaaacatatatacaagaatgttgagctgggcatggtggctcgcacatatagtcccagctacttggagagctgaggcaggaggattacttgggcccaggagttcaagaccaacctggacaatattgcaagactctatctcaaaaacagaaagttcattatcagctttactcaaaacagtccaaaagtggaaataaaacaatgtctatcaataatagtgtttgccactgctaagctttatttagatatatatatacacatatatatatattatttaatcctcagaacaactctttgatgtaaataatactgctccattttaagaagaaggaaatggccaggctcagtggctcacatttacaatctcagcactttgggaggccaaggcaagctgatcacttgaggtcaggagttcaaaaccagcctggccaacatggtaaagccccgtctctataaaaatacagaaaaaaaaaaaaattagccatgcgtggtgtcgcacgcctgtggtcccagctactgaagaggctgagggagaagaattgcttgaaccgggaggcagaagctgcagtgagccgtgatcgcgccactgcactccagcctgggtggcagagtgagacttggtctcaaaaaaaaaaaaaaagaaggaaatgaaggcttatgaaggttcagcatattgcccaacaggtcctagatataagctcaaaaagatctttaggtggttgtattttgcatatcactagtaataactcaaaaagttttagaagctattaattctatagttcaaaattaagcactaactatattatactttccttaccagagtttccctaccaaagcacaaagataactaattaatttgaaattcaggccaggcacagcatccacgcctgtaatcctagcacttagagaagctgagatggcaggattgcttgaggccaggagttcaagaccaacttggccaatatagcgagagactgtcttaaagagaagagaagagaagagaaggcaaggggccgggcgtgctggctcacctgcgcaatcccagcactttgggaggccgaggcgggcagatcacctgaggttgtgagttccagaccagcctgaccaacatggagaaaccccatctctactaaaaatacaaaattagcccggtgtggtggcacgtgcttgtaatcccagctacttaggaggctgaggcaggagaatcgcttgaacccagtaggtggaggttgtggtgagctgagattgcaccactgcactccagcctgggcaaaagagtgacactccgtctcaaaaaaaaaaagtgaaaagaaagcaagaaggaaattcattcaggctagacatggtggctcacacctgtaatcccagcactttgggggccaaggcaggcgtgtcacctgaggtcaggagttcgagaccaccctggtccaacatggtgaaactccatctctactaaaaatacaaaaattagccgggcgtggtggtgggtgcctgtaatcccagctactccagaggctgaggcaggagaattacttgaacctgcacggtggaggctgcagtgagccaagaccgtgccactgcactccagcctagatttcagagcaagactctatctcaaaaaaaaaaaaaaaaagaaagaaagaaagaaattcagagccacttagtagctgtggacttatgggaagttcacaaaaaactaccagtggggcgtaaggaatgaataaagaactatttccctaagagtatgtgtcactggtattaaagatgtttttaggtagttaaaaggacatagtaattttaataattatgcatgttaatgtatactttaaaacaacaaatctgtattttgataaattattctttagaaggatgctaagtttaagaagtctgtttatttatttaagacaaggtctggctctataactcaggctggagtgcaatggcacaatcttgcctcactgcaacctctgcctctccggcccaagtcatcctcccacctcagcctcccaagtagctgggactacaggcattcatcaccacacccagctaatttttgtatttttggagagacagtgtttcaccatgttgcccaggcccgtcttgaactcctgagctcaaatgatccactcgtctcaacctcccaaagtgttgggattacagcgacaccgtacccagccaagaagtcaatttaaagtcgacttaaggagacatattaagtaaagcttagtactgacaggcagacatggccaaaatcacagcgacacagtacccagccaagaagtccatttaaagtagacttaaggagacatagtaagtaaagcttagtactgacaggcagacatggccaaaatcacaaagatggttccaaaatgactttgtctaaccagcactgaaggctacacgatcatggcaggcaaagcagacaaaacagtttgactgcaagactctctccccttcaagctactggaattgctgctcactttttacatttatagtatcagatagcaacagaagggttcttcgcactttttttttttttggagacagtattttgctctggcacacaggctggaatgcagtggtgcaatcctagcttactgcagcctcaaactcctgggttcaagcaatcctcccacctcagccaccagagtagctggcagtacaggtgtgtgccaccatgcctggctaattttttaatttttttgtagagatgggggtctcattatgtggcccacattagtctcaaactcctgggctctagtgatcctctcacctcagcctcccagaatgctgggatgataggccactgtgaatgtggatgatagccactgtggctggcttcttcctactttttaagtttttgcagactattggaaaacaagttataaatataggttaaatgtcatgctatcattgtaatcaatgtatactaatacttttctttcctgttattgcctggattaaaaaggaaacacttctgtgaataatctcttagggttcttattgccccagcagcaggtaaatccaagatccaaagaccttcagtctttcatacaaagaactaatgagaagaatttattcagacttcagggataagccacagtgttaagtactgtgtagcactcaaagaaatacaaaacaaagtcttgattgtggcagagatgtctggttgttcccccaatattaatttctccctcctgctatataatagatttttagctgggcatacaactgcccagaagaaacacatttccaacccaaatttatagctaggatatgaccaggtgactaaattctgaacaatgggaagtgactggaaataacagacacaacttccagatcaggcattttccccctgcttgctggctagatgtaaaagtgggagtgaatcatcttgggccaggcatatgagggcaacaccccaggaatgctggagaaacaagagaggtcagatttcgtatagcagaactgccatattggttcacttctgtgtgaaagaaaaataaatgtctaccttgcttaaatcacttatttggaggctccatcaaatacagccaagcctagcagccaacacaacagtcttccaggactttacaattaagttcatcataccagatctttttgttttatctatttcactattaaaagtttactgagcgaggccagcctcggtggcccatgcctgtaatcccagcaccttgggaggccgaggcaggcaggtcacttgaggtcaggagttcgagaccaccctggccaacatggtgaaaccccatctctaccaaaaatataaaaaattagctgggcgtggtggtaggcacccgtaatcccagctactcgggagactgaagcaggagaatcgcttgaacccgggaggcagaggttgctgtgagccaacattgcgccactgcactctagcctgggcaacagagcgaaactctgtcttttaaaaaaaagcgtactgagcaatgtgaatgtaatgagcaatatcaatgtaatgacacacagcacatacaataagctattgtttttttgttttttttttttgagacggagtctcgctctgttgcccaggctggagtgcagtggcgcgatcttggctcagcgcaacctccgcctcccgggttcaagcgactcccgagcagctgggaccacaggcatgcacctccatgcccggctaatttttgtatttttagtagatagaaggtttcaccatattggccaggctggtctcgaactcctaaccctgtgatccacctgcctcagcctcccaaagtgctgggattacaggcgtgagccaccgcacccggccaataaactattgtaaaatgaatgaatgacatgtaccataatgtggttgaaggctacaacccaaaggatccaagtggcattgtcagagcagtagacatggaagataaagttacgtggttacaagatggggtaatccaatgataagaatgtatacagttgagactgggcatgggggctcatgcctgtcaatcccaacactggaaggccaaggtgggtggatcacctgaagtcaggagttcaagaccaccctgaccaacatggagaaactctgtctctactaaaaatacaaaattagctgggcgtggtggcacatgcctgtaatcccagctactcgggaggctgaggcaggagaatcgcttgaaccccgggaggcggaggttgcggtgagctgagattaagccattgcactccagcctgggtgacagagtgagactccatctcaaaaaaaaaaaaaaaaaagaagaatgtatacagttgtgtacagtgaactgcacttcaagagaagctgaagactactgaggacagctatgggggaaaagtccttactcatctcttcctctccctgtagcacggtacccaagaataaaggaagggaaccaggctctgtttagttggaagagctggggtgattctgcatttctcttcacaccagtaatataagcatgattatcaacacccaccagattaaaaaagatcttgttggccaggcatgggaggtctcgcctataatcctagcacttttgggaggttgaggcaggcagatcacctgagatcaggagttcgagaccagcctgggcaacacggcgaaaccccatctctactaaaaatatgaaaattaaccaggcttggtggtaacgcgcctgtaatcccagctacttggtatcacttgaacctgggaggcagaggttgcagtaagtcaaccactgcactacaatcaggacaacagagcaagaccctgtctcaaaaaaaaaaaaagatgttgttcactgacagtgatccttgggtttgggcttatgtaagggaagaattattttgagctgtacacaccaataatgcaagttaaatggagctgcttatatattacaccttttttaagactgggtctcactctgttgcacaggctagaggtgcggtggtgcaatcatggttcactgcagcctcaacctaccgggctcaggcaatcctcccacctcagcctcccagtatcatctcactgcaacctctgcctcctgggttcaagcaattctcctgcctcagcctcctaagtagctgggattacaggtacccaccaccacgcctaatttttgtatttttagtagaggtggcgtttcaccaccttggccaggctggtctcgaactcctgacctcaggtgatccacccgcctcagcctccccaagtactgggattacaggcgtgagccaccgcgcccggcctaccctctatttggatgatacaacttcacagatctctaacttgcatttagtctaaatgtacaactgcctaagggacagattcacctgcttactctcagaagtaacctgtggaaatatacaaatttaggactcaaaacacaagttcctgttccagccctgccactaacaacctgtgtgatcctgggcatgtctagttttcagtttcatcactaaaatgggtcaagtgctaactgggtgtggtggctcatgcatgtaatcccagcactttgggaggccgaggggggtggatcgcacaccgtgcgatcaagtgatctatccacctcagactctcaaagtgctgggattacaggcatgagccaccgtgcccggtccacttgtcaggaatcttaaactctggagatctagtctccggggagggtactaaaaatatctgtaagtggcaactttacatgccttgtccctttagagaagcaattattttccaaggtctaattctgcatactgcaacaacagttaatgctgtattacattacttacatgaatatggataacgtgatgtttttgcacagacacaaagctacagctggaccactgttacatctatcattcatatgtatttatgtgaatttacaacatatgtttaaaattccagaaataaacaattcgtaagtcttaagattgcaacgcagttcttagtaccatgatgaaatcttgtgctatcctgcctgggacatgaatcattcccttttccagagtatccacactgtatatgctaccatgcccattagttatttagtagccttctcactgatcaacgtagtgtatacagggctcagtgctatcagcagtttcaggcatccactgggggccttacaatatatgcccctcagataatggggactacttcattgctgtaaatagctcatgataatattctatcactcatcagttcaagtatgtagaaaatgttgaaaatctttgtataattagaaagcatttttttttttttgagacagattcttgctctgtcgcccaggctggtgagcagtggcgtcattcctgctcactgcaacctccacctcccaggttcaagtgattctcccacctcagcctcccaagagtttaggattcctgagaagtgggccgggtgcaatggctcacgcctgtaatcccaccactttgggaggccaaggcggatggatcatttgcagccaagagtttgagaccagcctgaccgatatagtggaaccctgactctactgaaaattcaaaaaaattggccaggcgtggtggtgcatgactgcagtcccagctactcgggaggctgaagcaggagaatcacttgaacttgggagatggaggctgcagtgagctgagatcgcgccattgcactccagcctgggtgacagagcgagactctgtatcaaaaaaaaaaaaaaaaaatgacagtgtagactagggtttctcaacctcagcactactgacatattgacattggagctgcacaactgttgtggggggctatcctacgcactacaggctattgagcagcatccctggcctctacccactagataccagtaacactccccacaacaggttctaacacccaaaaaacgtctccagtcattgctaaatgctccaggggcaggaagaggcaatattaccataggttaagaaccactgagtagagtcagccttggtgtttatccttaccattcaaagagttctgaatacaaagtaaccaaccagtcacagaaacactttgctgagtagattcatgtatgactcagggtaaagttatgacctgagttttccagtctccttataaaatatcatattctccaaagggcaagagcaacacacccaaaacagaggcataccattttcatgccttgttcttgctggcagtctttaaggtttctaactgacaaagccagagaaaacatcatcacaggcaagagtaagtatactaagaccttagccaactctagaactgctgggtgtggttccttctggtggtggaggggtgggtgcttttatataccgttttgtcttaaggcagtgattgtgccagtagatacactgcaatacgcttaaggctgtttcagtgaaaatactatttaaatctaattaaccagaatactgggcaaattttatatttgtctgttgtagaaaatcttttcgccatagcacagaaggctgaacaaaaccatattttttgttgttgactaaggattgtgtaatgcttcataggtttacaaaaattatctatgactaaatggtactgaagattcagaaaatccaaggagagggctgaatctgaaaatgatgccaggctatatcacaagtggaggaaaaaaacctttttaatggaatgagctcagtaacacttttgtatctctttcctaagaataagaatgccaccaaaggtttgaattagctgtgttccttttttttttttttttttttttttgagacaaggtctcactctgttgcctaggctggagtgcagtggcaagaacaaggctcactgcagaaaaaagaaaaaaaaaaaggctcactgcagccaacttcctgggctcactccatcctctcacctcagcctcctgagtagccagaactacaggcctgcaacaccacgttggctaacttttttttaatttttttttgggtgggggggggcgtctcaccatgttggccaggctggtcttgaactcctgacctcaggtgatccacctgcctcagcctcccaaaatgctgggattacaggagtaaaccacagctcccggccaagtaaggatttcctaattagcgcctactataccaggaaagcctgtcttctaatctgttaacatacttcagctgtgaaatatatctaaggtgttctgacaatcgaaataccacgcaactgggccaggcgccgtggctcacacctgcaatcccagcactttgggaggccgagctaggaggatcacctgaggtcaggagttcaagatcagcctggcaaacatggtgaaaccccgtctctactaaaaatacaaaaattacccaggcgcggtggagggcgcctgtaatcccagctacctgggaggctgcggcaggagaatcgcttgaacctgggaggcggaggttgcagtgagcagagatcgcgccattgcactccaccctgggcgagagagcaagactccttctcaccagaagaaaaaaaaagaaaagaaaaagaaaattaagctagtacacaacaccacatctatcccgttacttctatttcatgaattctactacaatgaggtagtaaactgtagctaatacaataatgggccgggcacgatggctcacgcctgtaatcccagtacttgggaggccgaggagaggagggtggttcacctgaggtcaggagttcgagaccagcctggccaacgtggtgaaaccccgtttctactaaaaatacaaaaaattagctgggcctggtggcggatgtctataatcccagctactcgggaggctgacgcaggagaatcatttgaacccaggaggcggagggtgcagtgagccgagactgcgccactgtactccagtttaggtagcaaaaacgaaactccgtctcaaaaaaaaatagccgcgcatggtggagagcgcctgtaatcccagctacccgggaggatgaggcagaagaattgcttgaacccaggaagcggaggttgcaatcagccgagatcgcgccattgcactccagcctgggtgaccagagcaaaactccgtctcaaaaaataataataaaacaatgtgctggactactgcaatactgagatccttctcagccaagtgtttacaggtgttagagcggcaacaggaatttctggagtacaagctaatctctgtgggaatggaaaaaaaaaagcactaatttgaatttcagtacctatgttgcaatgctaaattcttgacagggattagtactccgtaggttatgcttcttaaatctccaaaagtaagccaatatgtgaaatcgtacatttttggtccgttattctaagactgacaaaacgttccattgcttcgtatttgaatttgagaactgagactcatttaaaaattcttcactgttcttttcctttttgctcttcgatttcgcaagtgaaacggtcatttcaacagcacacacattacactagaataaagccaagtaaaatgacagactaaatcagatccgtgaatacacggtgactccttatttggtttttaatactttcactatgtttcatgtcttcgggaaagcaaaagaacaacgtactgtgccaaaagcactaacttacgaaaaaccaatttagaccaattctttacagcgttaagtatgggttgaaaaccaactttcctaatacttgtggtcagtgcctcaaggtcgttaggataaaaataaagcttccaagacacttcgcagccttccagcacttccagaaaggccaaataaaccagcattcaccttcccgctccatccaggccccgattctccgaccagagagggcgctgagtgcccgggcacggaggggcagcgccctggggcgcccggctctgcccagggcggggctcggcggggccgaagctccggacgccgcccacggggaccaccggcccttgggccgcccaggggcagctgcagcccaggggaggagctggaggagcccccggcggcaccagggcccgagccctgacggcggccgcccccggccgaaaagtaaggaaggtgccgccctcgctggaccagctgggcccgaagaggggcccccccaccacaaattcggaaaccgagtgaccccggcgagggacgcgcggtcccagccccgggacgaggaagggcggcggcgcgggcgggggttcttttcagaactacagcagggaaggcggcgggggtggccgcggggcgatccagggaaaatcggcgcctcacctgctcctcttgaggcagctgctgccactcgctgaggggacaacatggagcctccgccttcaaagcagaagcagcaggggtgcagaggagagggacgggtgcgggcgggaacgaaccgggccctggaagcgggaaacgggcggagcctgggctctagaaaaaactagccagaaggtggggcacgcggagccgcgacggagcgagcgcagcgcggtctgcgtggcccaacggacagcccgaggcgtggcgagcgcaggacgaggctaggcgaggcggggcgggaaagcgcacgcggcagaatcccgccaccgcctgccgcgtgtgcgcgaagcgagccgccgggtacctgttggcggggcgctgagtgctaccgtcctttgggaattgtagtcccgcgctcactgggtcccggccagcggtcctcatactgcgcactcatctggggcggggcttggcgtggttctccgacgactgaactacaactcccagcaggctgtgcgggaaggggcgggctggctcgggtcctcctgcgagctgcggccggcgcctaacgtgcagaccaggccccaggccgaggctttatcctggaaccaccagtgtgagagacagctttggtgtttaactaggcctgggaccacaggtgggcagaagagaggcctcaaccctggatggcatgaacgtcactgggtctttaatgattttgacttcataagggcaggtggccgtgacttcattaccacctttattatcatctccctatattcctgtccctggccatggctgatgcgcaccatcaccgctctgatagctaatgtaagaagtccaggccgggcgccgtgcctcacgcctgtaatcccagcactttgggaggccgaggcgggtggatcacctgaggtcgtgggcgttcgagaccagcctgaccaacatggagaatccccgtctctactaaaaatacgaaattagccaggcgtagtggcgcacgcttgtaatcccagctagtccagaggctgaacaggagaatcgcttgaacccaggaggcggaggttgcagtgagccgagatcgcaccattgcacaccagcgtaggcaacaggagcaaaactccatcaaaaaaaaaaaaaaaaaacttgcacgcacatcccagcattctctgctccttttccctgcattacttttctccaaaagacttcataccacttggccaggcgcggtggctcacgcctgtaatcccagcactttgggaggctgaggtggttggatcacctgaggtcgggagttcaagaccagccaggctaacatggtgaaaccccatctcttctaaaaatacaaaaaattaaccaggcgtggtggcaggcgcctgtaatcccagctactcgggaggctgaggcaggagaggttgcattgagtggagatggcaccactgcactccagcctgggagaaagagcaagactccatctcaaaaaaaaaaaaaaaaaaaaagacttcctgctactatctgacttatgttttacctttcattgtgtttgtctcttcccactgaatgtaagttccaaacagataggaatttttgtctgttttgtttacttgtatatccccagtccctaaatactgctggcagataatagagactcaaatatctattgaattaatggatgaagaagatatatgttacatctaacactgctcactcactttctggttcctttaatattaaatacctaacttttactattgaacaaaataccctagtttattttaagggctccccagagattcactgaaatccaacttctcaggaagtgaccagcaaatactgatatatgtctcaatattacatcatcaaggtatcaaggtcaatgttagcacatcagcattgtagcccttgtagaagcttttggcatttggaacaaaacagtacaaattataggtggacttaaggattagtcacaacttagaaagcaacccctgtaaatgagaaacatgttttgtgttatttccttctcaaatatccagggtcatcaaaacactggacattgaaagtgccaaatattgacaatactggttacagcctgccttcagctatctcactctgaattgagttatgtgctatgatcagaggttgagcttcccttgaggttttccagaagtaggtgacatgtagacatatttgagtggacagactactggctttggggtcagacttacctggctctgatgttcactagctatgcaaccttgggcgagctacttaacctctctgaatccatttcatcatctgcaaaatgatttaaagacccacacggttgttctaggctaagtgagctgtgtgtttggaaatgatgactgcgtggttagtgatcaaaattagtaatcagcatattcattctggaaaagcaaaataaagtcataaatattcaagatactcaagtggtttatgaaacacaaaaatagcaaaattgttttctgcaatggcatccaccatgactcaggttccaaagctttccaaaaataggtcatttgttatatgccaggtaccgtgataggccataatgctgcataagacacattcctatcctccagagactcgcagtcctgtgggatagacagctgaggaaatatcattcactgtgactgtactgggacacagttcagctttctgccctctatgtgcaggatcattatttaagcaacttggaagggacaagttggaatactacatccctgggcatcatttaaatttccataccttattttgcatgtgtgtaaaatggggtaatgatttggcatcttcatttgtaaaaagaaaatagccaaccccacttgatagggtcttataaagttgaatattaggtcctcaacatggtaacatactgaaagcttaagaccttgtcagctacttcattattggtatttcagccaacagcacagcggtctaactgggaggatctcttgagcccaggagttcaagaccagtctgggggctgggggcagtggctcacacctgtaatccctacactttgggaggccgaggcaggtggatcacctgaggtcaggagttggagaccagcctggccaacatggtgaaatcccgtctgtactaaaaatacaaaaacttagccaagagtggtggcaggcacctgtaatcccagctactccagaggctgaggcaggagaatctcttgaacccgggaggcagtggttgcagcgagctgagatcctgccattgcatccagcctgggcaataagagcaaaattctgtcacaaacaaacaaacaaacaaaacggtctgggcaacatagggagatcccatgtctaccaaaaataaacaaataaattagccaggtatggtggggtacctgtggtcccagctacttgggaggctgaggtgggaggattgcttgagcctaggaggtagaggatgcagtgagccataattgtagcactgcattacagcctgagcaacagagcaaaccctacctccaaaaaaagaaagaaagaaagaaagaaagtgggggcgggggacagcgcacagtggctcatgcctgtaatcccagcactttgggagtctgaagcatatggatcacttaaggtcacaagttcaagaccagcctggccaacacagtgaaacactgtctctactaaaaatacaaaaattagccaggcatggtggtgtatgcttgtaatcccagcaacctgggaggccgaggcaggagtatggcttgaacccaggaggcagaggttgcagtgagccaagatcatgccaccactgcattccagcctgggtgacagagcgactccactaaaaaaaaaaaaaaaaaggcagtggggatgaggatacagatttgctatattcacctttgcttatgtttgccacaggaatatcctaatagtggccaggctcggtggctcacgcctgtaatcccagcattttgggaggccgaggcaggcagatcacgaggtcaggagatcgagaccatcctggctaacacggtgaaaccccgtctctactaaaaatacaaaaaattagctgggcgtggtggcgggtgcctgtagtcccagctacttgggaggctgaggcaggagaatggcgtgaacccaggaggcagagcttgcagtgagctgagatcgcagcattgcactccagcctgggcgacacagcaagactccatttcaaaaaaaaaaaaaagagaaaatcctaatagtagctacctatatgtgtgtagaggagtggagggagttagtgataaaactttacaatatatatattcctgaatatttgtgtacgtatatatgaatgatctgtgactacatatcaaatttttttttgagatagagtttcactctgtcgcccaggctggagtgcagtggcgcaatcttggctcactgcaacttttgcttcccagattgaagcgagtctcctgcctcagccttctgagtagctgggacaacaggcatgtgccaccaggctcggctaatttttttgtatttttagtagagacagggtttcacgatgttaggcaggctgttctccaactcctgacctcaggcagtctggctacctcggcctcccaaagtgctgggattacaggtgtgagccactgcgcccgcccttcaaatgtcttaatttaaaatatataatttttaaaaatttaaaaataaaataaaatatataattttttctaaaagtcaagaaaatatagggtaattagatggcttagaagttaaactgggaaattatctgtataggccgagcacagtggctcaagcctgtaatcccagcactttgggaggctgaggtgggccaatcaccagaggtcaggagttcaagaacagcctggccaacatggtgaaaccccatctctagtaaaaatataaaaattagctgggcttggtagcgtgcacctgtaatcctagccagtggggaggctgatgcaggagaattgcttgaactaaggaggcggaggttgcagtgagctgagatcatgccattgccctccagtgtgggcgacaagagcaaaactccgtctcgaaaataaagaaattatctgtataagataccagtcctggccaggagtggtggctcatgcctgtaatctcagcactttgggaggccgaggcgggtggatcacctgaggtcaggagttcgagaccagcctgaccaacatggagaaaccctgtctctactaaaaatacaaaattagccgggtgtggtggcacatgcctgtagtcccagctactccagaggctgaggcaggagaatcgcttgaatccgggaggcagaggttgcggtgagccaagatcgcaccattgcactccagcctggacaacaagagcaaaactccgtctcaaaaaaaaaaaataccagtccttactacgtactcacacatgcacacaaaaataccagtcctataaagacagggccaaagaataagagacctagcacagcgcctcaggtgttcaagggaacttcagagaaatggccatactccagtgtgctctttatttttctttctttttttttttttgagatggagtctcgctctgttgcccaggctggagcgcagtggcgcgatctcggctcactgcaggctccacctcccgggttcacaccattctgctgcctcagcctcctgagtagctgggactacaggtacccgccagtaagcccggctaattttttgtatttttagtagagacggggtttcactgtgttagccaggatggtctcgatctcctgacctcgtgatccacccacctcggcctcccaaagtgctgggattacaggcgtgagccaccgcgcctggagttattttatttttcaagatgaggtctcgctatattgtccaggctggtcttgaactcttgggcccaagccatcctcctgccttggcctctcaaagtgtagggattacagaggtgagccaccatgacagccagggagcactttaaaaattccatcttgggccgggcgcggtggctcacgcctgtaatcccaggactttgggaggctgaggcaggcagatcacgaggtcaggagtacaagaccagcctagccaacatggtgaaacctcgtctctactaaaaatataaaaattagccaggcatggtggcatgggcctgtagtcccagctactcgggaagctgaggcagaagaatcacttgaacccaggaggtggagggtgcagtcagctgagatcatgccactgcactccagcctgggtgacagagtgagactccatctcaaaaaaaaaaaaaatcccatcttggacaaaaaaaaggaaaaaaaaaatcccagctgagccatttcccaccaaaaacttccactcaatccccattattcttaagacaaagcctcagttctttggttcaatactactgcttctccaaaaactggccccaacatatcttcctcattttagatgttatccctatatcttccctcctgtcctaattcaagccttcagctccagccaatttggtctaaccaacacccaagacaccttatacacgctcacgtctgagcctttagccaccacatatggctgtacagtctgagtgttacaccaaggcagcttgtggagacaaggggcaagaggggatcaaatctaggtgaggttctgctagccaaatcagcatggaactgtatcatgggtggggctgggagaaagaggttcttttttgtgattcatctgcccagaagagtactttttttgtatacattcacaaaagcaacccctgtatttgcttcataccatccttttctgcttttaatgacttccttacaattccaaacacctatctaactttgagcatcttcacaaaacctcctggctgggcgcagtggctcacgcctgtaatcccagcactttgggaggccgaggcaggcagatcacgaggtcaggacatcgagaccatcctggctaacacagtgaaaccccgtctctactaaaaatacaaaaaattagccaggcacggtggcacgcacctgtagtcccagctactcgggaggctgaggcaggagaatcacttaaacctgggaggcagaggttgcagtgagccgagatcgcaccactgcactccagcctgggtgacagaaaaaaaaaaaaaacctccctaagccactacaacttcatggtaattccttcccctcgttgtttttgtttttgtttttgtttttgtttgaggtggagtctcactgtgttgcccaggctggagtgcagtggcatgatcttggctcattgcaacctctgcctcccaggctcaggtgattctcgtgcctcagcctcccgagtagctgggattacaggtacacaccactatgcctgggtaattttgtattttcagtagagatggggtttctccatgttggccagactagtctcaaacttttgacctcaggtgatccgcctaccttgccctcccaaagtgctgggattacaggcgtgagccactgcgcctggcccctctcttttaaattcatttaatttacttgccatctaatcaaagcactatggttttatggtgtttggggttgtttttagttgctatttaatttatattatttaactttatgtgagtatgttttttgtcctaactagcttgtaagctcattgaagacaagactaacatattttggaggtctcttcaaagttcccagaattgtgttatacacacagcacatgatcaatacacattcatagaactggccgggcacagtggctcacgcctataatcccaggtgtgggaaactgaggcaggaggatcacccgaggtcaggagttcaagaccaccctggccaacatggtgaaaccccgcctctactaaaaatacaaaaattagccggacatggaggcatgtgcctgtaatcccagctactcaggaggctgaaccagaactgcttgaacccgggaggcggaggttgcagtgagccaagatggcactactgcactccagcctgggcaatagagcaagactccatctcaaaaaaaaaaatgtctgaagggtctgaaaagaccagtaagaccacgtgcatatcttgctttttaacttctctgctgctacatattaggaaaatggacttccttccagctggagtctccagattgtagcaagtgctgtcagagttagctaccagcatcatttatttccttatctagcacttaataatgtagatttttgtttgtttgttttgttttaaggagcagagcgtttaatagacaagaaagaaggaaggaagaagaaaacagctcccctaataatgcgatttttaaaaaaacatatgcacgtatcagaatgggtagataactggcttggttatccgatctgctattatttccctttgccatccaagagacagtttgctgcattatcagctgatgcagtaagtgccagggtaaggtattagccacaaagttattttgggaaatatttttctatgcctttttcagagcattgcaaaggccaggagtcatcctcccaccccctggggctttacctgaccttaaaaactcaagggcagatgtagtacacagcttgttctagaagatttccactggtcagatcgcctttcccctcagtggcagcttggctgaccacctcccgcttcatgaggctgcatctttacaggatctgctgatcctgcaattgtactttgggtcatcgattgctgctttagcagtaacagtcgacagccttgatttttattatttccaggatacagtcctcctttttttttttttatttgacggagatttgctctttcacccaagctggagtgcaatggtgagatctctgctcactgcaacctctgcctcccgagttcaagcaattctcctgcctcagcctcccgagtagttgggattacaggcgcccgccactacccccagctaatttttgtatttttagtagagacagggtttcaccacattggccaggctgttcttgaactcctgacatcagatgatccacctgcctcggcctcccaaagtgctgggattacaggtgtgagccaccgcgcccagccaacagtcctcctttaacaaagactatgcacctttccaatattttgaccagatgtagggagaaggcttcgaatttggcaatccagcccaggaaaagcaaaaaatgaacaaaatccaatataggctagaaatctggttttaaatacatgttctgctaaggacctcttttagtctatgaataaaattcaattatgtgtattttgtgccttattctgattttttttacttttttttttttttttaaggcaggaaggttctcgctgtgtggcccaggctggactccaactcctgggctcaagtgatcctcccttctctgccgtagcagagactacgggcctctgccactgactgcggccttattctgaatttttaatatctaattttatcatcccccataatcacagccaacattttcttatctcctggctcttcttcatcagctcagcattttttttccctctctaaaatatgtcgtctctatctgacagtctattcggaggaaaagagaaccttaagacccaaggtggacccttctctggcaacagtaacgagataagaatacgaagcaggttctgcgactgcattgcaatgtgattggaatgagtaatcgtttttcattctgtatagcatctttctccacctaccaaatggggggccgtgccatctctgcctctcggtgaggagatattacgacacagccagtgagattcacaaagcaccttgcagagtgggcctactctacactctggttttcagtttttattggagtcacaggtgggaatgcatcaaacaaaagatataggctctggaatgtacgggaaagagagtttccataatggaagcccaaagacatttctaccgttaaaatacataatctgccgaccctaaaacattcacataaagaggcaggagggaatactatcccgcagctccacgattagccgcagtcgtgggcggggattggggcttggatacgccttttgcgtctggtccccaagggacgctccccaaccctcggcgcgcgaggcgccgcgtgaggccggctttgcccctccttccctgcaagagcgcagaggagcggttcttgcgcctgcgccctgcgccgctgcgcgctttggcacccgcttggggccctttgtgcgcatgcgcgctcgcgctcccgccctctagctgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcgggtaaggcgcgcggggagcccccgccctgggaaagagggcgagcgggagcctgggggctggggggattaggaggcgaggcgggaggaggacgaattaccctcgactactgacggcttcagccccccggggacgagcgtttggaaaatgggcaaaggggaaggggaacgtaaggttgtgcaggcggtgaggaaatagcggggtgtgaggaaaacaggttgggggcggggagatagtccagtgggcgttaacgccaagactgggcaggtggggaaaaataccagctcgtgggataaaatggagagttgctcgatgcatatggtgaacctgggtgatttagtgaggattagagagattgaaaggatacgggcaggtgggtggtgggagaaacaatttgttactatttttgaggggatggtggtgaaagggttgcattgcaggtttgcagacaggtgttgacataatcaagcattcatgatagtcctccaaaatatttttggctgcccatgggaaggatgaggaagtttaatggaagcattgtagcctgttttttttgtttgtttgttttgtttttactgttttcggctagactccatgaatgccggatttttctgaggctccgaggtagaaggaggcgtgatgagaatagctcagggaagatttgggagggagctgctaatggtccaagatggatccgtggctgcatctgcaacagcctgctcttccctggcgctgcgtgggggtggggacacgcaatcagtcgcttatattctagaaaatagagtcatgctaagctatcaacatgttttgatttcatgttttctgtgggctactattgatcgaagtataacaaaggggggtgtttattgcagaaagggggagggggagaacattcagacaaagcaagggctggttgagtccccttctcccatctctgtgaaagactaagaacgaagctgcagacctcctttagtttgcattgtatacgcgtctgcctgctggtaagagctgcctggcaagctccccttatgcagaaatctgcagtgcagatgccttcttaaggggggaaaaaaaaaccaccatgggcaggtggtagttctcaaaggaacggagtctttgaagggaaaaaaaatgccttttgtcaaaggcagggccgtaaattcgggagagtagagataattttgctctctatttagttatgttaaaggattttgatcatttttttttaatgcttcgttgtctcctttggcagaatcttgggttctaaagaaaaaatttctgatcttaaccttaaatgtattattctctacgtgtttttctagcagtgaattttcacctgtctgagagctttggagccctgttggattttttcagtgtggttatggccatttcagtagaaacaggcagtatcaggaagcttttgcagataaaagaatgaggcagcaaatttagaaccctgtctcctttaaaccaccagccttttctccaaatttttgtgttctgggctaaggtccagatgaacagcgacttccttataacttagcaacttgatctttttgctttaatcacttgtcattgcttactgtttggtaggcccttttgtacttaccttttgggttttcttgatttttcatttttgattcagacctaagttttagaaatttggctctgtaagctcaagataagacagatgttaagtgttgaagagtcattttagttagcagatttgaaaatttagtcctagtttgtttataactaaatggtgaaatcatttgagattcaactttttcattcttttaatgcacttatggaagaactggcctagtaggccaatgaaataagagtattttgttcacagacacacaggcataccacaacctaattggcacctaaattggcaatacgaatttaatgacataacatatttctgtttggcttacctttttttatgtcatctacccttgtcacaatttttatctatttattgtgtattttttgcacttctctttataatagtggaaaaggtgctgaaattatgtgttttgtcgaaagtagtagaattatatcgtgaagtgctgttccaagtacatgagtttgcattacattttccgaataatattaaatgccgcggtttccactcgttatttctttctcttttcttttctttctttttttttttttttttttttttttttttagacaaggtcttgctctgtcacagactggagtgcagtggagccatcttggctcactgcaacctccatctccggggttcaaatgattctcatgcttcagccacccgagtagctggaattacaggcgtgtgccaccacgcgtggttaattttcttttggtttttttttttttttttttttttttggttttttttttgagacggagtctcgctttgtcgcccaggctggagtgcagtggtgcgatctcagctcactgcaacctccatctcccaggttcatgccattctcctgcctcagcttcccagtagctgggactacaggtgcccaccaccatgcccggctaattttttgtatttttagtagaaacagggtttcacagtgttagccaggatggtcttgatctcctgacctcgtgatccgcccacctcggcctcccaaaatgctgggaatacaggcatgagccaccacacacggcccacacctggttaatttttatatctttggtagagatggggttttgccatgttggccaggctggtctcaaactcctggcctcatgtgatctgccctcctcggcctcccaaagtgctgggattacagatgggagccactgtgaccagctttacccattatttcttagtaaaattttattacagaatttgtatttcttagatgtgctgtagacacgtatcactattagcacttaaaacagtgatatatagtagtacttggtaagtatttgttgaataaattatcaaatttacgagctagaaaggcacacttgagaaataaactaaagagaaactctttttggagtctcgctctgtagcccaggctggagtgcagtggtgtgatcttggctcactgcaacctctgtctcctgggctcaaaccattctcccaccttagcctcctgagtaggtgggattacagacatgcaccaccacgcccagataatttttgtacttttactagatatggggttttgccatgttggccaggctggtcttgaactcctgacctcaagtgatccgcccacctcggcctcccaaggtgttgggattacaggcatgagccactgagcccagccaagagactcttatcttaaatgcttatccattgcaaatgtgcattcatattgtctaaaaagcactaatacagttttggtgggcccaatgcaagatcctcatttgttgggtcactacttgaacataaaagtttaccttaagatactgcagtgtggggccaggcacgcttgctcactcctgtaatcccaacactttgggaggctgaggtggttggatcacctgaggtcaggagttagagaccagcctgaacaacatggtggaaccctgtctctactaaaaaatacaaaaattagccgggcacagtgacgggcacctgtagtctcagctactcgggaggctgagacaggaaaatcacttgaacccaggaggcgggagttgcagtgagctgagatcacaccatggcactccagcctaggcgacacagcaagactccatctcaaaaaaaaaaaaaagttactgcaatgtgttgtaatcatttttattgcagaagcctttcctccttgctggatgtttttcttcatgtcacaaaggaagtgtctcaggcttttgcaccatgaaaataagatgaagtttgttattccaaaatttaacttatttaaaatgtagatgctaaaaaattaccttaattgtttaaaaaaaaaatctgtacgtattgctgtcatcctccagcttcatgttctttcaccaagctcctcttggttttggagacttgtcttgattttagttaaagaaaaataagtgattggttggtgtcctacagaaaacaattttgtcttgactgacctgtccagtaattaattttagaagtattagttactatatacaggtcaagaatgagtgatggcactctgtactttagtgccttaggttctaatgcagccagcaatgtagtatgcttagagatggggatcaggggtcaggatggcttcccagatttctgcctttgaaggaaactgaagatatcagaggcaaaaatttgaggttgaggtaaaagagactgaaatattcagtgttcatttcagagcaagagttgcctttattaggcctcaagtatagagacacgtctatcatctgaactttaaaagtactttaatagtttactgatgacacgatgttgaaattctgtaacttggccgggcacggtggctcacgcctgtaatcctagcactttgggaggccgaggcaggcggatcacgaggtcaggagatcgagatcatcctggctaacatggtgaaaccctgtctctactaaaaatacaaaaaattagccgggcgtggtggcggggcgcctgtagtcccagctactcgggaggctgaggcaggagaatggcgtgaacccaggaggcggagcttgcagtgagcctagattgcaccactgcactccggcctgggggacagagcgagactccgtctcaaaaaaaaaaaaaaaaaaaagaacaaattctatacttgctagagactgctttttattgttgttatgaaagttggctgagtctggtggctcacacctgtaatcccagcactttgggaggctgaggtgggtggcttgcttgagctcacgagtttgagaccagcctggacaatagtggtgaaaccccatctctacaaaaagacaaaaaagcaagaattagctgagcatggtgatgtgcgcctgtggtcccagccacttaggagactgaggtaggaggatggcttgagctgggggcagaggttgcagtgagctgagattgtgccattgcactccagcctgggtgactgagccagaacttgtcttaaaaaaaagaaaagaaaaggaaaaaagaaaatcatgatgccaaaataaaactacattttatatgtttgttcatggaaattagctcaaagcaaaaacagcttgggcaattttttgaaaaaggttttgctttaaatatttctttcctcactcatgaaacttagttgttctgtgtactttttatggcttcattttcacactttgttctaccatattaatcaaatgtgaatatgtaatttgtgttttgagttaacccttaaataaaaaggaatgtggcccccgtccaacactgacatcatctgagtgttacattcgtgtcagattatcagtggcagtgtaatgtgttaaaacacagacttgagctccaggaatgcctagatttcaatcctggccctgtctcttaataattatgtgatcttgtgcaagtcctgagcctcagtttccttaacttgaaaattgggataatagtatctatcttggagttggtatgaaaattaaacacaatttggctgggcacggtggcccacgcctgtaatcacagcactttgggaggccaaggcgggtggatcatctgaggtcaagagttcgagaccagcctggccaacatggtgaaaccctgcctctattaaagatacaaaaaattagctgggtgtaatcctgtaatcccagctactcaggaggctgaggcaggagaatcacttgaacccaggaggtggaggttgcagtgagccaagatagcgccattgcactccagcctgagcaacagggtgagactccatctaaaaaaaaaaaaaaagtgaacacatttatagggcttaacacagtgtcttgcctgtagtaaataactgtaccattaatgtgaagaaatgaaatatagatcaacaatgtgacctagacacatttgctttgtacccttaaatcctgacctttattaaataacaatacctaatgtttgacatccatttgtaggttacaaactacttgcacatattaatagataccacatagcagttcaagtacaaatgagaaatctgtcttcctcacaatcaaagactattgttatgccttttttccctttccacatgtgagtcagttgtttcagtttgtggcccttcacattaatgtcataaagctgccacccgcttccactgaggtggtctgttaaagaggtagagggaggagtcaagatgtttcccagaaggcttggcatgaatcaatatgcttaaatacttatgcagattctgactaataaatgttgttatgatacattaggaaacccctttcagcacagaggcaagcatacaggagacagcaagaatggtcatgtcaatatggcctgcaaatgcctgctgacttggattgtttttattctccaagaataagaagtgtgttttgcttttttttttttttttttgagacggagtctcgctctgtcgcccaggcgggagtgcagtggtgcgatctcagctcactgcaacctccatctcccaggttcatgccattctcctgcctcagcttcccagtagctgggactacaggtgcccaccaccacgcctggctaattttttgtgtttttagtagagacagggtttcaccatgttagccaggatggtcttgatctcctgacctcatgatccgccagccttggcttcccaaagtgctgggattacaggcgtgagccaccacgcccggccaagaagtttttttttaatgctgtttttgtttattgtcaaattcacaagtaatggaaccactctgatcaaattaaacaaccaatctacatacatttagtaggtgcacccttaccctaaattgtcatttctaaggggttgttcattaagtggctggtaagaacctcagtgtttttattcttggtgttttaaagatgggctgaaaataaaaaccaatattactgcttttatcaaattatcctgtgaggaaataatatatttatcctgatataggagttacctgtctagtcctgtgcatgtttcaagccttgtaaaatgaagtttggtcatgaaggaattggtgacgtctggttgaagggaaaagggaaagttgagctttccaattttgtttgagtcaagagtatattttgcagaaagacacttctctttacccataatcctagaatttaccatttttgtaattctgaacagaattacaaaggcttcattaagtaagtaggttttctaatataaatgtgcatatttgttgtgtgcacttagcttatagtttgtgttaactttattgttgatgatgaatttagcctcctaaagtatacaaacttgtgaaaaattcatcaattttgtagtataactttttctcttaatttagctaatactctttgtattgttctaattttggtatatgtgctgctgaagtaagcactcatagtaaaactttttagacaaaaattagcaggtcgatattttgttcttataattgacttattcagaagttgcccagaaaactgacttaaccttctattctgttcatttatgacagctactagttgtagagttattttggatcatagggtatggtgttgatgttttgaaagaagtgtgtgtgttaaataagtttagctgtaatcagtattgcttgtgattgcatcattgaagtcttctgggcatctgtgagttttgtaagacatgttactctgtgatattgcaacctcagagagaatctctttaaatactgtaacggggtttgcatttccattttacgtatgggagaagattatcagcaagtggcctgctcttgtgattttttttttttatttcaaataactattcttacctgttttctccaatcaactgatttattatctcctataaccatatcattgtaacctaaccagagaagacagtgagcttatcagcaagtggcccactcttgtgatttttgatttttttttttttatttcaaagaactatttttttgagacagaatccccctctgttgctcaggctggagtgcagtggtgggatctctgctcactgcaacctccgccccccgggttcaagcgattctcctgcctcagccccctgagtaggtgggattgcaggcttgtgccaccatgcccagctaatttttgtatttttagtagagatggggtttcaccatgttggtcaggctggtcccgaactcctgacctcaagtgaactgcccccgcctcggcctcccacagtgctgggattacagatgtgagccaccacacccagtctcaaagaactattcttacctgttttctccaatcaactgatttattatctcctgtaaccatatcatcataacttaaccagagggaacggtgagctttttgacctgttcctcattggtagctcgcccttcaagatatatggaaggacattctggaaaaccttttgttatgaaaattgtgtcctgttatttgaacatatttcagtggagggcattgtctttattttacgtatgagatagaagtacttgattttcacgatatcttacatttgtgtactgctttatgatttaagttgtgcccatatgttaccttaattcaacaactgagcatacatgaaggctctttgccaggtgctgtggaagacagaaaggtaaataaaatatagatcattcctctagaggccatattctatagaggaaagacttgtattatgtttatctgtgaggtagacaggtagcgatataacccccttcttacagatggggactcaggcacagagagtttaatgcccacgctttaagatttgaagcaacatgtagtaaaagtggctcagttacccttttgaattcagtgatcagtttaatttaaaagtcttaatttctggctccacggttcttaagccaggtgcctttttatttcactgctctacagaaactttctagtcaagttcaccagatattttccacattgttaaattcagtggtcacttcatcctcctcttaacatgctttcacaacagcttttgacataattgattattctctccttgaaatgcttttttaatttgtcttctgtgacaccacatactcactctcactggcttttcatcctctgtctccataaaattcaccattttaaggtgggttttagtgtatgcacaaggttgtacagctatctccactatctaattccagaacatttttattaccccaaagagaaaccccatatctgttagcagtaattcaccgttcttccctcccctcaattctctgacaactattaatctgctttctgactctgtggatttccttattcttgagatttaatattgctaattcttttttttttttttttttttttttgagatggagtctcactctgtcacccagggtggagtgcagtggcacgatctctgctcactgcaccatccgcctcctggattcaagcgattctcctgcttcagcctcccaagtagctgggattataggcatgtgccaccatgcccagctaatttttgtatttttagtagaggcagggtttcaccatgttggtcaggctggtcttgaactcctgacctcaggagatccaccctccttggcctcctaaaatgctgggattacaggtgtgagctactgcgtccgacctaattatttttattttgatagagacgaggtctcactatgttgcctaggctggtattgaactcctgggctcaagcgatcctcctgccttagcctctcaaagtgctgggattataggcatgagccacagtgcctgtcccaatctttccttttaagttcgttcttctcacagtcttctcaatctcaataaatggccattctgttctttccttcttttgctcaaatcaaaaaccttggagttatccttgattcctttctgtccctcatagaagccatcagcaaatgctcttgattctaccttcaaaaagatatccaaagtctgaccaattctgtcaatctccattgctaccaccctggtccaggctagctctcttgggttattgtagatgccgcctatctggtctccctgctttctcctttgcctctcttcagtccattttccacacagcagctggtataagcctgtgaaaatgcaagttggatcatgtcacttatgggccaagtgctacagtggcttcctgttacactccgtaaatgctgatatcctcagaagacttattaataaataccctgtaatatctggcctcaacctccccctttctcacctggcttcaaccatactggcctctttgtctcactctgttgcccaggctggagtgcagtggcgcgatcttggctcacttcaaactctgcctcccaggttcaagcaatcctctcacctcagcctcccaagtagctggtattacaggtgcgcacctccatgcctggctgatttttgtattgttagtagagacaggatttcaccatgttggtcagactggttttgaactcctgacctcaagtcgtccatcaacctcggcctccaaaagtgctgggattacaggcatgagccactgtgcccaggtttccttgttctttacaccagaaataaccctctacctcggggttttatttgctgttcactctgcctagaatgctcttctctcattgcagtagactcaatgtttatgtccccacccctgcaacccggccaaatcatatgttaaaacctaaccccctggccgggcgcggtggctcatgcctgtaatcccagcactttgggaggctgaggcagacagatcacgaggtcaggagatggagaccatcctggctaacatggtgaaaccctgtctctactaaaaatacaaaaaaaaattagctgggcgtggtggcatgcgcctgtagttccagctactcgggagactgaggcaggagaatcgcttgaacctgggaggcggaggttgcaataagccgagatcatgccactgcacttcagcctgggtgacagagcgagactccgtctcaaaaaaaaaaaaacaccttcagaaggaaggaatgcttttatagaccactttggttttcttttttgcatgtcatgtggcagttttaagttattaaaataagtactttttaatgggaacaacttgaccaaatttgtcacaatttgtcacagaattttgagacctattaaaaaagttcaatgagaaagaaaaaaagagagatggggtctcaccatattgcccatgctggtcttgactgaattcctgagtgcaagagatcctccttccttggcttctcgatgtgctgggattacaggcataagccaccatgcccagcttccttattggttttgtccagcaactaaaacaagcccttggctcataagaggtgttcaataaatatttatgggaagaatgagtggagaaactcttcccagaaaaacatgcatattaacaaagtattgtggccagatgcagtggctcacgcctgtaatcccagcactttgggaggccgaggcgagcggatcacctgaggtcaggagttcgagaccagcctgaccaacatggagaaacgccatctctactaaaaatacaaaattagctgggcatggtggcacatgcctgtaatcccagctacttgggaaggctgaggcaggagaatcacttgaacctgggaggtcgaggttgtggtgagccgagatcgcaccattgtactccagcctgggcaacaagagcaaaactccatctcaaaaaaaaaaagtattgcatagttttcacagggttcatgaactgctgtcaaattcattcataaactttaggttaagaacatttggtttttgaaagtcaaattgtaaactttgttacatgcttataattcgtaatttctataagacctctatggaaatggatgtatccatttaagtgctgaggagagagttttcctgtaagcccataaaactgtatctgtaatagaaatatgtttaaggttagcctcttttatttcttctggactgtaggtattttctactaacaactttaatccagaaaaacatcttttcataaccacttgaatgccacattctggcatattagaaagagactctggccgggcacagtggctcatgcctgtaatctcagcactttgggaggccaagatgggaggattgcttgagcccaggagtttgaaaccagcctgcacaacataatgaaaccccatctctacaaaaattaaaaataatctgggtgtggtggtatatgcctgtagtcccagctccttaggaggctgaggtgggagtatcacttgggccctcaaggtcgaggctgcagtgattgcactaccactgcactccatcctgggcaacagaagacagaagaccctgtctcaaaaaaaagaaggctggggtattaagatatatttgtaaccagtttattaattaattatggttttttttttttctgaaatggaattttgttcttgttgcccaggctggagtgcaatggcgtgatctcggctcactgcaacctccgcctcccgggttcaagcaattctcctgcctcagcctcccaagtagctgggattacaggcatgcgccaccacgtccggctaattttgtatttttagtagagacggggtttctccatgttggtcaggctgctcttgaactcctgacctcaggtgatcttcctgctttggcctcccaaagtgctgggattacaggtgtgagccactgcgcctggccttttaatttacttttaagacaaggcatggctctgtcacccagtctggagtgcagtggcatgatatcggctcactacaacgtccatgtcctgggctcaagccgtcctcccacctcagcctccggagtagctaggactgtaggcgtggctattttttgtatttttctagagacgaggtttcaccatgttgcccaggctgatcttgacctcataagctcaagtgatcctcccacctcagcctcccaacgtgctgggatcacacgagtgagccagcgcgcccaacctttaaccaatttcatatctacatagtccattttgtttctgtcaggctttctaattttcttttgcaacaagagttctgctttgttcttcctcttagattgcatatgcatttactctaataaatggtgcaaagaaagctttccagctctttttagtgatgtaacagaagagtgggcatcttggaaattagcactgttttgacttatatgagagggaactgctgtcttagtaactactacattaataagacaaatgtccagttactagttactactcagtctagttttgaaataacaagctaaatctaaaaatctcttagagtttgggtttcagcaaacatttatgaagctcctgtaatattcaaacctccatattctgtgatttctgctatatgctggtcaatctgaaagatacgaagatatgtaagagggctttaaccctcaggtgcttccaatcagtttgtaattattttccaacaataaataaattgaatttatttcattagatattttgagaactaagatattaataatttttttcttttttttccccctgaaattcctgagcttcaactagttggtctgtttttatagtagttatgttagctataaatgaataaataaaaatcagcctgccagtttatgtagattctcccctcgaggaggtggagcttaactcctccaccacttaggggtggatgatgagcttaatgacttgtttccacagagtacagtgtggaagggtggggagaagtactgcttcctccaaccaggtggagaatcctggcaagcactacctcagccagggatcaggttaacatcatcagttgataagtcatgttgatagtctgtactcttgatatgctgtgatgagcatggcccttggtattcttcccgaaaagccatcactccagtctaaccatgagaaaaacatctgacaaattcaaattgagggacattctgtaaaatatctgaccagagtcttattaaaactgtcaagagaagtctgagaagctgacagtccagaaaaggctaaggagacatgatgacaaaatgtgatatggtatcctggataggatcttgggaagagaaaaggggcgttagggaaaaattaaaggggatcaagaaagaaggacagagtgagaccttacttctctaaaaaataataaatagtaagtaaaaattacctttgtaatattcttttttattagaatacgatgaacatctcttagtgtcaataaattcccatctacaacccagttgttaatgacttatcctattgtttggatatatgaaacttaaacggtctaattattagacctttgttaagtttcctttaaaaaaaaaaaaaaaacctattttaaggaatattgtgatgaggccgggcctggtggctcatgcctgtaatcctagcactttgggaggcttaggcggacagatcttgaggtcaggagcaacatggtgaaaccccgtctctactaaaaatagaaaaattagccagacgtgatggtgcgtacctgtaatcccagctactcaggaggctgaggcaggagaatcacttgaacctgggaggtggaggttgcagtgagccgagatcacaccactgcactccagcctgggcaacaaaacaagactctgtctcaaaaggaaaaaaaaagaatattgtgatgaagccaggtgcggtggctcacgcctgtaatcccagcacttcgggaggctaaggtaggaggatggcttgagcccaggagttcaagaccagcttggataacatagtggggccctgtcactatttttttttttttttttttggagacggagtcttgctctgttgcccacgttggagtacagtggtgccatcttggctcactgcaacctccacctcccgggttcaagcaattctcctgcctcagcctcccgagtagctgggattacaggtgcctgcctccacacccagctaatttttgtatttttagtagagacagggtttcaccatggttggccaggctggtctcgaactcctgacctcaggtgatccaccctccttggcctcccaaagtgctgggattacaggcttgagccaccacacctggcccctgttgctattttctttctttctttctttctttctttttttttttttttttttttgagatggagtcttgctctgtcgcccaggctggagtgcagtggcgtgatcttggctcacggcaaactccgcctcccgggttcacgccattctcctgcctcagcctcctgagtagctgggactacagacgcctgccaccatacccgactaattttttgtatttttagtagagatggggtttcaccatgttagccaaggtggtcttgatctcctgacctcgtgatctgtccgcctcggcctcccaaagtgctgggattacaggcgtgagccatcgcgcccggccccgttgctattttaagaaaattttaaaaataagaatatcgtgatgaataatcttatagccacatatttgcactggttatttattggaattagattttcagcaggtccacttatgctttttttttatttttatttttttttgagatagagcctcactctgtcgcccaggctggggtgcagtggttccatctcagctcactgcaacctccgtgtcccagattcaagcaattctcctgcctcagcctcccaagtcaagtagctgggatatgtgccaccacacccagctcattattattattattattattttgagacgaagtttcactcttatcccccaggctggagtgcaatggtgcgatactggctcactgcaacctctgcctcctgggttcaagcagttctcctaccttggcctcccgagtagctgggattatgggcacctgccaccacgcctggctaatttttgtatttttagtagagacagggtttcactatgttggccaggctgttcttgaactccttccctcaggtgacctgcccgccttggcctcccaaagtgctggcattacaggcgagagccaccgcgcccggcccacctgtgctttttcaatcccatatcttctagcaattttgtgggctttgttccagaaaaaattgtttcttttttatgtattttcagacttttttcttcattggctcctttctgtctttctgtaaatatacttgtcattttcatttctaaaaaactttccctcaacgttgcctctccctatagctgctgcccagtttttagttcttccctttatcacccgtatttcccatactttttgttttcagtgttttttaaacttaccttcactcctcagtcttcagtgtctgttccctccccctctaccactctcattttagtcatcaatgcgaaattaatttctgtgacccttttcatagtctttttttttttttctttaaaacagtgtctcactcttgcccaggtgccatggctcaatctcagctcactgccacctccgcttcctgggctcaagtgatcctttcagctcagtccccccaagtagctgggactacaggagcaagccagcatgcctggttaatttttgtatttttttgtagagatgggatttcaccatgttgcccaggctggtctcaaactgctgaggtcaagccatccacctgctttggcctcccaaagtgctgggattacaggcatcagctactgcgtctgattgtttttcatagtcttaatttagccattcaatggctttgactcttaaccattctctaaagcattctccaaatggcaccattttttcctttcttgacttctttctgttttcttcactggtctttctttcttgatcccctttaaatacacatattttaaaatttctcttcatgccatctggtaagatcaagtggccaatctcagcatacctgggaaacttaacatgatctaagatcactgaggaaccattgactccagatactgtcttgtacatgaggcaaggctgggagaggttgttccgactgactgccagcacctgctcccgagctcctaccactggcccctttaaatattgagatacctcaagattcttttgtaaaacttctgtatttcttcctggatgaaggtattcactgcagtggtgtcagttctcacccaaatgttaattcccagatatttatctacagcatttacctctctcctgagcctgtccctattactgcactgcctgttcaacagttgccacttatatatgccttaggcaacttttttatattgaaagttaataatataagggattcctggccgggcacagtggctcacgcctgtaatccgaacactttgggaggccaaggtgggcgggtcactttaggtcaggagtttgagaccagcctgccagcatggtgaaaccccactaaaaatacaaaacccctactaaaaatacaaaaattagccgtgtgtggtagcatgcacctgtaatcccagctactcagcaggctgaggcatgagaatcacttgaacctgggaggcggaggttgcagtgagctgaaatcacaccactgtactccagcctgggcgggcgacagagctgagactccttctcaaaaaaaaaaaaaagaattccttctgtgttcccaaccatggcatttcatttagtccctcagtgatcttttacttctccagtctttaacatccaggcagatggtctcaagacctgtcttctctcttgtcagcagtcctctcattcccatcctcactgccttagtgcgagcccttatctcttgccaagattatgcagtagcttttcagttccgtccatgctctaccctgctgccagagttctttctaaaacacgtgatattgtcacacccttacttaaaaaccttcagtgattccttattacacaaaggatataatccagattacatggcatttaaagccatttggaatctggccaattgttccttctccccagaatgcctttcccttccttgttcacctcatgaacttaaatctttaaaaccaagcttaccacctcttctgaaacattcttaatttaccatagtggctgtctctgctgcattcccacaactcatacagttttactggtgcatatttgattttcagctacttgtgggcactgtattaccagtactaacacaggtcctggacttcgctacttaatgaaaatggtttcattaatggcatttgaggattaagatcattctggggttcagttccctgtgacacaaatacagaatatgaatacaatgtggttttgtaagttagaaacctcatggaatattgtaccagccattaccagttatctgtgttctgcatctgcataacaatttgcatgttgaaattttccattaggagggagtggtgttaggtgaaggtgaaaaggcaaacagctggcatgctcataggctcttctttggcattgggcttgaagtatttggtttttcaggtttgttgggatttaaacgcatcattggcagagatttaatgttgatagtaaatgcatgtagaaatggatccatctggaaacatagagataggaaaacatgattcttttactttttttttttaaggtaaggtctcactctgttgcccaggctggagtacagtggtgtgatcacggttcactgcagcctcagcttcctggcctcaaataatcctcttacctcagccttccaagtagctgggactataggctcatgccaccacacccagctaattttttttttttttaattttttgtggagacaggatctcaccatgttgcccaggctggtcttgagctcctgggcgcaagcggtccacctgcctcagcctcccaaagtgtggggattacaggcgtgagccacctcacctgacctgtttccctgcccccatcctttttatttttttttttttgagatggagtctcactttgtcacccaggctggagtgcagtggcatgatctcagctcactgcaactgccctctcctaggctcaaatggtccttccacctcagcctcctgagaagtaaaggattaattgaaatgttattttttatttgatcttcttcattggtcactgtgtatcctgataagaattttcaggccaggcttggtggctcacacctgtaatcccagcactttgggaggctgaggcgtgcggatcacgaggtcaggacatcgagaccatcctggccaacatggtgaaaccctgtctctactgaaatacaaaaaattagccaggtgtggtggtgcgcgcctgtagtcccagctactcgggaggctgaggcaggagaatcgcatgaacccaggaggcagaggttgcagtgatccgagattgcgccactgccctccatcctggtgacagagcgagactccttctcaaaaaaaaaaaaaaagaattttcagcttttagtgctcatatataatttgtttcttacagtacttctcttccaaatttttatactttctaaacccttgctgtttgaagtattgatatcattttgttgtttctgtttttttcctgatatcaaatgtacagctcttttccagaatgtcatatagttggactgggccagtatgttgccctttcatactggtttctttcacagaccaataagcatttaaggttccttcatgtctttctgtgtcttgatagctcattctagaatatcttttaacatctcaatttctaaatttaatcagctaaaaagtcccatattttatttaaatcatctacataaagtataatgaaactcagggtatgagccagagagtaaaatttctctctatttgtgaacagttctacaggctttatagggagcaaagtgccggaggctcctcagtttctggggaggcttcaggaagcttccaatcatgcagaagacacagggggcacaggcatgtcacatggcaaaaacaggagcaagagagctacccttgattaaagtatcacttagacctgggtgtggtggctcatgcttgtaatcgcagcactttgggaggctgagtgggaggactgcttgagcccaggagttcaagaccagcctaagcaacatggcgacacctgtctccagaaaaaaataaaaaattatctgggcgtagtggtgcacacctgtagtcagtgctactcgggaggctgaggcaggaagatcacttgagcccaggaggtcaaggatgcagtaagctgtgatcatgtcagtgcactgggcagcagagtgaaactttgtctcaaaaataaataaataaggaaaggacaattttttaatttgtaggagtagatgtggtacttcattttcatataattaaaaagcagctttatatttgaaactaaatagttttcatgaattagtacttatagctatagccctgtcctttaaagcaatcttctagcttaaatatatttctaatatttgtgaaaatatttttataattgcaagataaaagggagttaatatgtaaagttcagtatttagggacaattttggagggttttgtttttcacatggcttttttattcttttttcatcatttttattgaaaaagtcattttatgttcttagtgtgtggtttttttgtgtttttggttttggttttttttgtttttttgtttttttgttttttttttgagacagagtctcgccctgtcgcccaggctggagtgcaatggcgtgatctcagctcactgtaacctctgccacccgggttcaagtgattctcctgcctcagccttcggagtagctgggattacaggcacgtgccaccacgcctggctaattttttgtatctttagtagagacagagtttcaccatgttggccaggctggtcttgaactcctgacctcatgatccatctgcctccacctcccaaagtgctgggattacaggcatgagccactgcgcccggccgtccctttgttacttaacaaatgggagcacactgctttttaagcacactgcactttgtttttgtttttttgtttttttgtttttttttttgagacggagtcttgctctgttgcccaggctggagtgcaatggcgtgatctcggctcactgcaaactccgcctcctgggttcacgccattctcctgcctcagcttcctgagtagctgggactacaggtgcccgccaccacgcccagctaattttttgtatttttagtagagacggggtttcaccgtgttagccaggatggtctcaacctcctgacctcgtgatctgcctgcctcggcctcccaaagtgctgggattacaggtgtgagccactgcgcctggcctgcactttgctttttgagtttaattcgtagatggactatgtctacgtatacacttagcctaccttatctcaggttctacatctgtggattcaaccaattgtggaccaaaaatatttttttaaaaaacaacaataaaaaaaaacacaatttttaaaaacaatacagtgtaacaactatttacatagcatttacgttgtattaggtgtctaaagaatacttaaagtataagggatgatgtgtgtaggttatatgcaaatactatgccattttatacacaggacttgagcatcttcagattttggtggtggggggtggtggttttagaaccaatccccctcagataccaaggtatagctgtacctcattctttttcatggcagcaagtgtttcatagtttgcatgtaactttaaaaaaaaataactttaggggccgtgctagtcttctgtgtatccctccagttttagtatatgtgttgccaaagcaagtgataggtgtaactttagagtattcctaatatttataaccagagcttttatgaatatcttcatacacatattttttttcttttttttttttttgagacgtctcactctgtctcccaggctggagtgcagtggcgcgatctcggctcactgcaagctccacctcccaggttcacgccattctcctgcctcagcctcccgagtagctgggactacaggcgcccgccaccacgcctggctaattttttgtatttttcatagagacggggtttcaccgtgttagccaggatggtcttgatctcctgacctcgtgatccgcctgcctcagcctcccaaagtgctgggattacaggcatgagccaccacgcctggcaacacatatctttgtacatgtatgcaaatatgtccatagtatatattcttagaagtgtaactgtagagttagtattgtgcagggggactgggaggagaatatgtgcattttaaattttgatacatgttgctgaattagaggagtataattttatttaattaattaatttattttttttttgagaaggagtctcactctattgcccaggctggagtgcagtggcacaatcttggctcactgcaaactctgcctcctgggttcaagtgattctcctgcctcagcttcttgagtagctgggattacaggcgtgcactgccacgcctggctaatttttgtatttttagtagagacggggtttcaccatgttggccaggctggtttcgaactcctgacctcaggtgatccacctgcctcagcttcccaaagtgctggtattacagatgtgagccaccatgcccagcctagaggagtataattttagaagatagatttctcatgtagtcctgtcttccccatggattaattgtgatttttaaaaaaatatttagggtcaactttgcatatttgccaattagatattttcaaatgcttatattagtgacttacctcctcaaaatgcatccaggaatggttaaaagcaaatattaattagtattcagatacttattttccccttcccacacagagtagcagagcagcagcatctgttcttgaggttgtgcttaatgtaaaatgctaggggttcctcttttctttttttgaaggtgagaatgtttgactaaaaaaaaaaaaatgaatggattaacttttagaaatgcatcttgaaaataaaataaggttttgctaccaggtgagtgaaaacaataattggaaataaagatttgagttttcctccttgttaaacccaatgaaattatgatgcttggctcttcctccccatcaaaaagaaagttaaagttaaaattcctgtgtgaggttgtcatattctcatgctgtatattttctttcagattcctttgtttcttcctcttcctctcagcctgtatctctattttcgacctcacaaggcaagtctgtaatttttttgtgtgcattggtaaaagaaaaatgttgagaaagaggctgtaactggggatacgaggcacaagtcttctattgccccaaatcccctaaaataaaaactaattacaagctgattctttctatttagcagtttccagtgggtttcgtgtaatggttaataaagtaaaatgaggctgggtggaccctgtaacatagcataaacttcaggagtagttttgagtatttctttaaaattaaaaacttgcccaccagaatttggagcagatagaattgtggctcagaggccaggtgcagttgctcacacctgtaatctcagcactttgggaggcaaaggcgggcagatcacttgaactcatgagtttgagaccagtctgggcaacatggtgaaaccctgtgtctacagaaaatatccgggcataggtggtgcatgcctgtagtcccagctactcaggaggctgaggtgggaggattgcttgagcccaggggctggaggttgcagtgagcgatgatcgtgccactgcactccccgctgggtgagagagcaagaccctgtgtcaccatcaccaccaacagcaacaaaattgtggctcaggaaacacccaacccctagaatgcatttaatatattgttttggagctatgaaactggtttacagaggtagcagattggaaaaacagtataaaagtgtgcttccactgaactagaaaaataccagcctagctagggtattttaatgtgaatttatctgagacacgtcataaaagctaggctagttccaaattgcctacaaacattgaacaagtcagttatgtgacttttggcaagcaaggcttcttgtcctagagattgagttgtggctttgttttgttttgttttgtttttaatctgtcagtctgtagggaagggaatcagtttgtggaggcaacattgccaagaagctgaaagagagggtactatgtgcttcatcaatttatactaataataaagtattatttcattcgtgctgtttttactagacccaaatatatgtcaattgagaacctttattttaaaagaggaaaaagtaattaaaatcactagacagattgatagatttaagaagtcttgtgcaaacagtttgttgttacaggtggagttctctagctgcaaaagacttttataagaataaaaacataatgggatttaaaaaaattagtaaaacttttgcctggttaaatctgcttcttaggaaacatggtagggaattttttttttaatttgttgttgttgttgttttgagatagggtctcactctgtcaccctggctgaagggcaatggcacttcattgaattcatagttcactgcagcctcaatctcctgggttcaagcgatccccccacctcagctttctgagtagctgggactacaggcacatgccaccatgccctgctaattttttaatttttatttcgtagagacattttgctatgttgcccaggctggtctcgaactcctcagccagtctggctcagccagtccttccaccttagccatccacagtgctgggattataagcatgagccaccaccacacctggccaacaatttgttttaatttaaactgatgacattagaacccccaattcctttataatgtgtctcattgtgtgaatttgggtatcttgtgggccaaataatgacctctgaaattaacatgtttacattaaaagatagaaattttgttaatgttagaaagtaactcaaacgtatgaagtagttatattgttcttgacatttggaacttgacaatatttttatttttaaggatttttttttctcatgagaaaataatttaagcaaataggtattaaattattctactgtggaagaaaaatatggtataaatagaacaaataattatttcctctcttgtaagtatttcagatctttaagaatacgttctaaccttaagtcactattttttttcttttcttttttctttttttttttttgagatggagtcttactctgtcacccaggctggagtgcattggtgtgatctcagctcagtgcaacctccacccaagaatcgctcaagcagttctctcgcctcagcctcctgagtagctgggattacaggcgtgcaccaccacgcccagctaatttttgcatttttagtagaaacggggtttcaccatgttgaccaggctggactcaaactcctaaactcaagtgattcgcctgccttggcctcccaaagtgctggcattacaggcatgagtcacgtcgccaggccaagtcacttttttcatatagaaaagggatagttgatactctaaacggtgtaacggtgtaacccatggcttacatacctaatgtataacgttgaaaagataactgtcatagctttaaaaattattttaatccctggttaacaacacttacatgtacactcaagtagaagggaggtaaataaaaatgatttaaattaaaaatgaatgttttaataggcttcagtttcacagtgtgtattagaatttgcaagacagcatacacttattcttcctttttgcctacaaaaaaaattttttgaccaatgtagattgagaatagtcttattgtagaaaggtaattaagaatgccctatccgactgtgcgcggtggctcacacctgtaatcctagcactttaggaggctgaggcaggcggatcacctgacgtcaggagttcgagaccagcctagccaacatggcaaaatcccgtctctactaaaaatacaaaaattagccaggtgtggtggcaggcacctgtaatcccagctactcgggaggctgaggcaggagaatcacttgaacccgggggacagaggttgcagtgagccgagatcacgctattcattgcactccagcttgggcgaaagagcaaaactccgtctcaaaaacaaaacaaaagaatgccctatcctcgaatgggtttcatttaacctatattagtagcattttctcctgcaacaaacaaataaacaaaacacatgatggaaaagtagcccagtggggccctacgtcattggcagtctagaggttagcctgttcagttgtttgaaggaacaccttggcagatgattagttgttttctagggtagccaagactggtagcttccagtctgccttagtaaaaataagggaagaggaagctgttgatacatagttggttaactgtattaaaaccctgaatggagatgagggctctgggaacagtccacttccacacaggcctttgaaagtgactgctgccacctgcatgcactttgagtccgtcactgacactaacccaactaatttctttggcttcatataccttagctatctagccttagggaaattgtgtctatttttatataccccaatcatattaagcaatatgtagtaataataggacttaaaaaaaaaatagagacaaggtctcactagattgcccaggctgaactcctgagcacaagcggtcctcctaccttggcttcccaaagtgctgggattacaggcatgagccaccatacctggcctaaataggacatgttaagatttaagtgactttttttttatcctgaaatacatatttatcattattgggtttcaggtagatgcatgtataaaaaatgtcattgattcagactgagttaaaggcagttaaagtttttaaaagtaaattttgtgatatttactaagttgtactgctttgagaatacagctacataagctaggaagttaaacttctgatatgaatagatttctagttagaatgtcagtggaataatcagttccttcttcaataagttgtacccctgagtagtccttgtccttgcagtcttttgcttatggtttcctttttccatcaagcaacaattatatttcagcctaatccctgagagtttcaaaatagtggattacattttaatgatgttttcctgtacttcataaaacatacaaagatattgacagaagtatagatgtagtatgtggctaatttttattgaacttttactatgcccagtaaacttcacatgaatcatctcatttaatcttcataagcagttctatgaagggaagggactagctcttttaccaattgaaatgacttgaaaatggtgaaatcacttgctcaaggtaacacagcaagtaagtgatagagggaggatgccaaagccgtggtcataactgctgtacctataataaagatgatcaaataaactagctgtattttagggtttagacttctttttagagatggcattttgaagttaatattaaaatcatgacagcagaagaggcagataccattgttttgaccatattatcactattagtgatataatttagtatcatctggggtatatgctccctccaacaaaatcaaaatcaaactgaaattttgttttacttttcaaaacccttgagagtggaagctagaaaatactgtttctttagaaaacattggaagaaaagtaggtgaaaatgagattggaaagaggatccatccaccatgccgcattggaagcattgcattaatgaatgcttgcattcaatttgactaatgcagtaggcatctggaataggaagttacaaccctgaactttgggggcaagcattgaggaaaaaataaatttgccagttacagcctttttttaaaaaaaaaaaaagaaaaacatttttctttgtacaaaagagacgttttgtttaggatctagcttggctgcagaatgtctgctggctaacttcctattttgatgctgtggctgcaagttgttgatactgttttgcacgaatttgtcttgttttgtgaacatgagaaaattcaagtgtaggaaaacctatacctgaatatttcaaacctccctcaaatgaatatgcatagtatggatatgaaaaagtaagttagtggctactacaggctggcacccattcttcactgatgtatatagttattccatgttatagatatccttttagtaaaaagtaatgaatttcttaggtgagcaggtaattaatcacatggtaactataacctagttttaaactatttactctttttaggaagaactctttgatataggatataacattccttattccttaattatagatcacattttgtttttagtaattaagttatacgtacttgaatagatgagtactaaatctttatctaagagacactttggggaaaaagaagcagaataaacagtatatgaagggttttcaattcaaatgtatttactcataagtattttttgttggttgtttctttgttttttaagagatgtggtctcactgtgtttcccaggatgatctcaaactcctggactcaagcaatcttcccgcctcagcctcctgagtagctgggactacaggcgggcaccactgtgcccagtcttagacattgtagtttttttgtttttttttttatcatgttactttaaactccccatcttgctctgaaagataaaatactctaggcataaaagagagaaatttcttcctcaattcccataccagattttctagtcagatgtgtttttttccttattccaataaaaatgcagaattactgtactttagaattagtatatggaagtgtttaaagtaggcacgggaagaccgctcctgctgtatgccttggtactcttaagttgtgcaagcccatctatgtgaggagaagccgtgacagtggctcctcctgtgggatttttatgggactagagctctgaagtatggcccttatctttctgctctccaacacataccaaatgtattaaggctgtggttctgaaaccagtttcgttgcctgggaaacttgtaatacagattcctgagctctgtcctccttaggaagttctgaggcagtaaatcagagataaagcccatgaagaactagtagttgctcttaagtttgagagggattgtgaaaaattgtgccaaaggctgtctttgtgctcggttattaaattgttcagctggttgtacattgaactaaaatatgctttgaccctgctggtggtaaagatcatttgtgaaacattttgttgaggaaaatttactggctgggtgtggtggctcacatctgtaatcccagcacttgtgggaggccgaggcgggtggatcacttgaggtcgggaatttgagacaagcctggctgacatggcaaaaccccatctccgctaaaaatacaaaaattagctgggtatggtggtgcacgcttctagtcccagctactcaggaggctggggcatgagaatcacttgaaccggggaggtggaggttgcagtgagctgacatcaggccactgcactccagcctggtcgacagagtgagactgagactgtctcaaaaaaaaaggaaaagttatttatctttcagtgttggcttagaatttcttatatgttaagttctcttgtggggtttttggttttgttttttgggttttttattttttttttgttatttttttttgagacagggtctcactctgttgcccaggctggagtgcagtgggtcaattagggctcactgcagcctcaactttccaggctcaagcaatcctcccaccttagcttcctgagtagctggaaccacaggcgtgtgccaccacaccaagctaatttaaaacaaaaaattttatttttgagacggagttttcgttcttgttgcccaggctggaatgcaatggcgcgatctcagctcaccacaacctctgcctcccaggttcaagtgattctcctgcctcagcctcctgagtagctggaattacaggcatgcaccactactcccagctagttttgtatttttagtagagacagggtttctccatgttggtcaggctggtctcgagatcccaacctcaggtgatccacctgcctcagcatcccaaagtgctgggattacaggcgtgagccaccgcgctgggccctacaattttttatagagaagggatctgtctcattattttgcccaggctcgtctaactcctgggctcaagcaatcctcccacctgggcctcccagagtgttgacattacaggcatgagccactatgccaggctgggctctcaagcatctttatctgcatagaacctagcacaattcttaggatgccataggcatttggtttgtaccaacgtattcagacgttgcatcacctaagattttgaagtagataaaagctctttgaattatcttccttaatatgtgaatggtaggagggaaagtgtctaaagctctacatgaggattttctgtattatataccagatgaaggtggttacagtttgccaatatgccttttctctccctagtaaaaaggcatgtggtctggagtctctatgtcaagagagttttttgagaatgtggtgtttggggacatttattggggatttactaagtggcagctactactgtgaacatgtattaactcatttaatcctcacagcagttctaaagttaggtgctttaattttcccattttgatgagattggattaagcagtttactcaaggccacacgattagtaattgtgattaaaggactttgattttttttttttttttttttgagatggagtctcacattgttgcctgggctagagtgcagtggtgtgatcttggctcaccgcaatttccacctcctgggttcaagcgattctcctgcctcagtctcccgagtagctgggattataggcatgcgccaccacactcggctaatttttttgtatttttagtagagatggggttctccatgttgatccggctggtcttgaactcctgacctcgtgatcaggaccagctcggcccccaaagtgctgggattacaggcgtgagccaccgtgcctggccgacttcgaattttttaataagaattttttggccgggcgcaatggctcacacttgtaatcccagcacttggagaggccgaggcaggcgaatcacctgaggttgggagttccagaccagcctaaccaacgtggagaaactccgtctctactaaaaatacaaaattagctaggcctggtggcgcatgcctgtaatcccagctactccggaggctgaggcaggagaatcgcttgaacccaggaggcagaggttgcggtgagccaaggtcacaccattgcactccagcctgggcaaaaagagtgaaattccatctctcaaaaatataaaagaattttttatttgggtctaaaaatttagaatttagaatatgactaccaacttaatttcttagtctttgtttcagataatatatctcagtggagtatttagagtttaagaagatgagtaatcatggagctgagtacttgataagtttgagaacatgttcatgatcattgtggggatatgacattttttacctcttaccatatatcgattctcacccaccccccattttttgaaacaaggtcttgctttgtcacccagggtggagtgcatggctcactgcagcctcgacctcctgggctcaagcagtcctcccacttcagcctcccaagtagtcaggaccacaggtgtatgccaccatgactggctaattgtttaatttttttgtagagatggggtcgcactgtgttgcccaggctggtctcgaactcctgggctcaagctgtctccctgccttggcttctcaaagtgctaggattacaggcatgagccaccacactcagctgattccctttttagtaaatctactagatctatgactttatttgttaataattagagtagcaccatgtttttaagtgattagaactcttgaaaatgaatatccacactaaattccattatagcaaagaactaatttagaaaatgttcataatgagagttttgatggcgatttgttttgagtagtgttgaaaggctcttagagtgcatgtgaagggatgaatcttttgagaaaagaaagatagtagacattttctgagacataaaataatccagatttattccaccagacagctttacagtgtatagtattttaagagctaactgccttcagattcactggacttttctgtccttttgccaggtactgacttgggcaacagcagtgactacaagtgccatactgaccaattggaagagtctttgcttatcggagctgttctaaaaggcttattagtttttggtcttcattctatttaatgttttcatgcctttataaactttttacttccagcccaatttttcccattgtcttggtacaggtcagctgtgtccaagtttgttagggtttcagctagccaaaaatggtattttcatttgctgaaattctaaacaaaataattaaagttaaagcacagatgatgatgctaccttatttttctacatgtgggaaagcttgattgatagtaatgattagcgcctgcatctcacaatcactgagaaatgaatgcagcactgagctctgtttgccctctaagcttgtccccagaaaaaacaagatataccctaaatagtaagttataatatttttattagggaacattattagagtttttttttaatatatctcgtagccatgtcatattaatcttttttcttttttcctttttttcatttttctcttttctcttctcttctcttctcttttctctttctcactctgtcacccaagctggagtgcagtggcatgaccatggctcactgcagccttgacctcccagactcaagcaatcctcccactccagcctcccaagtgactgggactacaggcacgtgccaccatgcacggctaatttttctattttttgtaggggcaggatctcagcatgttgcccaggctgatcttgacctcttggactcaagcaattttccctcctgtgcctcccaaagttctaagatacaggcatgagccaccacacccagcctagagaatccttaatgtttgaagtctgtcaggctatcatggtgctcagcagaggatgtgttagtattctgagaataggacttctaactttagttttacctgagattattctacacctaacttgaaacttttggagtattaaaggttcaaagaagttaagagaaaagcaaagcttgataaactgaccagtttgtgtcctgctaaagcatagacagttttaccatgctcttcccagtgacatgaatattctttggttagcattcaatttggttgctttcttttttgtttaatcaggcactgtcaccactgtattattgtcatcattttgcttattgattttgcttattgtctgccttcccctctgtgttgtaagctccataaaggcaagaaattttttctgttttattcactgctttaagcccagtttctaaaacagtgtctgacacgtggtaggcactcaataaatacctgttgaattattactaattcattttgtagactttcatctgtaagatgacagatctgaatcatctgaaatctccatctccataaaacatataagctggctgggtgcagtggctcatgcctgtaatcctagtactttgtgaggctgaggcgagcagattgcttgagctcaggagttcgagaccagcctgcgcaacgtggtgaaaccagctctctactaaaaatacaaaaaattagccaggtgcggtggtgcacgcctgtaatcccagctacttcggaggctgagtcaggaaaatcgcttcaatctggggggcggaggttgcagtgagccgagattgcaccactgcactccagcctgggcaacagaactagactctgtctaaaaaaaacacacaaaaaacacacaaaaaaacatataagctgaacctcccctgtggggtggagtcagtttgactcacctcagagttgtttgaagagagaggttcccaaacagttttaccataaccttagttcactgaatgttttgtggtagaaacactgactagtaagttcagtaacaatgcatggctcagattgtggaatatttctgatttaaatgtaatctgtagtacttcacacttcagatttttgaaccttttaacctacaatactgggcttcatttctgttatgccctaatctagtcatgctgaatatccatactgtataatggtagatgcaaaccatgtttactaaattagaactacatatgaattacagtttacttcaagtgttttgttttggtaatatagctttgccaccaagcttttacagttttccttgaatgtacaaagactttttattctaataaccagattacagttatactatttctaaagctcagctcttattacatcaagtttcagtgatgtgttgaagtaggggaactttatatggcatttcaaaacattttcataatactggaattttatttattgtaaaatatttttgtctttaataaaataattttgaatgaagtcataattttgcttttatctggtatttggatgtttacatgaaaaagggaacataagctgaataaaggtaatcccaaaagaacttctctgtcacattttcccagttactcattcatgctcaaggcattgctgtcctgagcctacttaggtctcagctgaccaagctgaatctttgattcacttatttggggctatttatttaagacccactttgtcccagctccaaagatacaacagtatgcaagaaagacagcgcccagggtgggcgtggtggctcatgcctataatcccagcacttcaggaggccgaggtgggcaggttgcttgagcccagtagtttgagaccaacctggcaatgtagtgaggcaccaggtctgtagaaagtttaaaaatcaggccaggcgcggtggctcatgcgtgtattcccagctctttgggaggccgaggcaggcggatcacggggtcaggagatcgagaccattctggctaacacggtgaaaccccgtctctactaaaaatacaaaaataaaattagccaggcgtggcggcgggtgcctgtagtcccaactgcttgggagactgaggcaggagaatggcgcgaacccgggaggcggagcttgcagtgagcagagatcgcgccactacactccagcctgggcgacagagcaagactccgtctcaaaaaaaaaacaaaaaaaaaaaaaaaagaaaagaaagtttaaaaattagccaggtgtggtggcatgtgcctgtggtcccagctacttgggaggctgaggtgggaggatagcttgaggccaggaggtcaaggctgcagtgagccacaattgtaccactggcactccagcctggaggacagagggagaccctctctcaaatacaaacaaacaaataaatgaagtaagaaagcaccagcccttgggatatttgttttgatccttttccccagtaaaaatttgttagagtgggaagttagaaaacagtgtggtagattgatggctactatggtattaactgataagacttaacgtattactttgagaaggatattttctattttaaaagtaattctggagttaactctgtctttttttttttttttttttttttttttgagacagtttcactcttgttgcccaggctggggtgcgatggcgtgacctcagctcactgccatcaatgtctgcctcctgggttcaaaggattctcctgcctcagcctcccgagtagctggaattacaggtgcctgccaccacgcccggctaatttttttgtatctttagtagagatgaggtttcaccattttggtcaggctggtctcgaactcctgacctcaggtgagccactgcacccagccaagttaactctgtcttaaccaaagaaatcaatttgcacagtacaatattgatttaaatgacaagttagtacaagagattttggaggggccaggcgtagcggctcacacctgtaatcccagcactttgggaggccaaggcgggtggatcacttgaggtcaggagttaagagaccagcctggccaacatggtgaaaccccatctcttctaaaaatacaaaaattagctgggcttgatggtgcctgcctgtaatcccagctacttgagaggctgaggcaggagaatggcttgaacctgggaggtggaggttgcagtgagctgagattgcgccattgcacttcagcctgggcaacaagaaaaagactccgtatcaaaaaaaaaaaaaaaagattttggagggggtccacctttttcagtaccctttagtttagaacatcacagctatttatttgtacatgggacagattctccctgtggatagaatagaataattctagtctcatttttcagattcaggaagggcccattgcatctcctaaaaatcaaaaaagtctggccactagtttttttccttttcagattgtgagactaacagatttatagaggcagtctgtgctctgaattgttcagcttacagattgaagtctatcaaccctttatagtatcaggttatttgttttgtataaattattttgcttttgttgattagctctatcaaagaataaaaaacctcccaagatttctcaatcttaccgcccttctttatgctttctctgtacaatggaaaagtagaccaaaagtatttgtcatgaaaattttttatcatttgcagtttgtggcatgatatggcttttctgtttcactgttggcagttttatgcatgtcctgtaggataacttgatcgttttgttacatatttatgtgtgtatatatacatcctgtgtgtgtatatatatatttatgtaatttaaaaaataaaaagcatgctgcttggcttggctagctaatgtgtaattgtacctggtaaacaatttttttctttgaaattctgatcatagagggattgagctctctttgctctgatgagccatcttcagaaattatgacttcttcctttctttcatcttctgaaatacataacactggccttacaatactacatggagaaaaaagccatgtgttagggagccagcctattttagccaaagaaggaaaagaccacttggatcttctagatatgaaaaagatggaaaagcctcaggggaccagcaacaacgtatcagactcttcagtttctcttgcagcaggagttcattgtgaccgtccttctattccagccagtttcccagagcatcctgcttttctctcaaagaaaattggtcaagtggaagagcaaatagataaagagaccaagaacccaaatggggtatcaagtagggaggctaaaactgcattggatgctgatgacagattcactttgctgacagcccagaaaccacctactgagtactctaaggtagaaggcatttatacatattctttgtctccatccaaagtttcaggagatgatgttattgaaaaggattcccctgaatcaccatttgaagtaattattgacaaagcagcatttgacaaagaatttaaagactcatataaggagagcacagatgattttggtagctggtctgtgcacactgataaagaatcatccgaagacatttcagagactaatgacaagctttttccactgagaaataaagaggcaggacgttacccaatgtctgcattgctcagtaggcagttttcacacacaaatgcagcactggaagaggtgtccagatgcgtgaatgatatgcataactttactaacgaaatactgacttgggatctggttccccaagtgaaacaacagaccgataaatcttctgactgcatcacaaaaactacaggacttgacatgagtgaatataattcagaaattccagttgtaaatcttaaaactagcactcatcagaaaactcctgtatgttctattgatgggagcactcccatcactaaatcaacaggtgattgggcagaagcatctctccagcaagaaaatgctattactggaaaacctgtacctgactctttgaattccacaaaagaattcagtatcaaaggtgtgcaaggcaatatgcagaaacaggatgacacacttgcagaattacctggatctccacctgagaaatgtgactctttgggttctggagtggccacagtgaaagtggttttacctgatgaccacctgaaagatgaaatggactggcagagctctgcattgggagaaatcacagaagctgatagttctggtgagtctgatgacacagtaatagaggacatcacagcagatacatcatttgaaaataacaaaattcaggctgaaaaacctgtttccattccaagtgctgttgtaaaaacaggtgaaagagaaatcaaagagattcccagttgtgagagagaagaaaaaacatctaaaaactttgaagaattggtcagtgactctgagctgcatcaagatcagcctgatattcttggaaggagtccagctagtgaggcagcatgttcaaaagtacccgatacgaatgtctccttagaagatgtgagtgaagttgctcctgaaaagcctattactactgagaaccccaaacttccttcaacagtgtctccaaatgtttttaatgagacagaattctcattaaatgtgacaacatctgcctatttggagtcattacatgggaaaaatgttaaacatatagatgattcctccccagaggacctgatagcagcctttacagaaaccagagataaaggaatagtagatagtgaaagaaatgcttttaaagcaatatcagagaagatgacagactttaaaacaactcctcctgtagaagtcttacatgaaaatgagtccggtggttctgaaattaaagacattggaagcaaatacagtgaacaaagcaaagaaacaaatggaagtgagcctctaggtgttttccctacccaaggtactccagtagcatctcttgacttagaacaagaacagctcacaattaaggctcttaaagaattaggtgaaagacaggttgagaagtcaacttctgcacagcgtgacgcagaattgccttctgaagaagtactgaagcaaactttcacatttgctccagaatcttggccacagagatcatatgacatcctagaacgtaatgtcaagaatggatctgatcttgggatttcccagaagcccatcactatcagagaaactactagggtagatgctgtttccagccttagcaagactgaattggtaaaaaagcatgtcctagcaagacttctgacagacttctcaggtaaccatttatattagaatactgcatgtggttaattctgtgattgattacttatcagcgtgccatttatgttagtctgatttatacctacaaaattatggctaaaatacaaaaacaatatgctgtatgatgggaaaggcagattcttctcctgtctttttttaaatgattgcttgatttggtttccttaatatcaatatttcccaaagcagtagaccactttgtaacattaatcttcccctaaatattttttctatgctcgctgggtacggtggctcacgcctataatcccagcactttgggaggccgagacgggcggatcacaaggtcaggagattgagaccatcctggctaacacggtgaaaccccgtctctactaaaaatacagaaaaattagctggacgtggtggcgggcgcctgtagtcccagctgcttgggaggctgaggcaggagaatggcgtaaacccgggaggcagagcttgcagtgagatgagatcgcgccagtacactccagcctgggtgacagagcaagactctgtctcaaaaaaaaaaaaaaaaagaaaattttttttctatgctccagttatatttcaaggtacttcttttcttataggttgcccctaaggtgatattaggtgagaatctaatatcatcaggttcttacttatttacaaagcttgtttttaaatctccataattgtcatactttttagcacttggattttttgatatgtgctttgtggaatcttagcaatcaaagataaaggaattcctgctgggaaagatagtaaatgaaacttttaattaatgtgatcgtatactatagagattttatgctctgaaagtaggtaaccagtattgtagtactattttgtgagtaatgcttaggagaactcatgcattcttctactttctatcttatttaatattcttcaggccaaaactcattattagatggtaccagaaaccccttctcttgtcttttatctatttcaaatgatcacttttctagcaagtggctttcagttagattactgcaaatgctgtctattctgggatcttggaaagtacaagaaaaaaaaaggatctttcaagcccctctacaagggacccccatcctttaatgtaataccaagttttacatctactgtatggtcagtgttaggtgctatgtagaggtctgtggtttttaaactatttgattatagatcttttatcaaatgaaatcatacacagagttgtagtatttacaagaaaattagatttttgttaggctaaatgtattttgtgtttgattttgtgcctttttataaaggcattttcttactggaaactgtaggtagatttatctttttaagttttaatatttaaaatagataaattgtacttaaccttacaatggtattgtgaggattaaatatgaaaatgcaggtaatacagtgcctagcacatagtaaatatgcagtcagatttagcaccaaatacagggcctgccacataagtagtactggataattatttgttgaatgaatgatatgaattatttcactaacaattatcagtgaaagacattgaggctttttgataaaccaaaaattttgaattaccaattaaggatagctcttatactctagcatttgaagctcactgaatttggattaaagagtactaggttctaattcttgctgtgctgtgtctagaagtatgactttgaacaagtaacttacataacctttcgggggcctcagttttaatatctgtaaagtgaggatgtaaagtgaagtagatggtcttcaattatcatttaaataatatgattctctggctctggtacattctagatttcttcctcagttgtcataattcttacaggtagtaacttttgggcaataaggcatataggaattatgctacaagaactccagtgtctaattctggcaaattcctgttttagcatgaccttagatgactagtctaattggttcagcatcttcctttgttaatgtgatgatcattattttgccctgctttgtatgttgcagtaaataaagtgctgtgtaaatgctaattattagtgattatcaactgaattatttaatctagcgtgagagatgtaaagggctatggaagttcaggatatttgtcactgaccaaagtctatgattagtgtatgtttttagattgtaattaaagaagaccggtatagttagaccaagaagtttaaaggcctttcttgcagctttcaaaagtgaaaaccttttaaaattgtcttatttatgaataaatctttaaaaatataatccatttcattgcagtgaaataaataaataaaaacataaaccatttcagtaaaatgcatcagtgtctagttttatttatttatctttttttttttttttttaattttttgagacagagtctcactctgttgcccaggctggagtgcagtggcgcgatctcggctcactgcaacctccacctccagggttcaagcgactctcctgcctcagccttccgagtagctgggattacaggcgtgtgccaccacgcccagctaattttttgtatttttactagagatggggtttcaccatgttggccaggctggtctctcaaactcctggcttcaagtgatccgcctgcgttggcctctcaaagtgctgggatttacaggcctgagccaccacacacagccgattgtctagttttaaatacgtgtatctgcatattcttcctttctaaggtaaaaacagtgctttaattatattctgccttaagttgtttgggaaaataggcaaaagaaacaatgaaagaattagtggttttctgtttgtttttgctattttatggtatattatgtaacagcttgtaatgaagcctttatcatattatagttggttgctgagtaattaagttatgatagactctcatagtttggggaagaaaatcagatccctgcctctcacatacctagtgtagtgaagatagttttttgtgttttagtatccagattggcaggatgcaaggaaataagcatatagtttggtgaagtacatgtaaattgttacagcctttctggaaggcagttggcaatatgtaacagacctagaactgccctagcaatcttgtttttaggaattctttttttttttttttttttttttttttgagacagagtctcgctctgtcgcccaggctggagtgcagtggcgcaatctcggctcactgcaagctctgcctcccgggttcacgccattctcctgcctcagcctcccgagtagctgggattacgggcgcctgctaccacgcccggctaattttttgtattttttagtacagacggggtttcaccatgttagccaggatggcctcaatctcctgacctggtgatctgcccacctcggcctcccaaagtgctgggattacaggcgtgagccacccgtgcccggcccttttttttttttttttttttttttaaagacagagtctcaccgtgttgcccaggctggagtgcaatggcacgatctcgggtcactgcaacctccacctcccgggttcaagcgattctcctgcctcagcctcccaagtagctgggattacaggtgcctgccaccacgcccggctaattttttgtattattagtaaagacggagtttcactatattggccaggctggtctcgaactcctgacctcgtgatccgcccgccttggcttcccaaaatactgagattacaggcgtgagccacggaacccagctggaatttatccttttttaaaaatgtgcaaaaataactacacagatgttcattatagcacagtttatgatagtggcagatatctcggtgtcttaacaattagagattggttgagtatattatggtataactgtgcaatcgaatattacacagtcattgaagttgttaaagttttgttttttttttttttaagaaatggaaaaatatagaaaagtacaaaggcagcctacacccatatcttctctatatgtagaattaacttatgttaattgttagcattggtagtcatatttgcttccaaactaaaggactctttgattaccacctggccacgccctccatctccccttccccagacgtaacaccgtcatggacctggtacatccttccagtttattttaaataaatgtgtttgtattgttttatgctttttaaccattcattcatgttatcatgtttgttgtataacgttttccattcaacattaggtttttaaacttctttcatgttggaatttatataatttattcattttaacagctatgtagtaatccattatatgaatatattattttcttttggtaaggatttagattctttcctattttttgctattatagacagcgctgaagttaacattcttctttttttttttcctttttctttttcttttttgagatggaggagtttcactctgtcgcccaggctggagtgcagtggtgcaatctccgctcactgcaagctccgcctcccgggttcatgccattctcccgcctcagcctcctgagtagctgggactacaggcgcctgctaccacgcccagctaattttatttttgtatttttagtagagtcggggtttcactgtgttagccaggatggtctcaatctcctggcctcgtgatccgcccgcctcggcctcccaaagtgctggaattacaggcatgagccaccgcgcccggccttaagttaacgttgttatacttgtctgtttttacacatatgtgactatttccccagcgttagggtgctactgcttatcagtttcacttctagctctgtgccttatttttctagttactgtcaaagttagtgtcttctgttatgtaaaaatgttcgtaatttattagtaaaaactacattgttcagcacccagcagatggtgggtgctaaagtggaatgaaaagagttaccaaacaaggaatacaaaataattcctatcttggtatcatttaaagtgaatctatgctagaaagattccataaagaaaaaaaatgaatctatatacctacatatacagggaatctgaagtaatttttaaaagcaatgtcagaatggttttcttttcttatggccaagtaggcttttactggacctgaccttcctgcatataactggacaaaatttttaaaaaacaaagacccgaaggcactggaggatgaacgggagcagtcagattctgaaagagagttgacacatgtaagaagagacagcatgaaattagttttttatttttactgcttttagctagaggacaggctgaagtgggcacctgacaggctggcttaaaccttcatagaaaacctaagcagtggacagcatttgggtcagccacaaccactgagtcagtggaatgtaaggggaggaggaatcttggaagggagagatccagagagtgacagcctaaaattctgtagataaaataaactgtgtttaagcctctgtttaattgtaaaccacacttaacacaaaagattataagcagcacaactagagatgaaagaagtgaactgggccgggtgcaatggcccacgcctgtaatcccagcactttgggaggccaaggcgggtggatcacgagatcaggagttcaagaccagcctggtcaagctggtgaaaccccatctctactaaaaatacaaaaattagccgggcacattggcaggcgcctgtaatcccacctactcaggtggctgaggcaggagaatcgcttgaacccctgggggtggaggttgcagtgagccaagatcatgccattgcactacagcctgggtgacagagtaagactccgtctgaaaaaaaaaaaaaaaaagaagaagtgagccgagtttgtagtttgaaggccaggcacagtggctcatgcctgtaatcccagtacttcaggaggctgaagcaggtggatcacttgagcccaagagttcaaggccagcctgggcagcatggtgaaaccccatctccactaaaaaatacaaaattaagccaggcatggtggcctgtgcctgtagtccctgagcccagggaggtcaggggtgcagatcgcaccactgcactccagcctgggtgacagagtaagactctatcttgaaaaaaaaagtttgcagtttgaatctaaccaaatttattacatgttaaaacaaaagtaatgatactctccagaggaatagaacacagtctggaatttgtacagcataatattcacaatgtccaggatataatccaaaactacatgttttaagaaccaagaaattataactcagtctgaagaaaaagagacaatcgatagaaactaactgcatgtgttggaattaggagtcaggattttaagggttttcattttaatcactcaaagaagtaaagggaaatattcttgtattgaataaaaaagaaaatctcaacctagaaatcgaaacaaaaaagagtcaggtggggattctagaactgtaaaatataaccactgaaattaaaattcagcaggtgaccttaacagcaaaatggagatgacaggggaagaagctggtgaacttgatagcatactaaagaacagaaagaacacatattttttaaaagtgtcaccagagcttcagaaccctgtgggacaatatcaaaagacctaactttggccaggcacagtggctcacgtctgtaatcccaccacttcagcacttagggaggccgaggcaggaggatcacttgagcccaggagtgcgagacctgcaaaacctattttttataattggagtcctagcaggagaggaaagtgagagagagactggagaaggacatatttaaagataaaatggctgaaattttcttaaattttatgaaaggcacatttactgatgaaagacgctcatcaaacaccacctactaggataattacaaagaaaaccataccttggtgtatgtgtcggggtccccaagataaccatcagggccagtgatttgctagaaggacccataggactcataaactgtaaactagcagttaatggtttattacagcaaaaggacataggttagaattggccagaggaaaagacacacgggataaaatctaggagagatcagatgcaagcttccaggtattgaatggagtcatacagggatgtacttaattcttttacagtgatgcgtgataacatgtgcaaaggattcccaaccaaggaagctctttcaatctttggtgtctagcacggcatgcagtgcccatatgactgaactcagctactcagaccccagacccccagagcaaaaacatgtactggcaataaatcatattgttaggataaatttatctgatacagcatggcctaagacctcaggcatgcaaaaatacttatgaagcagaatattcaaagggctcagaggccatctccaaggagccagcaaagggctagtcctgaagacagacctttctttggcatgtgcagggcttggcattctaggcctgctgagttttcaccctttcctatacagtgtatcgtagtcaagttgctgaaaaccaaaaataaggagaaaatcttgaaagtagctagagaagaggctgggcgcggtggctcacgcctgtaatccccacacgttggaaggccgagacaggtgggtcacaaggtcaggagttcgagaccagcctgaccaacatggtaaaaccccatctctactaaaaatacaaaaattagccggggtggcagtgcacacctgtaatcccagctacccaggaggctgaggcaagagaatcacttgaacccaggaggcggaggttgcagtgagccgggattgcgccactgcactccagcctgggcgacagagcgagactccgtctcaaaaaaaaaaaaaaaagaaaaaagaaaagaaagtagctagagaagaatgacacagggaaatgacaattataattagagcttacttcttactagaaaccacagatgtttaaaaggcagtagagtaacatcttataaagtgcccaacagggaaaaaaaacctgtcaacccaggtttctgtattcaggaaaaaaacaacaaaaaaaacaaaaaaactgcaagattaaaagacatttttagataaaagaaaactaaaagaattctaccagaagacctgcactacaagaaatgctaaaggaagtttttcagattaaaggaaagtgataccaaataaaaactcagacctttaggaaggaatgaagagaattggaagtggtaaacacctgggtgaatatgaaaggcttatttttttcctcttaatttcttaaaatatataggattgcttaaagcaaaaattgtaataacgtgtatagaggttatgatgtttatttcttaggacaattataacagaaaaaaacgagtatatggactgtactatagcaaaggtttctgctttttttttttttttttttttttgtttgtttgagacaggatctggctctgtggctctgtatcccagtctggagtgcagtggtgcaatcatgactcactgcaacctagacctcctgggctcaagcaatcctcgtgcctcagcctcccatgtacctgggaccacaggtgcatgccaccacacctagctaatttttttatttttttagtagagacagagtctcattatgttgccaacactggcattgatctcctgggctcaagtaatcctcccaccttggtctcccaaagtgctgggattataggcatgagccactatgcccagcctgtttctacatttttaatgtaatggtactataaatatatatatatttggagacagggtctcgctctgtcacccaggctgtagtgcagtgagtggcatgaacacagctcactgtacctcaacctcccaggctcaagcaatcctcccacttcacctttttgggactataggtatatgccacgatgcccaactagtttttaaattaattttatttttatttattttttgagacagagtctcactctgtcacccaggctggagtgcagtggcgtgatctcagctcactgcaacctctgccttccgggttcaagggattctcctccctcagcctcccaagtagctgggattacaggcactcaccaccacgcctggcttatttttgtatttttagtagagatgaggtttcaccatgtttgtcaggctgatctcaaactcctgacctctagtgatccaccctcctcggcctcccaaagtgctgggatcataggcgtgagccaccgtgctcggccaaaagatgttatttaaatataaagacacaggttgaaagtaaatggatggaaaagatatcccaaaaaatttataaatgtatgccatgcaaacagtaagcataagaagatgaaagcttttatcagaaataaataagggacatcttatcatgataaaagataccaggaagtcttgacagttataagtgtgtatgtgcctaataatggcttcaaaatacacaaagcaaaaattgacagaattggctgggcaatggcccatgcctgtaaccccaacattttgggaggccaaggtgagaagatcacttgagactagtttgagaccagcctgggcaacataacccttaacccaacataaccctaccctggagtttttttgtagagacccccatctctacaaaaattcaaaaattaactggtttggtggcatgcatctgtagtcccagctactcaggaggctgaggcggaggattgcttgagcccaggaggtggaggctgcagtgaaccatgatcacaccactgcactccagcctggtgacagagtgagaccctgtctcccaaaaaggcagaattaaggagatatattggcaatctgtaataattggaaaatttaatacctctttctcagcaattaactagacacacccaggtatctgaacagtacaatcaatgaatttgacttagatggtggttatagaacactactccctacaatagcagaatacacattattttacaagtgtataaggtatgcattcattggtatcgataatatactactaggcccacaaaacaactcagcaaatttcaaaggatttttttttttatttatttattggagacacagtttcactctgcctcccaggctggagtgcagtggtgtgatctcagctcactgcaacctctgcctcccgggttcaaatgattattgtgcctcaacctcccgagtagctgtgatcacaggcgcgtaccaccacgcccactaatttttgtattttaagtagagacagggtttcaccatgtttgccaggttggtctcgaactcccaacctcaagtgatctgcccaccttggcctcccaaagtactgggattatagatgtgagccactgtgcctggccaaatttcaaaggatttaaatcatacaaaatatgttctaaggccataatgaatttaagctttaaattaatgaagatatctatgatgaagacaacatctaggaaaattcccaaatatttggaaattaagacagttttacctaatctatagataaaagaagaaatcacaagaaaaatattaagtgatttaaactgaatcacttaaactgaacaatgaaaataaatcaaacttgtggaatacagtgctgagagggaaattatatagctttatttattttttattttttatttttttgagatgaactctcgctctgtcaccaggctggagtgcagtggcacaatcccggctcactgcaacctctgcctcccgggttcaaacgattctcctgcctcagcctcctgagtagctgggattacaggcgtgcgccactacacccagctaatttttgtacttttaatagagatggggtttcatcatgttggccaggatggtctcgatctcttgaccttgtgatccgtccacgttggcctcccaaagtgctgggattacaggcttgagccactgcgcccagccatgtatatagctttaaatgcttatattggaaaagacaaaaatctaaaacagtgatctaaggttcgaacttgaaaatctagaaaaagaagagcaaagtaaacccagtaagtagaaagaaaaaaaaagagctgaaatcaatggaataaaaaaacaaacaatagaaaaaattaacaaagccaaaatttggttcctggaaagttcaacaaaattattttttatttttttggaaacagggtcttgctcagtcacccagactgaagtgcagtagcatgatcatagttcattgtaatctcaaactcctgggcttcagcgatcctcctgcctcagccaagtagctaggactacaggcaggcatctagggactacaggcacgcactatcatactttattaatttttaaaaattttttgtagaaatggggtctcatgttgctcgggctggtctcgaactcctggcctcaagtgatcctcccaccttggcctcctaaagcgctgaggttataggtgtgagccacttttggccaaaattatttcttgactggacaagaaaaaaaaaaaagcacagattaccaatatcaagcatgaaaaaagggttttccattcagatcctacagatattaaaagaacagtagattattatgaacaattttatgccaacagatttatcaacttagagaaatggacaaaatccttgaaaaatgctacttaatgctaacacaatttatattaaagaaattaaattcagtatcaaaactctttccacaaagaaaattccaggcccagagttttcactggagaattcttcgaagcatataaggaaaaaggagaggagaatacttcccaatttataaactagtatatatgtcatatataatacatatgtatagagtaataccaaaactggacaaagacatggcaaatacaattatagactaatattattcatgaacgtaaatgaaaaatccttcagaagatattagcagatcataccagcaacataataagataatgaatgcatcaaggctaattagggtttgttacaggatatacaggatacaaggttgttttaagattaaataatcagggctgggctcagtggctcacgcctataatcctagcactttgggaggccgaggcaggtggatcacttgaggtcaagagttcaaaaccagcctggccaacatggtgaaaccctatctctactaaaaatacaaaaaaaaaaaggctgggcacagtggctcacgcctgtaatcccagcactttgggaggaccgaggcaggcacatcatgaggtcaggagggaggaccgaggcaggcacatcatgaggtcaggagatcgagaccatcctggcttacacggtgaaaccccgtctctactaaaaacacaaaaaattacccgggcgtggtggcacgcgcctgtagtcccagctacttgggaggctgaggcaggagaatcgcttgaactcaggaggtggaggttgcagtaagccaagattgcaccactgcactccagcctgggcgacagagactgtctcagaataaaaaaaaaaaagattggataatcaatataattcaccacattaacaatgaagaaaaactatggcataagttcagttcataaaaagtgtttgaaaatgtttggctgagtgcagtggctcattcctgtaatctcaacactctgggaggctgaggtgggagacttgcttgagcctaggagttcaagaccagcctggacaacaaagtgagaccctgtctctaccaacaaaaaaaaaaggaaaagaaaaattagctgggcgtggtggcggtggtggtgtgtgtctgtagtcccagctactcgggaggctgaggcaggaggattgcttgggcccaggaagtcgaggctggagtgagccatgattgtacaactgcactccagcctgggtgacagaacaagaccttgcctcaaaaagaaaaaaaaacaccacatacatacgtatgtatatatgtatatacacacagacacacatatatatatacacacacacattcagtgagatcctgtttctaaaatttttaaataaaaaaagttcgatatccttttctgatagaattttctacaaacaaggaatagaaggtaattccctcagtctaataaacagcatctgttgaaaactacagctgatgtcatccttaatactgaaatgctgaacactttctcctgaagattgggtacaatgttcactctcaccatttgtatacaacatactggaggtcactttgggaggccgaggtgggcagttcatttgaggtcagagtttgagatctgcctcaccaacatggtgaaacccccatctctactaaaaatacaaaaattagccaggtgtggtggtgcacacttgtaatcccagtactcaggaggctgaggcaggagaatcccttgaactcaacaggcaaaggttgcagtgagccgagatcacaccactgcactccagcatgggtaacaaatcaagactgtctcaaacaaaaatagccaggcacagtggctcatgcctgtaatcccagtactttgggaggccgaggtgagcggatcacttgaggtcaggagtttgagaccagcctggccaacatggtgaaacctctactaaaaatagaaaaattagccaggcatggtggcacacacctgtaatcccagctactcaggaggctgaggcaggagaattgcttaaacccaggaggcggaggttgcaatgagccgagttcacgctactgcactccagcctgggtgatagagggagactctgtctcaaaacacacacacacacacacacacacacacacacacacacacacacacaccatactggaggtcctagccactgaattatggcaataaatggaaatagaaggaatcaggattagaaaggaagaagttaaactttcttcatttgcagatgacatgattgtttacatagaaaatcctaagaaatccacaaaacaactattaggattaataagtgaacttagcaggattgcgggatagatattaggttgataaacaaaactcaattttgttgttatatattaatagcaaaatttgacaataaaaaaaaaactttttttgagacagcctttctctgtcgcccaggctggagtgcagtggcgcaatctctgctcattgtaacctccgcctctagctgagactgcaagtgtgcaccaccatacttggctaatttttgtaattgtagtagagacagggtttcatcttgttgcccaggctggtctcgaactcccaacctcaagtgatctgcccacctcagcctcccaaagtgctgggattacaaggtgtgagccacaatgcccgacctagaaaattatttttttaaataagtagttccatttacaatagcaccaaaagcataaaatacttggaataaatttagctaaaaaagtacttaagaccgcagtactaaaagctaccaaacactgcagagagaagctaaagaatgactaagaggagagaggtgctatgttcatgaattggaagactcagtgttgttaagatgtcagtcctactcacactgatctatggattcaagacaattcaaagtcccagattctaacatttctctctctctctctctctctctctctctctctctctctctctctctctctttctttcaacccctgtttcctgggctcaagccatcctcccacctcagcctcctgagtggctaggattgcaggcatatgccaccacaccgagctaatttttgtatttttagtaaagatggagttttgccatgttgcccaggttggtcttgaactcatcagcccaagcattctgcccaatttggcttcccaaagtgttgggattaccagtgtgagctaaagcgcctcaccaattctaacatttctgtggaaatacacagagcaaagaacaaaattggagaacttggaacatttatttaaagacattataaaactccagtaataaagacagtatggtactgacgagtctacaagtaaagaaacagagaacccagaaataacaaattagcacaaatttagcaacttaaatttattatctcacagttttcatggatcagcattctaggcatgggctagctgatcctcctgctcagggcctcactggggttgtgataccatctgagactcagggacctctttctttccaagctggctggttgttgacagaattcagttcctggaagttgtggaatgagatacccactttctttctccctggatgtcagctggggaaatcatgctcagctcctagaagctgcctgcgggtgctaacctcatggccctctcacaacatggtagcttgcttcttcgaagctatcaagagaatcttatacagtcagtcctctgcatccgcaggttctgcatccttgggttcaaccaacctcggattgaaaatacaaaagaaaaaacaataaaaaataatataaaggccaggcgtggtggctcatgcctgtaatcccagcactttaggaggctgaggcaggtggatcacctgaggtaggagttcaagaccagtctggccaacatggtgaaaccccatctctactaaaaatacaaaaaattagctggatgtggtggcacacacctgtagtcccagctactcgggaggctgaggcagtagaatcgcttgaacccgggaggcggaggttgcagtgagccaagattgcaccactgcactccagcctggatgacagagactccgtctcaaaaaaattttaaaaaataagtatccaaatggatatgtctaggttatatgcaaataccatgctattttatataagggacttgggcttccatggatttttatatccttggggatcctggaacgaatctcattcagatactgagaaatgactgtttatataactcaaatgcaaaaactagaatgactatcccatcatattcacaggttctgtccacagttaggggcaggggaaagtgttatacaaggcatgtacaacaaggggcaagagtcttggaagctatcatagaatccttttttttttttttttccctgtgatagggtcttgctctgttcctaagccagagtgcagttttgcaatcctagctcactgctgcctcctgggctcaagggatcctcccacctcagcctcctgagtagctgggactacgggtatacgccgccatgcccagctccatcttagaattccgcctgccacaattctaacttcacatgatgtgcagaaattaaaatgaattagatctctgaacataaaaactaaaaccaaaaaacttttccaagaatgcataggaaaacatcttcatgacatagggtaggcaaagatttcttaggtaaaatacactaaccataaaattaaagattgatggccaggcatgccggtgtctcatgcctgtaatcccagcactttgggaggccagggtgggtggatcacttgaggccaggagtttgagaccagcctggccaacatggtgaaaccccatctctactaaaaatacaaaaattagccagatgtggtgacgggcacccgtagccccagctgttaaggagactgagggaagagaatcacttgaacccaggaggcagaggttgcagtgagctgagatcatgctactgcactccagcctgctcaacagaatgagactctgtctcaacaaaagaaaaaaaaggaaaatactttttaggtaactaaggtcaaaagttcacatttttagatccatactattcacctggagaggggtagacaatgccattttgttttctgttttataaatctgaaattgagggcaaaggggatggtaggttattttaatgaacaaacaactattttttctgagagtgtgagatgaacattagtttgaaaggggttcctacatatttctctggcctgctgccagacttatctatggccaaaagtatgtgtgtctgtctttgacagtgacagctttgtattctgtcagtgatctttctgtgccttttgagggggtggatttccttggttaaggataaatctgtagcagagcagagtcttaacccatttcagcagccacaaaatttgggcctgagtttacaaacacatcacctgacgtctcttttgcaactcaaaagtggcttcatttattataactattaatgtgaaagtaaccaaagaaaagaaataatctgtgtaaaaatgtctgcatctttgtctttacataaattgttcatattaaaaagcttaactgtttcccctttattaacagtttcctttttgaggttataaaacatggccttttttttccttttagttatttcaggcatgtttgagtgttcttagggatgtgttatagacaagttttaagaaactgttgcaaggaaggtggaatgaattggagatttatttgttcttaaaaaatgaagtggctgggttcagtgattcacgcctgtaattccagcactttgggaggccaaggagggcagattgcttgagcccaagagtttaagaccagcgtgggcatcaaactgagacccccatctgtacaaaaaatttaaaaaattagccaggcatggtggcatgtacctgtagtcccatctacttgggaggctgaggcaggaggatcacctgagctcgggaagtcgaggctacagtgagctgtagtcacaccagcctgggtgacagagtgagaccctgtctttaaaaaaaaaaaaaaaaagaaggtaaagctgacagactactaaaccttgaaatttctttcacatttgttccttttcagaataagtatttgaacagctcttcttttctacctttgaggtgtatacttgggagaataaagtcaattgacttttggaaatggctagttagaatcaaaacaagagctttccccaaattcggtaataaaattaacgggtgaggaatcagtaaggtttactgctgttcctcctggaaatggcacaagactgatttcctttttccttagcctgagattaccattggatgtgttagtgccctcttcaggtgtaacttgggtactgcagccggcgtccttaaataacagggacaagaaatagatactttaataaaataaaactttaaaataaataccttaaagtttttaaaataaaagtaatatggccacattacaaaagatttggaaaataaaaagaaggaatcagtcgtaattccaccagcaacgtaaactcttggtgcagacattccttgtcagatgtttcatctgtcattagcaaaataatataactgaaaaattagtgattttacttatgtaatgaatcacgaaaagagaaaaaagtaaggtcctttaaatgaaaaaaaattaagtgatatgatattaaagataaagttgtaacctgaaaagtaagggaacattgacttcgttcttttgagaatttttggctttttatttttccagtaccttttgaactagcttgggtcacttccctgtaggactttaggaagagactagccaaggcttcattctttctctataaggttgtgtactagtgtggcagttcgttagcccattgcctcacaattctcttctgttttagaacacccaagataacacatagcacacccaaagaaaaggacattccctgtctgtatcagtggctctctccagtagtgattctctacctgacacataaccagaatcaagcaataatttgtccatagctttaaaaaggtgacatgcaccatcaggagtcaggatctactccccatcccacgtcctttatcccatctcacatgcagctgagagtcactgacttggacagtcttctctaaagagtctgctcatagaaggtaaatttaagacataaaaatgtttaagactcttaatcaaaagactttaattttttctgataaattcaaaaagatagactttaaccagccctgatgtttgagtgtagatgatgagggagaaagaagagtgaaccctatttctgtatttgtcttgggtttctgggtggatggtagaactattttctgatcagggaagaatgtcagtcagaaatgatgttttctttgatgtgtggaatttgaggggctgagatgcctcaaagtgatcccttctgtttccgtagcttcaaattactacctacatgttgataactcccaaatctatactctatgttggtctggtctgccccataggtgatgtatcatactgcctctatctcctggtcctctgtctccgtatatcatttacacaccaatctatttaatcatagttctgatagcgcaacactttttcatagaaaagtttatatggaagtttgatacataaaatagatttggttaataaggccccttctaacctccccatcttagtttcttttttttttttgagacggagtctcactctgtcacccaggctagagtgcagcagtgtgatcttggctcactgcagccttcactccccaggttcaagtgattctcctgcctcagcctcccaagtagctgggactacaggtgcctgccaccatgcctggctaattttttttttttttttttttttgtatttttagtacagacaggatttcactatgttggcctggctgatctcaaactcctgacctcgtgatccatctgcctcggcctcctaaagtgctgggataacaggcatgagccaccgcgcctggcctttttttttcttttaatagagatagggtctcactatgttgcccaggctggtttcaaactcttggaattcaagcgatcctccagcctccacttcccaaagtgctgggattacagtcatgagccacctttaatttctttgtatcttactggcaacaaagaggaaaggaaaaaatcttgttgctctatagctaactttaacttcaattcttaaattttctgttacaattgtagcagaggttggcagtcaaatgaataataatagctgatattgtgttactatctaatcaatagtattctgagcacttctacacattaatccacttaatcctggcaacatccctatgaagttgatcttgtattatcctattttacaaatgagggacccgatgcacagagagattgagtgtcttgtccaaaatcacagagctggcaaatggaagaggatacaaactcaggcattctggagccagagtcatttctgtgctgtactaactctaaagctggggataaagtattttactaggtagggatccatggccaagtggaagccaggaagcattaaggggtgaaataatctttattttattatagttatttatttatttatttatttatttattttttgagatggagtttcgctcttgtcgcccaggctgcagtgctgtggcttgatcttggctcactgcaacctccgcctcctgggttcaatcaattcttgtgcctcagcctcctgagtagctggggctacaggcgtgtgccaccacgcctggctaattttgtatttttagtagagagggggtttcaccatgttggccaggctgttcccaaattcctgaccttaagtgatccacccgcttcagcttcccagagtgctgggattacaggcatgagccaccgtgcccagcatttattttttttttttgagacagcgtctcattctattgcccaggctggaatgcagtggcatgatcttggctcactgcaacctctgcctcccgggttcaagtgattctactgcctcagcctccccagtagctgaaacttacaggtatgtaccaccatgcccagctaacttatgtgtttttagtagagatggggttctgccgtgttggccaggctggtctcgaatttgtgacctcaggtgatcttcccgcctcagcctcccaaagggctgggattacaggcatgagccactgcgcctggcctgaaataatctttaaacatctcttaatgcacaattgtctgtttctggattttctataccattctattgctctattatctttcgaccagtactatagcatcttgataatggtagctttatatttaaaatcaggtcatgttaatcttctaactttatttttcaaagttgttttggctcttctaggttttttttttttttgagatggagtctcgctctgttgcccaggctggagtgcagtggcgcgatctcagctcactgcaagctccacctcctgggttcacgccattctcctgcctcagcctcccaagtagctgagactacaggcacctgccaccacacccggctaattttttgtatttttagtagagatggggtttcaccgtgttagccaggatgatctcgatctcctgaccttgtgatccacctgcctcggcctcccaaagtgctgggattacaggcatgagccaccgcgccttgcctggctcttctaggttctttacatttgaatttgcataggaattttagattagcttgtccatttttacaaaaacctactaggattgtaggccagcgcagtggctcatgcctgtaatcccagcactttgagaggccaaggctggtggatcactagaggtcaggagttcgagaccagcctgaccaacatggtgaaaccccgtctctactaaaaatacaaaattagctgggcatggtggcacacgcctgtaatcccagctactttgggaggctcaggcaggagagtcgcttgaacctggatgcggaggttgcattgagccgagatcatgccactgcactccagcctgggcaacaagaacaaaactccatcacacacaaaaaaaagaaaggattgtgattaaagtcgtgaagaattataggtcaatttggggataattaatgtcttggcaattttgagtcttccaacctttgaaaacagatagctctccattaatttagatctttgttggtttctctcagcaatgttttatagatttcactgtactggtcttatatatcttttgtgagatttatacctaagtttatatatatatatttttgtttgtttgtttgtttgtttgttttgagattgagtcccactcttgtcactcaggttggagtgcagtggcgcgatctcagctcgctgcaacctccaactcctgggttcaagcgattcttctgcctcggcttcccgagtagctgggactacaggtgactgccaccatgtctggctaatttattttattttattttattttttgtatatttagtagagacggggttttgccatgttgaccaggctggtctcaaactcctgacctctggtgatccgcctgccttggcctcccaaagtgctgggattacaggcatgagccaccgcgcccagcctgtttttcttgacttagtgagctggctagaacctttaatacagtgttaaacaggagtagaggcagagagaacttcttgccttctttcagtaagtacgatgtttgctgtaagttactggtagattacctttatcaagttgagggatttcccttccctagtttcctgagattttaaaatcaggaatgaatgttggattttctcaaatgcttttttctgtatcatatggtttttcttttttagttgttaatatggtgaattatggaattcttccttggtggaattctttaaaatggagaattattttgattattgaatgttaagccaatcctgtattttttcaaaagaaacacctcagtcatgatgtagtattgcgtttatttattgttgtgtttggtttgctaaatttttgttaagaattttcacaagctgggcacaaatgtcaagtggctcatgcctacaatcccagcactttgggaggctgaggcgggcggatcatctgaggtcaggagttggagaccagcctggccaacatggtgaaaccctgtctctactaaagatacaaaaaatcagctgggcgtggtggtgcgcgcttgtaatcccagctactcaggaagctgaggcaggagaattgcttgaacccgggagccagaggttgcagtgagccgagatctcgccattgcacttcagcgtgggcaacacactgagactccgtctcaaaacacaaacaaaaacttgatgaaggaagataaaggtgggaaaggggccaggcacagtggctcacgcctgtaattccagtgctttgggaggccgaggcaggcagatcacgaggtcaggagttcgagaccagcctggccaatatggcaaaaccctgtctctaataaacatacaaaaaattagccgggagtggtggcaggcacctgtaatgtcagctactcgaaggctgaggtgggagaatcgcttgaacctgggaggcagagattgcagtgagccgagaccacaccattgcactcgagcctggcgacagagcaagactctgtctcaaaaaaaaaaaaaaaaaaaaaaaaaagtgggaaaggaaggaaagataacacattaaaaaataaataatttcctgttttaaaaagtagttatgcattgattaccagtgggatacattctgagaaacgtcattaggtgatttcatcattgggcaaataccatagttaacttacataaacctagaaggtatactactacatacctatgcaatatggtatcatctatcgctcctaggccacaaatccatacagcatgttacactatattggatactgtaggcagtgtggtacagtgcttagtatttgtacatctaaacattaaaaaaatacagtaaaaatacaatattctaatcttatgggactacagtcatatatgtggtgctttgttgtccacatgtcatttagtacataactgtactatactcagccagaacaggtacatgaaaataaaagagaatgaaaagaaagtttctgctggtcgctgtggttcacacctgtaatcccagtactttgggaagccaaggccagtggattgcttgagcccatgagtttgagaccaacatgggcaacatgacaaaaccctgcctctacaaaaaatagaaaaatcaaccgggaatggtggtgcacgcctatagtcctagctacttgggatgctgagatgggaggatggcttgagcccaggaggcagaggttgcaatgggtcaagattgtgccactgcactccaacctgggcgatacaaccagaccttgtctaaaaaaagaaaagaaaatttcatggacgcaaaccatgcagcctcttgctggttatgaaatacacactagaactagtgtaagtctagtggcttcattttaaactattggcaactgcctcatttctcactttttcttcatatttttcatcctcttctcccccaaggtattagagagggaaaagtttccaaaaaccatgccagtttccttcctttggtgttctatacttggaatccttagtcttctgtggtcaatagagtcatgtgcaaaaacttgactagtttaaggggaattattaggaaacaaatggttttgctgtcttttggtcattagcttggccccatgtttaagcattcggtaacaactgtgaagagcctgctacaaataaagtggtaggtgctctgaagaaaaataaagctgttaaagggaatagaaagtgatgaaggcaggggctgttagacaggctggtcagtgtctgaggaagtagccctgcactgagacctgaaaagtaaagaagcaagccatggggagttggggaggagcattccagacagaggcttgatgtgttgaaccatcttttccaagctcttcctctgttaccttctctttagtcactatgtcccctttctatcccagaccataattccaccatttatcttaaggctgagcccagggcctatattattatgcaggttgtttactgcacacatctaggggcactgtttacacttgttatctttgtaggtttgaatatttctatttcttatgagttttccagcagatggcagtaacacgcatgaagacagggtgactttttctagtttgcacaaaggtcttttttgagacggagtctcactctttcacccaggctggaatgcaaaggtgcgatctcggctcactgccacctccgcctcccaggttcaagtgattctcctgcctcaaccttccgagtagctgggagtacaggcacgcaccaccatgcctggctaatttttgtatttttagtagagacagggtttcgccatgttggccaggctagtttcgaactcctaaccgcaagtgatccacccaccttggcctcccaaagtgctgggattacaggagtgacccaccgcacctggcctaaaggtgtagacactctgatttgcatctaggcacatgtcgtctttatcccttttccttctctgatacatcaaggtccttttctctctgggtcctagcctcattctctaagtttcctcttcctgtctttcaaatattttgaatgtatagaagaattacagttgtgctacaaggaagtcccgtataatctgcactctagttcaccagttgttatcatttggccacatgtgcgttatcatcccctccctctcagtatagatagatgtttttttcctgaaccatttgagagctgattgcaaacattctgcctctttacccctactttggagtgtgtttccattgaacaaaacatctttgttttacgtaaccaacgaaagttattgttaaggaaattttgctttttgttttttgttttttttttttgagacggagtctcgctctgttgcccaagctagagtgaagtggcgcaatcttggctcactgcaagctctgcctcccaggtccacgccattctcctgcctcagcctcctgagtagctgggactatgggcacccgccaccacgcccagctagtgttttgtatttttagtagagacggggtttcacgatgttagccaggatggtctcggtctcctgacctcgtgatctgcctgcctcaacctcccaaagtgctgggattacaggcgtgagccaccgcacccggctgttaaggaaatttaacagtaatttaggaaattaaacattgataaacagtacttttgtcaattatatagtacacatttaaattttgtcagttgtaccaatgatgtctttatagctgtgtttaccccttttccagagtccagtctaggatcacactttgtgcctcatcctgtctccttactctcctttaatctgagaattaagattaaaagaagtaagttcctcagcctttctctttcacaccactgacatttttgaagactataggccagttgttttgtagaatatttctcaatctgggttggtctggtgttttctgattagatgcaggttacatgttttgggcgggaataccatagaagtgatgttgtgtctttctcagtgcatgcactatgtctggaggcatatggtatctgtttgttctactactgatgacgtcggccctctaagccttctgtgttgaaactgttccttgtagttatatgaattctaacatgtatatgcttgaactctgactataggaattctcctacttacaggaattcactcttaagtaggcagtattctattaagttcttctgttcaatctcttagttcatcaagtgagcctgagttccctcccaattctttctctcctttgcagcatcactatctgggactctcgggttcccatcaggagtcataataccttctctttctcctagtaagttgcatcccttagccagactctttgaaccagtgattacttcttatatacaatcagcatatttttagtgttttattgaatcaagttaaggttctttggctctaggaaggttagtcttcaaagaaatggtttcagaagagagctgtatagctgaatgtggggaagaactaggtaccctcaagacaacttgaatcacacccagttcattttatcgcaaataagtcttttccgctaaccttatttgaattactgcatgtcatttacactgtcttagcctctttattccttaaactctaggaggtagatttcattttcttcatttttcagatgtgaggaaatggaggcttggaaaggttaaagtaatatagtgagaaattaccaggacttaaactcatgtctctccaactccaaagcccttgctcttttttgagagcagagagtggctgggaggaaagtcctctagctattcatggtgaaattagccttcatagacagaaatacaaaaggtaatggcagccacgtgcagaggcttatgcctgtaatcccagcactttgggatgccgaggcgggcagatcactagaggtcaggagttcgagaccagcctggccaatatggtgaaaccctgactgtgtctcaaaaaaaaaaataaaagtaatgtcactgctagattggaggtgattgccggcacctgccactcagagagttggaggtgtctttaaaccaggaccatcctgggcaactagatcttacagttggggacttacaaactgggaaaatcgaaatacttctacttaaactcatttcctgacataattattaatagtgccccactcacttttttttttttttttaaacagtctcattctgtcacccaggctggagtgcagtggcacgatgttggctcactgcaacctccgcctcccaggttcaagtgatttctcgtgcctcagcctcccgagtagctgagattacaagtgtgcaccaccatgcccaggtattttttgtatttttagtagagacaggggtctcaccatgttggccagtctggtcttgagctcctggcctcaagtgatccaccagcctcggactcccaaagtgcagagattacaggcgtgagcccctgcaccctgccagccccactcactttttttttttttttttttttttttagacggagtttcgctctgtcacccagactggaatgcaatggcgcgatctcggctcactgcagcctccgcttcccgggttcaagcgattctcctacctcagcctcctgagtagctgggactacaggcacataccaccatgcccagctaatttttatattttagtagagactggcttttcaccatgttggccaggttggtctcgaactcctgacctcaggtgatccgcccgccttggtctcccaaagtgccaggattacaggcgtgagccaccatgcccggcccccactcactttttttaagagtactgcagcttggccaggcatggtggctcatgcctgtaatcacagcactgtgggaggccacagcaggaagattgcttgaagccaggagttcgagactagcctggcagcatattgagaccctgtctctacaaaaaagaaaaaagtacctggacatggtggcacatacctgtagtcctagctactcagaggctgaggtaggaggcttgcttgaacccaggagttaaaggctgcagtgagtaatgatagtgccactgctctccagcccaggtgacagagtgagacgctgtctcaaaaaagggaggaggtagtattgtggcttggataattatatggtcccctatacataatccttcctgaattcttttcagattaacattgagactggtgtttctttataactagcactaatagtgcttggtctatttttatttaccactttctttgcccctgccccaatttatacactggggcaaaattagctttggttttatagtctgttcacctaactaatttataggcctggtttgcataatttagttaacagcaagattttgccacacctgctttatcatcctttctgccaaactatttaaggtaaatggcactttaccccggtgtatttccatagctgaaataagctcttaaatttttataatcctatcctgaaacctaatcggtgtagcagaagaacgttttgcctcgtgagttatcacccctgacataatttgattttcatttataagattctcttagaaccaagtacagtggcacacacctgtagtctggctactcaggaagtgaaggcaggaggatcacttgagccaagagttccaggccagcctgggcaacatagtgagaccccatctctttaaaaaaacaaaaccagattatcttaaagtggggcatacctgtatttgtgtgctaatgtgaggctccacaggtatgcaagacatagtagctgtggatgtttcttataacttatattcccttttcttttgtcagtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaagtgagttgaagtcttaaaagcaacattctacattttagtggaagggttcactgaagctgataggtctaaaactcagacctgactaaaaatcaagaattatggggcctaatgcagctgattggtggcatgaagcatcccctagagaccttgaaatcaccttaagaagtggccaagttagaagccaagaactttttgacaaattagaggctcatacttgaagttcaaagagggagtccttcaaagaagactctaaattctttttttttttttttgagacggatattgctcttgttgcccaggctggagtacagtggcgcgatctcagcttatcgcaacctctgcctcccaggtgaaagcgattctcctgcctcagcctcctgagtagctgggattacaggcatgcgccactatgcccagctaattttgtatttttactagatacggggtttctctatgttggtcaggctggtctcaaacttctgaccttgggtgatccgcccgcctcagcctcccaaagtgctgttttttttgttttttgtttgtgtgtttttgagacagagtctcactctgtcgcccaggctggagtgcagcggtgcaatctcggctcactgcaagctcctcctcctgggttcatgccattctcctgcctcagcctcccgagtagctgggactacaggcacccaccatcacgcccggctaatttttttgtatttttagtagagacaaggtttcaccatgttcggcaggatggtctcgaactcctgaccttgtgatccacccgcctctgcctcccaaagtgctgggattacaggcgtgagccaccgctcccgaccataatgtttgtatttttagtagagacagggttttaccatattggtcaggctggtcttgaactcctgacctcgtgatccacccgcctcggcctcccaaatcatgcatgggattactatgcatgagccaccgtgcccggcaactctaaattcttgagcagggcagggaaagcagagcacctagagcagcgctcggttagatggggttccaagtgcatgtttaatcccccacataggtaagacttgacatgactttcaaaccttgttgtgtctgtgctttggtaataccagaactcagtgttttcattcttggtttattactgatttcctccgtatctcttactagttttcttaacgctggaggtcttaatgaagtcagtaatcttctgactacatttctagtatacaatttctagcttttttgattgtgctgtaactttaactaatgttttcttcacactttcctcttgaaaatcttaccccataaacaatgttgactttaacgtgagcaaatgacagttttttgaaggctcttttttcatagagaaggagaccctgctgtgacctctcaggactacaacagaataggtttctggccacacctgtgctccttgtattttctcttggtggaaatagaaggaataacttacaactttatgtggcattaaaaattttattgcagttcaggtgcggtgacttacgcatgtagtctcagcactttgggaagctgaggcaggcagatcgcttgaggtcaggagttcaagactagcctggccaacatggtgaaacctcgtctttactaaaaatatgaaaattagccgggcaaggtggcaggtgcctgtaatcccagctattcaggaggctgaggcaggagaatatcttgaacccaggaggtggagtttgcagtgagctgagattgtgccattgcactccaacctgggcaactgagcaaaacaccatctcataaaaaaactgctaaaaaaaacccccagtaccctgtttttatgtgttctgggctgttaattacaaatacaaatgtggttttccaaaatgttttttttaaaaaacaaaaacagcaaaattttagcataaacaaaatatagttttagaaactccaggatatgttaatgttaaaactgctaaaaaaaaaaaaaaaagtaccttgtttttatgtgttctgggctcttatttataaatggatttaccttcatgaatatccaatgaggtagtaaaagtgacacagaacataggtcagttctttactgtgcttgactgtcccatgctttgcagacatctggcatatttgcctctgcccactaaatgacagtgtgtctccaccccacctgatgacaacaaaaaaatgctcctacaggttctaacatgcaccctgggaaccaattttacattctcagtaactactgtgctaacaaaatcttcttccatgtcaaatgtatgactgttatttcttcttctggaagagcctacctggacgtagacattactctgtcctcagaagctttccataattacatgaatgctgccatggtgcacatcaacagggccctgaaactcattattcgtctctttctggtagaagatctggttgactccttgaaggttagttgtttctgcagctcttggtggtaaaacagaaaaagcagggactgggttataatttggaggaaaaacagtacataggattttatcagacaaaaatgaacgtatgcttagctcagtcattctataatgggataggtgtcactagagaaaggtatagccttctgctggggaacaaatatcagaagagaggtgatataattggaagcagtgcagtttcagtctttggacctcagaaaactacagacttcactcacataccttcaaatgtataacacaagtagggaaccttcatttggaaattgtccatgtcacacatcactaaatttatgcagacttaattagctggaggagaatgacatcagttaatgtgaattttgccttacggttattcctgcttaacttttgatatggccttcacagctggctgtcttcatgtggctgatgacctatgttggtgctgtttttaacggaatcacccttctaattcttggtaaggtggcaaggagaatgtgcccatgctctttgaagtagtttgtaagaataagagtgaagagaaagcccagcatggctctactcattcttcattgcccagtcttgacccatagagacctgggagtagaggcactggaggaaccggagtttgtggtcacaggtttatgaaatggtctcagttataaattaagaaatatcaaaacagctggaagtaaaggacagttgtctagatttggtttacgtatggggatcttatttacagaaaccattttggtaatttggaaattgttatttgtggtacaaagaaggtagcctgtatacctgaagaggttttttttgttttgttttaacactaccttaaattagctgtcttaattgggagtgctaaccaggatttctcattttgaggaatgcctgtgttttcctgtattttttgaggaaaaatgtatatgttactctgagtcttaagatgtgactgtctctcatatacacttgccatgtcccatgattctgtcttacagctgaactgctcattttcagtgtcccgattgtctatgagaagtacaaggtaagcatttatctgttccaaatcaaatgtgccagttgatgtatgactagttgtagttcatttctgagacattgaatgttcagagcagtctttttataactatttctacaatctaattttgtgagtcaagtgcctataagaaactggtggcagtagtttcctccaaggagagaaactggatatttaggagagagatgactaggaaagagaaacttcctttttatacttgtgtgcctttcgagtttttaatcatgtagatgtattttctatgcaaaagtaataagttgaaaaaatgcttaggccaggggtggtggcttgtgcctgtaatcccagcactttgggatgctgaagcgggagaatcccttgagcccaggagctcaagaccagcctgggcaacctggcaaaaccttgtctctaaaaaaaaatagccggatgcagtggcctgcacctgtagtctaagataggagaatctacttgagcctgggagacagaggttgcagtgagccgagatcatgtcattgcactccagcctgggtgatgggagtgaaaccctctctcaaaaaggccaggagcagtggctcatgcctataatcctaacactttggggggccgaggcaggcagatcacttgaggtcaggagttcgagaccagcctggccaacatggtaaaacttcatctctactaaaaatataaaaattagcccagtgtggggccaggcacggtggctcacgcctgtaatcccagcactttgggaggccgaggcgggcagatcacgaggtcaggagatcgagaccatcctggctaacacggtgaaaccccatctctactaaaaatacaaaaaattagtcgggtgtggtggcaggcgcctgtggtcccagttgctcaggaggctgaggcaggagaattgcttgaacctgggaggtggaggttgcagtgagccgagattgcaccactgcactccaacctggatgacagagcaagactccatctcaaaaaaaaaaaaaaaaaaacgcttagatgggagattgagaccacggtgaaaccccgtctctactaaaaatacaaaaaattagccaggcatggtggcgggcgcctgtagtcccagctactcagagaggctgaggcaggagaatggcatgaacctgggaggtggagcttgcagtgagccgagatcgcgccactgcattccagcctgggcgacagggagactctgtctcaaaaaaaaaaaaaaaaaaatgcttagatgaataaaagccgggtgtctaaaaggaaactttaaactctaggttattcaggtaatccatcagtgtgatgaggtgtttgcattgttggatgatgtgtaccaagtatactagatgccatgagattattctttatggattaagtcatccatcaagagactttttggctttttggtattaagtgaattagtgttacacaagagccataacatatttatgatgacagaaaatagattagacacacagtttctagtcattggaaactgttatatactccagtgtctctaaagaaaatacttaccaagtaagacttaacctctgcaaaagatgagtgattttttcactttaacaaagtgtggggtgtttatggtgtaatttggattctaaaaccagaggttttaaaaatacttttaaggctaggtgtggtggctcatgtctgtaatcccagcactttgggaggcggaggcaggtggattgcctgaggatgggagttcaagaccagcctgaccaacatgaagaaaccctgtctctgtctctattaaaaatacaaaattagccaggcatggtggcgcatgcctgtaatcccagctacttaggaggctgaggcaggagaattgcttaaacccgggaggtggaggtttcggtgagccgagatcacaccattgcactccagcctggacaacaagaacaaaattccatctcaaaaaaaaaaaaaaaaaaaaaaaaaaggctgggcacagtggctcatgcctgtaatcccagcactttgggaggccgaggtgggtggatcacgaggtcaggaggtcgagaccatcctggctaacacggtgaaaccccgtctctactaaaaatataaaaaattagccaggcgtggtggcgggcgcccgtagtcccagctactcgggaggctgaggcaggagaatggcgtgaacccgggaggtggagcttgcagtgagccaagatagcgccactgcactccaccctgggcgagagcgaggctccgtctcaaaaaaaaaaaaaacttttaaaaactgggtgttttcattttctacactggtcagtcgtgtttaaaaaatggttaaactagacaaaagagccgtgccttcaggaaaattggtgatctgtatgttaccacaactgaatttattttccttccttaaagacccagattgatcactatgttggcatcgcccgagatcagaccaagtcaattgttgaaaagtaagtacatttagagaccacatcatcatgaggtatgcttccttccccccaattatctttagtcccttgtacaaaatgcagatgccaaggaaagtaattttcattttgataaaaaccttagttaatagtttcattttactaaaaattattatagctgcttctataaaaaggaaaaaaaatcctttatatctttttctggccctgccttctggacctttgtaggccaggcattttgactcacatctgtaatgccagtgctttgggaggccgagacaggaggattgcttgatcccaggagttcaagaccagcctgggcaacatagctaggccttgtctctactaagaataaaaaattagctgtgcatggtaacacgtgcctttagtcccagctactggagaggctgagacaagaggatcaatgggaaaaaaaagatcagtggaattttttggagacagggtcttgctttgtcacccaggctgaagtgcagtctcgacctcctgggctcaggtgatcctcccacctcagcttctccagtagcaaggaccataggctactctgcctttttgaactggcttttaaatgttcttcattacaggctgggcacggtggctcacacctgtaatcccaacactttgggaggccaaggccggtggatcacgaggtcaggagttcgagaccagcctggccaacatagtgaaaccccatctctactaaaaatacaaaaattagccaggtgtggtggcatgcaactttagtcccagctactcaggaggctgaggagggagaattgcttgaacctgggaggcgaggttgcagtgagcagagaccatgccattgcactccagcctgggtgacagtgagactccgtctcaaaaaaaaaccaaaaagttattggttgcttccccaccttcatttattttcacatgtattcatttaagccaaacgtatccctctcagaaacaaaagttctagtaaataagtaacttaaggatcaaagttgtcttttctaagattgccaaatctctgttcccatttttttaaaccaattaataaatcaggaaataaaatattgacaaacatctttatgactccctatatcaaagagttgttttcttctttttactttttttccccatacctagaggacagtattttttttcttttttcttttttctttcttttttgttttgctttctagagacagggtctcactctgtcacccaggttgaagtgcagtggcacaagctgaaagctcactgcagccttgacctctgacctcccttgctccaagtgatcctcccaccccagcctcctgagtagctgacactacaggcatgtgccatgccctggcaaattttttattttttatagagatgggggtctcactatgttgcccaggccaggctttaacttctggcttcaagtgatcctcccaccttggcctcacaaagtgctgagattacaggcatgagccctgcttttattttgaattattcatagcaaatactgtgaacctaacgctttgaatttgttaacatttttctttttttctttttttttttttttttgagatggagtctcgctgtcacccaggctggagtgcagtggtgcgatgtctgctcactgcagcctccacctcccgggttcaagcgattatccttcattcacctgcctcagcctcctgagtagctgggattacaggtgcacaccaacacgcctggctaatttttgcattttttagtagagacagggtttcaccacattggccaggctggtcttcaactcctgacctcatgatctgcctgcctcggactcccaaagtgctgggattacacgcgtgagccaccatacccagccgggagaatgcatttcacattgcttatgcaagtccaggactgtcctctagcatcacagttaaaataaaaacctagagcaaatgctaatgttttcactttctttctttttcccctccttttctcaataggatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggatttttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaacacaaacaatgactgtggcatcattctgctaactttattctttatacacagtttgggtaaagtaagaaccaaacactgcttccactccccctatcctcactccactttggggactttaaaaagtgactaatagttggtactcgtaaggattcccaagactgcagaatttagttgtacagcataactgtgcatttgatctctgaaagaaaataagagaccctctaagaggtggtgaccttagaagaatgaggaggggtcagggggtcttttaccccagttcagcctcacaccagcctgggagattttcccacctgcaacgcaaagcagcctgtaaattacatatagccacaatacacttaaattgagtcaatcaccgtggaaaatgggaactaaatacatcatcaggtcttcattgaaagaacttgagtggtcacctgtgattagctcttctcctaaactaaggctgctgtgacccttaagctggcttttaaaaatgtattcaacatacctcttagaaaacttaggctgaaatattttttaaatgactgatgcaaacaatttcacaaatacgcatacaaatgtttgaataatgtcactaagtaacatggtatataaatatgtattcagagtaacatttacatattggccataatagcaagcataccattaacaacaacaacaaaaaaaatcatgaagagacttcacctgttcatgtcagaatcccaaggcaaggaggcacacctaggcaagagggccaactcaacttgcaacgtctaacctgtgaggccataacttccatcaaagcaggaatcaatggaatcactaccgcagcccttccctttcactggtgcccggcacttcagctgcatcaagatcaatggagggctcatgaaaacactgctaggccccaaccaagtttctgattcagtaaccctggggtatggcccaagaatttttatttctagcagattcctaaggtgatgctgctggtctcagggacacactttgagagccactggtgtgtttggggctgtctcagtaaagatgtccactctcctgaggcctctctctgcctacggaggggggggaatctaacccctctgccctggcttatccgaactttggcagtgggcttgagtgattataaattggttcccccaatttgcctactgtttttgaatgggcagagtaaaaaaagtggtgttaatactctggatccgaaaaaatgcatgaaggaaagtaaaagaatggcagtgcccagcctggtgccatccataatctccgttctcaagcttttaatactgtctcaaaaaccgtggaggttcaaactcactgggaatttacttttcagtcaattgacaacccattcaggatcttcctgaatccctggtggcctccacaacaaaaagcacaaagccccctgccgaggcagccttgggccctgcggcagccgccccacctctggagttctgctggggaggggaaggacgattggatggcgccttccagctgaggccctgcagagctcagtgtgctcatcccaaggcagtgtgcagggctttgccaccttcaggagtcacagatccaccgtggtggcctgcattgcccagcatgtcaatccttcggcaggcctgacaaattttaataactgaccagcgaattgggaagcagtgtggcatcgtgcaaagaacactgagtcaggagctaggattttcattctagttcttgtactgtccctacctggctgtgtgatcatctcggttcctgggctccaatttacctatctgtgaaggtgaggagggtagtactagtgatctccagggccctttccaattctgacaatcctcaattatataaaaatgctataaaatccgtggtataaaatccaactcccaaacaggaagcgtcaaggggactgggcctgaggcacttgaaccttaggctctggcctgggggtcagggatgagaggaggggcctcctctttgccctctgctttcccactcctgggctctggcctgggggtccggaataagaggggcctcctctttgctctctgcctttccaccccgaggcaggggctggaccacgctgcccaggcatctcttcctccagacccaaccctcaagttccacccactagcctccccgccccggctttaggaccgcgggaactgttcctgcagcagcctggctttgtgaagagcagacagtagggcccggagtctcccagcgggattaacatcagcacagctagttggggtcctcccgtccccgcctctgccctcgctcctccttccttcaggtcctccctccaccacctcacagcttatctctgatacacgcataataaataagacatttgcacataagggtgactgggtcagctctgtccccgcccctccccctttcatataaaagcattaaatacagtttcaaaataaaatacaaagagcaaaaaagggcctgatctcggggccacctgttctccacaggagaatgaatctacacatccctctcggacctgcctgggagatcgcggggccccatccctgccacacagggcctgcggctgccacggggaaaagaggccgaggcccggccccaggccctgcgggttgagaacggacgccgcatccaccgcggacaaagggggatggggatggggcgggaatcgaaggctgactgccgggaccgcctgtgccccgggctcccacggacttggtttaggggtaagcagagaccctcggggcaagaggagcaaaggaaaaaagtgctaatccctttacaagagctttcctggagggcgtggcagcggcctgggaggagagtggggccgccgggcgcacggttctcactgagcctgccggggaggtaagcgcagctggtccagcccgggccccgggcgcgtagccccgccctcggtccaacgcgccttcccaccccgggaaggctcccgagccctgcggcccagcctcccgctggaagccccagtccgcagccggggcctccgagaggccgagaatcccaattagggaagggcagccagcagcccccaagccgggagccgtgcctgccagcgtgcaaggctgcagggaactgggcccccagccagggccagagccagagcccgcacggccccccttcggccctaatactgactgacggcgcccccagtcccggcctgcggagaaccccctcgcggggtgcggccgggagcgctcggcgctaacacgtggaggccactgaggattctcggaaaacgtgggccctgcgcggggagggcagggctccgggccgatgggagagtgcgcttcccgcagcgcaccgactggctcagggacccaagtggcaccgcgcagacgccggtggccccacccgatcccccgtctccgcccggcccggccagcggggggcgcggccgcgggaagcgctaacaccggacgcgagggtctcccagccgaagggccgggcgagcacagggcggggcggggccgatccgacccgacccgacctgacccgggggcccgctaggccgctacgcccgacacacagcgccagacttgaggtccgcgccgccgtcacgcggcgccggggcgggcggcccgaagccctcgtggccgtagcagcgcagcgccgcctcctcgtaggcctccaggatagtctggcgctcctcaggcgtgaagtccatggagaaggggtgcacctgcaggatgtggcgcttgatggtgctcaccttgagcgtggccagcgcgcccccgcacaccatacacaccaggccgcgccggctgccgtcgtagtccatcaggtactcgccccgccaccgcggctggtagttccgccgctgctcccggctgcggggcgggggcggaggcgggggaggaggcggcggcggcaaggcgagtcccccaggctcctggccgtcctcttcgtcctcctcttcttcggcgggccgctccaagggagctccaggggacagcggaacgtcgcctaaggagggacaaaggaccgcattggcgacggcggggggcagcgggctgggccccgcgtctcatctccagtcaccccatctttgcccttctatcccatcctccagtcccttctgccccagcaactgcccggctctccctctccgcctgctctggccccaccgctcaccccactcctcctcctcctcctctggctcctcctcctcgtcccctcccccctcgtcggaggctgcggcagtgccgggggggatggggccctggggggactcggggcggggcggccccagggccagcaggtgggcggccttctcgctccactcccgggcgatgagggcctggacaggcccgccgaggcgcgtggagcccgggtggcgccggcggatgtggcgctcgatggtgctcatcttgagcgaggccagcgcgcccccgcacaccccgcacaccaggccgcgccggccgccgtccaactccatgaggtactccagccgccagcgctcctgggggtggcggcggtgggcgcggccccgcggcgaccggcccgggacccccgccctctcgccctcgccctcctccagctcctcctcctcctctgcgggcccgggcctctcagggacccagccagcctcttcctttacgtctggggggctgagatcctgagaggagggggctccagcagcggaggccgagtcccggctctttccggtcaggtcctggggggcgaggtcatcgcctgttggggaaggggtgagggagaggggctcagcctgctggctgggttgcccttgcccactcagaggggtccatcctggctcctcaccccagccccaagctagaggccccagtctgtctctgtctgggggcagggggaaagtatgtgtgtggagcaccagctcctggccttcagccctcagccctaagtccctgcctcccagttttggccacagaccccacttcagagccccagtatgagggggtctcagcctgggatgggcctcgcacctggtggggactgggtgagctcagacagcgcctcgggctggcccccccaggcctgcagcagggcactgcgctgggggccgctgagccccagggagccagggtgcacctccagcacgtgggcacggatgtcgtccaggtgcaggctgggcagtgcccggccacaggccatgcacaccagccggttcccccgcgggtcatagtccatgagacactcggcccggaaccagttctgcagggactccttcagcctcctctccaggcgccgggcccccagccccctgctgcccccggccctccgggaggctgagaggcgcagacgccgagcccggggtgccactgggccccctcgccgctggcgccggcagcccccaccagctggggctttgcctgaaagggttggagggaaggaactgagacgctggccccacgggagcatacccactacagccaggtctcccacaagcctctcactcacttgggccccaggcctaacctttgcccttctcttcctctctcctgaaatcctaactccctaaaccctcctctgctagcatttcaagcaccacccacacctcccccagactggaatctagccctgtccctggccttcaccgtcagccacacctctccagcaccctccccttccctcacccaccccagccaggcctccctgctccaagcctttccactgcctgtcacccaacttctctccttgatacttcaaaaaccacagaatgtacaagctgtcatggacatcggagaccctctcaccccactgtccttcccccacctttgtataataagggcaataaacagaccccacccagaggaggagcagtgccttgctcaagaacaccagctccttggcagagcagctggcccactgtgccccactggccacccaggcccctgcctgtacagaatctgcatttgcattacctgggcccttgggcgggcaagctgggacaccggccccctcctcctcctcctcttcttcctcctcctcctcctcctcagccccctggacccccaggccctcggcctctccgcaggcccccagccccaggtgtgcatcccagctgttgctgatgacttccttctcccggggactccaatgcaaggagtaggggtgcttttggcggatgtggcgcttgatggtgctgagcttgagggtggccagggagctgccgcacaccatgcacaccatgccgtgccgggcagggttgaagtccatcaggtactccagccgccagtggtcgtggtagtagcgccggtggtcacggccagggatgcggctctttccaggcctcgaggcccgggcctcacagtggtctgaatatttcctgcctgaagatgctggtcccctggccctggaggagggcaggggggcactcccccaggaccccaaggcacccccttccagctgaagatcttgccctgaagaaggggaaagggagacagtttttcaatctctgatttccagggaaagaggcgagggctttgatggtgagccctgagaaagggagctgggggagggggtgttccggggcaggaaagggacggcaacagcaataaaagggatggtagaagtgggagccaaaacattagccctttacaaagggcaaggaccctttaagaggagatcaagaacaaaaggacgcagggcactgtggaaatagctctgactttttaaaaaataaggtgagggccaaggagccaaccagctctgtaaggtgccctttctggacaagagccgtagggagaaagccaggagagcagcaggccagggcggttccagctggagcagagcaggcagtggggccagacaaacaaagggggcatctgtctacagccagggctgcacacgggacccacccacctggggcccccgccaggagggccccacccacaggtcttctccctttttccagtaatgcttcaaatatagcttcctgagactcccattttggggatgggctaggcattgtcagttccccaaatctaggcccccacatgggagggatccccaagacaaagctgccaacatctccagggaaaggagtttctgagactgaaacttctccagattctggaggagccaatgaccctgtaaagggatggcaggagggccaccagagtgacaactaatgacactgcggcagggagtggccaccatccactgaagcccattaagtctttctggggctttatttgctgctctggcagggagccggccactgcccagcagtcagaagggcgggcactggagaggccccactaacccaatggtgttccctgtgccagacacccacccagagcagtcccctaccctccctacagttcccacccctcttgatttagaaaaatggtctcctgggcacacaggcaggttctggtcattctcccagtggagaatcacagggttgggaaaacaaaagacaggatcagaaagggctcctgtcacccttgtggaagtttttttgttttagtttttatttaagtagatccatagaatccactggcttcggagtcataggcctgggttcaagtcctggcttcactggtaacttgctctgtgacctttgataggtcatgtccgcactctgggcctgagcttctttgtctgcaacgacactggctagctggctggtctctaagcatccttccagcgctggatccaggctagtctaaggtggattggccctttaagagccgaaaaagggggaggagccgaggttctttaaaaacaaaaggggatggggcgtttctgggaggggagagaccgggaggggagcctggagattcgggcagagtctccctggcctggaggaaaccctcaagggtcttaaggcgtgaccctgcagccgggaaatgagtcaacagtctcctttgagagcgaacgaggaggactggttggttccgctagagctgacaaattagggcaaaaaaaaattctgaaaagaagggaagggagaatgcaccggccggaggggtgcctgcctttgtgggcgaacccatcgctttaaaaactgcccgcggtgggaaaagatggtgtgggcccccggggcgcaagcgatgcactttcctagggagaatgtgggagaaaagaaaaagggtgcatgtctctcacaaggccacgagacgagaggagcagcccgatttaaaacagcagagttcggagctgagctcagctccgctggggaaaagcccccgaaggggacccagggtctgggcggacttttgagagaaagcccgattagggagaccacctgggagtctgaaagagaaaggggcgggggccaaagtccagcctcgctccgtggcgccctgccccgtggggcccctcgggcctggcccccaaggcggggcgctgcgggcggcagcggggccctttaagggggaggcgagccgcccgagccccgcgagccgaccccgggagctgggcggggggctcccccgccagccctgcagccgcgctccgcgcccaccaggtggcgcccccggccgccctgcccgcgtcccccgctttgttcggcggcggagaggggccccgagccgcagccctcccttcccccacgccggggcccccgcccgggccgccggccccagctcttaccgccttcgtcttcctctggctccgcgctgccgctcgatccggcgggcggcagccgtcggccccgtgccgaggccactgctggcccggggccgcccctgccgccgctgctccggctccggtggtccccgccgggctccatgcgctgcgctgcggagcggggccccggggcggcggggcgcggggccgcggggccggcggcagcccgcgcggagcgctcgctgcgcggggccccggggcgcggggcgcatgcacggggcggccggccgcacggacggcaggctgctcgctcggcggcgcgggctggaccggggtggggattcctgtctggggcccctggggctcctttaagggctcctgggtaaatttaaaggggccgcgcgctatttcctcctgccagctcgcggggggctggggggaaaggcgggaggcaacgagcccagccgaggctcagcagcctgcgcccgctccggacgctaggggcacggacctcgccgcccccgcgggcccgcaccgccgcctgcggggctccggtcccggctcccaaagggtcactgaggtggcgaggggcgcccgcgtccgctgcgacgcgcttccacccgggctcggctcgcggccaccgccccctcggggcatctcagcgccgggagcgcccgctgaggaggccggggtccctgcccggggctgcctcccgccgcgcaagcgggtcgcgagctccgtgcgggccccggagcggccgctactggcaggggccccagatggctgcggccccgccgagagggtggagccgtgggggcggccgcgccccctcccgcgggagccgcccgggagcgctgagagctcgggcttctcatgggaggggcggacaagcgaggctcccccgagccagccaggggtgggggcggcggccgcagtgactcgggctggggagaggggcgcacagcagacccgcagagagccggctgcgccggggcccgaccctgcgggctggaggtggccccaggatggaagccgggaggagagggcgtgcgcggcggtgactcaggatcctgcccccgcaggcctgggggtgcctgacgaggcccttgacgcagccccagacccccggcccggccctaggaagcgaaaaatgctggccccgggcggggtgtcgggcacctggggaggcgcgttaccacggctcggaagcgctgggcggaccctggctgcgggtcccggggcgcccccggtcccccagctccggagaagcggagcgcagggacccggagaggcagccggggcgcagcagcctggggtcctcctgcgaggaccggcgggaggagcaggtgctcgctttgcctgaggttgggcgcccacaacaaaggcgattcctggagatccaaattacagggtgcgggaggcctgcagggtcttcttatctggaggcgggttttgttccctgcactggcgagttacccagctgtcgccgatggcagttcgtccgcttgtcaccacctactgtgtgcccgcatgctttcagacgctggacacacagcactgaaaaacatgggcaagaccgatactgcctgtgactttccttctcagaggcacccacagcctctgaaaaggaaaccgctccagcctttcgggagccatgggaattaaattacttggaacacaggaaacctgtccccgaagtgcttatgaggaggggacaagaactaagatttcttaagtgcctctgggctctgtcgccgcggagatgtcccgtctcttcctcagcccccatgttgacgtgcttgagactccaccttgggtaaactgagtctcctttcacagctctgctctcttcgcggcaggccctgcgctcaggggggcgggggggggttgcacttcctctcacccactggggtcagaggccctgatgctgatgggtgccacgcaggccctgagatgggagattccttaattcattatgtccctcatctgtgccaggcccgggaacacaaagggaaagtgagacagagacctgggcttcacgcacttctaagtagtatggtttaaaaaaaaaaaaaaaagaaaaagaaagaaagaaaagaaaggaaaagaagctaaaagagcctaatgtcctaaaatgaaagaagcctgttcttctggggccaagggcccttgtgctttattctagtttagttgctcactccacagagaaccaatgctgagggccagcccctgtgagactctggtgtctgtcctgccagtgctctgtgtgtataaaaagggtaattttattaccagaagaaaggtatcaaagccacctggagccaccttcaacaacctctgccctccccttcccacccacattctgcacgacctcaggaacggctgcacgcttgacagttctaaaagtttcccactcactacttgatccccgcagcagccccgtgaagctggaactttgttgtcgggatgaagaaatggagactcagagagtcaagagccttgcgcaaggccattcatttatttctgcacttcttttcttgttcagaaagcagtcataagtgatgagaacagggctgggggtgcagagacttaagaataacataatgcagtgggggggtaccccccaaccccactgggggaaggggaaaccaatggcagtgagtcagggccacattctcactttctcaggccttaggtgcttttgtcttcatgaggtatcttcctctatttaaaaaaaaaataaaaatttaaataattcagtagattttcatgggccctacgcatttatttttttgatgtgagaaaaaaaattgtctttgacccttacatttttttcatctaattttaaaataaaacattttcatgagcccctaaaagtaccttgcactctaggcaccagtgcctcggtgccctgggtccctggcactgattgcagtagagggtgataagcaccaaggaaaagggaagccccaggaagggtcacccaactggggaagacttcctaaagagggcattgtttaaaccaaaactagaaagaccagggtattgccagaaggagaaagggaacaagggtttcctggcagaggctgggaaaattctggatgaaggagggtttcaggtgggagagggagaagaggaaatagaaattggcagggactagagccttaggtgccacatggagagtctcagtttgtcctgaaggcactgggaatgctgggaattgtggacaattatggaggcagctgggagaacgctggggagagggacagcaacaaagacccatgtcaaggcagcagccccagggccaatggagaggaggcaaaagatttgagcagggccacagcacatcatggtgtaaacttcactgcattgaggaggaagagaaggaagaggtggtggcaactggaggatgaataccagctgagtgaggaggaggaggagaaggaggaggaggaggaggagaaggaggaggaggaggaggtggcaactggaggatgaataccagctgagtgaggaggaggagaaggaggaggaggaggaggaggcaactggaggatgaataccagctgagtgaagagaaggaggaggaggaggcaactggaggatgaataccagctgagtgaagagaaggaggaggaggaggcaactggaggatgaataccagctgagtgaagagaaggaggaggaggaggaggggaagaaggagaaggaggagggcaagaaggaggaggaggaaggggaggcgaccggaggatgaataccagcaaagccaggaaaaaggatacctcttctcaccaaggggctatttcttacctaagtgatatacctaaaagttgcttatgcctggggcaggggtcaggagtgttgagggctagtagtggttctagcttgagcatatcaagaagatagaattacaggacatggtgtctgcttgaatgtgatgatccgggaaaggccctgctaactcccaagtatctggattgagaggatggggctataaaaagaaaagtagatttggaagtagaaaatgaggttacaggctgggcgcagtggttcacacctattacagcactttgggaggctgaggtgggtggatcacctgaggttgggagttcgagaccagcctgaccaacatagtgaaaccccatcactactaaaaatacaaaaattagctgggcgtggtggcgcgggcctgtaatcccagctactcgggaggctgaggcaggagaatcactcgaacctgggaggtggaggttgcagtgagctgcgattgtgccattagcctgggcaacaagagtgaaactccgtctcaaaaaaaaagaaaagaaaatgaggtcacaacctgagaactttggagcccatttcaaacccagaactcctgatttttacaccttacctcttccattctctaactcagattcacttagtcccctgtgtggtgtctccagccagccctagaacttctaaggttgttggtcccagccttcaagggccagcgtcccccagtggggcagccttctcctagtgcttcagtggctccttgggcaggtcccgttaaaaggagggccactgacaacaaaaacagaggaactgtgaattgtgttcccaaaggaaggtttttaaggaggtaaaacattaacctccctagacccaactttgtgacaaattctggattctacttttcaggatatctcagaactaaaaaaaaacaaatcctggttctaaaagtagccttcaacattctccagagagcagacccaaactccttcaaaaaactaagatcggtcatataggctgtaatgttaaaggaactttctatgtagattgtaaattaaatcatcccttgtaaaatcccaaaggaatttcaaacttaaggattatatccaggtctaagccaaaaccttgagctttgaatgtgtgtgttgaggggagagagtgtggaattttatttaatttaattaatttatttatttttttgagatggagttttggtcttgtcgctcaggctggagttcaatggctcactgcaacctctgcctcccgggttcaagcgattctcccgcctcagcctcccgagtagctgggattacaggcgcccgctaccacacccagctaatttttgtatttttagtagagacggggtttcaccatgttggccaggctggtctcgaactcctgacttcaggtgatctgccctccttggccccccaaagtgctgggattacaggcgtgagcaaccgcgcctggcctaatttttgtatttttaatagagacggggtttcaccatcttggccaggctgatattgaattcctgacctcgtgatccacctgtcttggcctcccaaagtgctggaattacaggcgtgagccactgcccctgacctaatgtttgtatttttgcagacatgaggtgtcaccatgttgcccatgctggtctcaaattcctgagctcaggcgatcctcccacctcgacctcccaaagttctgggattacaagcatgagccactacgcccggcttctttctttttaaaattgtaagaacacttaacatgaaatctatcctctaaacaagcttttaaatgtacagtgcactattgttgaccataggcactaggttctacagcagatctctacagcctattcatcttatttaactaaaactttatgctcattggccaggcgcagtagatcacgcccataatcccagcactttgggaggctaaaaagggcggatcaactgagatcaggagtttgagacgaggctgaccaacatggtgaaacccccatctctactaaaaatacaaaaattagccaggcatggtggcacacgcctgtagtcccagctacccaggaagctgaggcaggagaattgcttgaacccgggaggcagaggttacagtgagccaagattgtgccactgcactccagcctaggtaacagaatgagactccgtctcaaaaaaaaaaaaaaaactaggccgggcgcagtggctcacgcctgtaatcccagcattttgggaggccgaggtgggcggatcacaaggtcaggagatcgagaccatcctggctaacatgatgaaaccccatctctactaaaaatacaaaaaattagctgggcgtggtggcgggcgcctgtagtcccagctactcgggaggctgaggcaggagaatggcgtgaacctgggaggcagagcttgcagtgagccgagatcgtgccactgcactccagcctgggcgacagagccagactccatctcaaaaacaaaaaaaactctatgctcattgattagtaacccctctttcctcctttccccagctcctatcaaccacccttccacagtttgattctatgaatttgaatttttaaaaaaatttttttttagattcaggatcttgctgtgttatccaggctggagtgccatggcacaatcatagctctctgtaacctcgaattcctggtctcaagggattcttccgcctcagcctcccaaataactaggactacaggcacccactaccacacctgactaattttttaatttttttgttgagatgggtgtctcctcactatcttgcccaggctggtttcgaaccccctgcctcaagcaatcctcctgcctcagcctcccaaagtgttgggattacagttgtgagccacatgcccagtcaaatttgactattttagaaacttcatgtcactgaaatcatgcagtgtttgtctttctgtgactggcttagttcacttagcataatttcctcaaagttcatccatgttgtcacatgttgaagaatttccttctattttaaggctggataagattccattgtatgtatacaaagcattttcttcattcatctgttggtggacatttagtctgtctccacatcttgactattatgaataaacatagaagtgctaatatatctctgagatcttatttgaagtcttctggataaatgcccagaagtgagatttacagtggctataccatttctcattcctaaccaacagtgtgcaagggttccgatttccccacatccgtatgaacagtgattgccctgtacagcgaagcactctgaatgcctcagctatgcaaaccatttactggggtgacttgatcaatgagaaaatacaggatagccggctgggagtggtagctcatgcctgtaatcccagcactttgggatgctgaggcaggtggatcacctgaggtcaggagtttgagaccagcctgaccaacatggtgaaaccccgtctctactaaaaattagctgggcatggtggctggcacctgtaatcccagctactcaggaagctgaggcaggagaatggcttgaacctgggaggcggaggttgcaatgaaccgagatcacatcattgcactccaacctgggctacggagcgagactccatctcaaaaaaaacaaacaaacaaacaaaaacacaggatagtcttcttggccctacctgttggtgccaatggaaggataattcttagggccagggcacaagtgtcctgagttccccctgccagtgtggaaaaccacagatgcactggacggtgctcctcagagccagccttggatgctggctgctgctggctccccaattcctggttttagggacctctaagatggccccaatgtcctaacccgtccaccccactaaagagggacagtcccataatggtccaactctttgacaagaccatgagcaaggatgaagaacaaggggtagttgaccaacaaggccttcattcctgtccctctttattaaaaaaaaaaaaaacatagacacagagtctccctatgttgtcgaggctggtctcgaactcctgggctcaagtgattctccagccttggcctctgatatggtttggctgcgtccccacccaaatctcaccttgaattataataattcccacatgtggagggtgaggccaggtggagataattgaatcatgggggcagtttccccagtattgttctcgtggtagtgaataagtctcacaagatctgatggttttataaatgggagttactctgcacaagctctcttgtctgccaccatgtaagacatgactttgctccttattccccttctgccatgattttgaggcatccccagccatgtggaactgcgagtcaattaaacttctttcctttataaattacccagtcttgggtatgtctttatgaacagcatgagaacggactaatacagcctcccaaagtgctgggactacaggtatgagccaccacacccagcctgtccctctttaaatgtgtcaaaagtgtaaattttgtatttctgtctcctttccataacctcagagtattccagtggctgcttactgttttatcaatcccctcagactgagtcagcaccttttttttttttttggagacagggtctcactctgtcgcccaggctactagagtgcagtggcacaatctcagctcactgcaacctttacctcctgggttcaagcaattctcctgcctcagcttcccgagtaggtgggactacaggcatgtgccaccacgcctggctaattttttgaatttttagtagagttggggtttcaccacgttagccaggctggtcttgaactcctgacctcaagtgatccgcctgcctcggcctcccaaagtgctgggattacagcatgagccactgtacccagccaaatcagcacacttttgataataaatgattaaaaataaaaataaaaataaaactggcttaaaagtttaaagcaggagagggtgtattggttcatgggactgaaaattaaaaaatgatcttcagatgtggctcgatgcaaggttcaagcagtgtcccggtgatcttaatgtctgtctgtctgtctctctccatctctaccctgctcccctgtttgttggctgtccttttggaaaggtctttctacaggatgaccccagcacctccagactcacagcctgacaactggaaggctcacagaaaagaaagagatcttctctcctccaacaatgtgaacaaagtcccaggtctaaatctcactggatcacattggatcatgagcctgtccttcaacgagttactgaaactaaactcacgggatatgccattcacttaagcctgggtcagaggcccgctcctggaggagtcagcactcccaactatgtggactaagggtgctctctataaagaaaaactggatggagttaacacaagaagtaatgctgaacagcagaaacaacagaagtctagtcactcatgttgagaacatattgccattccaattaatagcaagacacagtaacaggagtgaggcacatcttaggggttggcccttccattctatcccttcacagccctgtaggaaatggctctcctctgctctctggccagctctccaagggctgtccccaagatcaatcccttccgacccagaatggggcccacagcagtcacctttcctccaaactttccagcccaaaagcctatagttgcctacccagtaagagtggtcactctgacccatgaaagaccagtcagatctctctcctgacattctttttggggatttcatagacagccaaatgatctctgagattgacttgaaactgcacaaatctatcatgaagaatagaagcaagaggccgggcgtggtgtaatcccagcactttgggaggcagaggcgggtggattacaaggtcaggagatcaagaccatcctggctaacacgatgaaaccccgtctctactaaaaatacaaaaaaattagctgggtgtggtggtgggctcctgtagtcccagctgctggggaggctgaggcaggagaatggcgtgaacccgggaggcggagcttgcagtgagttgatattgcgccactgcactccagcctgggcgacagagcgagactctgtctcaaaaaaaaaaaaaaaaaaaaggctttggtctttatactaagagaaatgggaggtaactgaagagtgtgtgtgtgtgtgtgtgtgtgtgtgtgtgtgtgcgcgcgcgcgggtgcatgtgtgtgtgtatgtagagattaccagatttttattttgatagaataactgtggaaatatatttcaaggggacaaagagtagaggcaggaagactgattagaaggctatcgaattggactatcagagaaagagaggctgccaggaatagacagtggagaaggaaatgcagaaaggagcagatttcagagttacggaggaaggaagtttaacagaataggggatggactaggggagaaaagggggttccaaggatgagaatgaagttttgagtttgcatgaaaagaaagatagtattgctactcattgaactgaaagacagtagaagagaagtgggcttggaggaaggggtgtatcagcttgagtaacagatagggtgtatgtgttacatttggctgcaagtaacagaggacagaggctaaaatataaagctctttgttgtttatgtaagaagtccaggggttggaggtcccagacttagttcaaattcttcccactcttcagctccatcatttttagctggcttttaactcttttgtttgttatctcatgatcaaaagctgtataccacagctccaaatatgtgctcataccagcattccaaggaagaagaaagagacaagggcaaaagttctttcctccagaggctctgtcttttatctgggaatcaaactcttccctagaaactccccaggaaattttcccttacctctcattggccagaactggttgcatagttgtctctggctacaaaggaagctaggaatatttgtattcagtatttggcaacaggaaaagcaattatcattggtagtttaaccataattcatcccccggggttgcggggagagcctgtattcctaaaaatcaagggatttccacctacttcctgtaccaagcagacatatattggcaggatacaggaggctgggaaggctggtgggtcacaatgaactgagcatacataggtacactatcatttgtgcatatcatctccatttctttctggaaacaccagcttcatttttccttctggaatgatacctcttctcacactcaaactaagtggttttggtatagctgatttcatcccccacactgagttgacatatgacccaggtagggttaccagataaaacacaggatgcatacttgggaatactaatccaaaaaaatttattcattgtgtatctgaaattcaaatgtcctgtatttttatgtgctaaatctggcaactccacatccaggcctattaataggacactagattgatttggaaaaggccatgagtcctaaggtaggctgaggagagtcatcctttggacatctgctggagctctctggaaagagcctgtctcattctactggggttgcaaagctagcagaacatatgatcagctgcagatatgtgcccatgacccaaatctggtccatcagaatactattttccccaattacaatgtttgactgatagctgggcatataacccaacccaagccaagtcagcaagacttgaccatggagctgatgacggaattaatgggcaggagaaatctctgtccacgggagttgctgagcttgaggaatgtaagcctgaagctgctggcagatatctcacccctgtgagaggagggtaggcctaagagtgaagtcagaagagagaaaaccagaagcaagagatggaaagacagacatcgagtcttctcaatatcattttaccctgaagtcaccctgaccctggacttactggttaattgagccaataactttccataatggcttaagccagtttcggttggggttctggcacttgccaccaagatagtcctgattagggaagatctcaggttcaattttacacgcagtaaatttgagatacctcagagtggagacatcaagttggctgatgcaaatgtgggtctaatctagaggtttaaattggtaattctcctttgtatagatggaaagtgaattccccgtgcaaaagcagaagatgggtcttcattgaacatttgatgaataaatgaatgaaggcataaacaaatgaatacaacagtctgattattccttggtagccatttaaaccagaagtgctggctaggcacggtggctcaacctgtaatcccagcactttgggaggccgaggcgggtggatcatttgaggtcaggagtttgagaccaaccaggacaacatagtgaaaccctgtctccactaaaaatatgaaaattatctgggcacagtggtgcgcgcctgtagtcccactactcgggaggctgaggcaggagaatcgcttgaacctgggaggcgaacgttgaagtgagccgagatcgcaccactctactctagcctgggtgacagagcaagactcggtctcaaaaaaaaaaaaaatcaacaaccagaagtgctgacaagtccaagtagatgagataaatagaatgaatacagctcaggaaatcattagtgaactggcagaccaacttgagtaactttcccagaaagaaacaaaatacaaaaaataggaaaatataaaataaaaactataagatgcagagggtacaagtagaagtaaaaatacccagataataagatttcagaaagacacacataaaaataaatagaaaggccgggcgcggtggctcatgcctgtaatcccagcactttgggaggccaacgtgggtggatcacctgaggtcaggagtttgagaccagtctgaccaacatggcgaaaccccgtctctactaaaaatacaaaagaattagccaggcgtagtggcagacacctgtaatcccagctacttgggaagctgaggcgggagaatcacttgaactggggagatggaggttgcagtgagccgagattgcactactgcactctaacctgggtgacagagcaagactccgtctcaaaaaaaaaaaaaaaaaattgaagaaataacatggctgggcatggtggctcacacctgtaatcccagcagtttgggaggcagaggcaggtggatcaactgagtcggcagttcgagacaagcctggccaacgtggtgaaaccctgtctcctaaaaatacaaaaattggccgggcctggtggtgcatgcctgtaatcccagttactcgggaggctcagacaggaaaatcgcttgaacccaggaggtaggggttgcagtgagccgagatcgcaccattgcactccagcctgggcaacaagagtgaaactctgtctcaaaaaaaaatttttttgaataaataataaaaataaaatgtattaaaatttaggaaaagatcaaaaagacttctgtttcctttgaggatatagaagtttttagcaggccagtgatcccattgcaaaacaaaaaaattttaattgcaaaaatcatctttttttttttttttgagacagagactcacactgttgcccaggctggagtgcagtggtatgatctaggctcactgcagcctccacctcccaggtttaagcgattctcatgcctcagcctccggagtagctgggattacaagtgcccgctatcatgcctggctaattttttgtatttttagtagaaacagggtttcactatgttggtcaggctggtctggaacgcctgacctcatgatccacctgcctcggcctcccaaagtgctgggattacaggcgtgagccaccgcacctggccacagaaaaaaatcatcttttttaaagacagcagagagctgtgaacacaacgagaatgaaatgaattaaaaatttttttttaattttttcagacagagtctcactctgccacccaggttggggtgcagtggtatcatctcggctcattgcaacctccgtctcccaggttcaagcgattctcctgcctcggcctccctagtagctgggattacagatgtgtgccaccacactaggctaatttttgtatttttagtagagatggggtttcgccatgttggccaggctggtctcgaactcctgacctcaggtgatccacccaactcggccttccaaagtgctgggattacaggcgtgagccactgtgcccgacctttaaaatgtttttttaaatcccctcaaaaaaaaaaaattccagaatgaatgagctgaccatcattggtcaaatttttttcctggaggcaattcccccattctaggcataaaaacctagtccaggcaaagggactctcctggtgagaagagaaaccagcagagcttttggtggtcatgaggcactggaagctcctagaagctcctcaaaggcagaatgaaatcttctgcagcctcatagtgttcagtagacaaagtcccaaacataggacatttgccagattttgaagatacaatggtcaggaggcaaaagagtgaggctcaaaacctctaaaaggcagaggctgagtgaggtgactcacaccagcagtcgcagcacttggggaggctgaagcaggagaaccacttgaagccagagtctgagaccatcctgggcagcacagcaagaccccatctgtacaaaacaattttaaaaaattatctgggcatggtagtgtacgcctatagccccggctactcgggagactgaggtatgaggatcaacggggcccaggagttcgagattgcagtaagttatgttcataccactgcacttcagcctggctcacagcacaagactttgtctctaataaataaaaataggaggctaagacaggagaatcgcttgaacctgggaggtggaggttgcagtgagccgagattgtgctactgcactccagcctgggcgacagagtgagactccatctcaaaaataaataaataaataaacaaataaataaataaaaataaataaataaacaacagaacaaaatctcccacagcttataagctgaagagacagataccttccaggctccccttcaaaagcccaggaggatcatggctgtggaacagggataagagaggtagccagactcatcctaaatccagctcagttcctgactgtattgaggtgatcaattcctaactttattaacctaaaagagtaaaagtagaacactctccagtggaagataaaatcttctgtatgaaagataatggttctttggatcaggcatgtaagaagcttggaagttgtcactccatcctgttaataagtaaaaagctaaacaagctgaaaaatcaacaatgcttcttagatccataagagaaatggagtcacagggcaaaccactgtcttcaaaattggagacacagacaggtgaatacagagaatcaccatttacccaagcagaagcctctgagggggccaggcggggtggctcatgcctataatcctagcactttgggaggccaaggtgggcggatcacttaagtccaggagtttgagaccagcctggccaacatggcaaaaccctgtctctactaaaaatacaaaaattagccaggtgcggtggcgcaatcctgtaatcccagccacttgagaggctaaggcatgagaatcacttgaacccgggaagcagaggttgcagtgagctgacatcgtgccactgcactccctcctgggctacagagtgagccggggaggggaggggaagggaggggaggggaggggaccaagaaacctccgggggatccagtgctggagaggaaaccatgaactgcaattgacaaagtgcaggaggttcagtgtggacaagcctgaaagttaaaaactccaggatgacccagtcacaggcaggcccccgcacctttgtgagttttacctccaggagcttgacctggttttcacagtaaatattggagaaaaattccttcatgcttccagcagtgggaggggaaaaggaaccattttgaaatacaccagagcattctgttctcaacaaagtctgccctcaggagaaatcagggcctaagcttccgggttttatcagggcttaactcagctgggagaagggaagtacccaactccagacccctctaaccttccctgtgggagaggaaaataccccaatccaacccactgtacatatccagacccacctaaaggtggtggggagactagcagcatgtgtgaagtccacagtccagaggcacagacttactgaaagactgcgacctattcacaggacaatagtatcctttaccacactccccccataccttaccacccctttacaaaggcctgttttcagcaggttcttttacccagtacattatgtccagctatcaagagaaaattacaaggcatgctaaaaagacaaaaaaagagagtttgaatagacagaagaagcatcataagcagactcagatatgggagatattcagaattattagaccaggaatttaaaacaacgatgaataatacgatggctttcatggataaagtcaacagcatgcaagaacagatggacagtgtaagacaggtggaaattctacgaaagaaccaaaaagaaatactagagatggaaaacatgaggacagaaatgaagaatgtgtttggcggattacttagtggtacagtaatccactgaacacagcgaggaaagaatctctgcgcttgaggatatttcaatagaaacctcaaaaactaaaaagcaaaaagaaaagagactttaaaaaaaccccacagaaacagaacttcaagaactgtgggaaattatgaaagctgtaacaacgtgtactgagaatagcagaaggagaagaaaaagagaaagtaacaaaagaaaagacatatttgaaacaacaatgactgtaatttttcaaaattaatgtcagaaaccaaaccacatatttagaaaggtcagaaaacatcaagccagataaatgccaaaatgacacctagccgggcgcggtggctcatgcctgtaatcccagcactttgagaggctgaggcaggaggatcacttgaggccaggagttcgagaacaacctgggcaacagagagaccctgtctctacaaaaaaaaataaaaataattctctgggtgtggtggcacctgcctgtggtctcagctataggggaagctgaggtgggaggatcgcttgagccccagaggtcaaggctacaatgagccatgattgtgctaccgcactccaacccgggcatcaaagcaagatcccatctgttaaaaaaaaaaaaaaaaaaaaggttggcacagtggttcacacctgtaaccctcagcactttgggaggccaaggtgggaagatcacttgaacccaggagctcaagatcagcctgggtaacatagggagactccctctctacaaaaaaattaaaaaataaaaataaaatacataaaacataaaaataaaaattatgtgagggcagtggcatgtacctgtagtcccagctactcacgaggctgaggcaggaagatcccttgagcatgggaggttgaggctgcagtgagttatgatcacacactccactgcactccagcctgggtgacacagcaagaccatgaagaaaggaaagaaaagaaaaaaagaaagagagagagagagagaaagaaagaaagagagagggagggaagtagggaagcagggaaggaagaaagaaaggggaaaggagagggaaagggagggaagggaaaggaagggtccagaaagaagccagaggagaagaataatacctatagaagagcaaagataagaattacatccaacttctcagaaaccatgcaaacaagaaaagagtggcaaacagaaattgaaggaatttgttgccagtggtcctaccttgcaagaaatggtaaaaagaggttctttgaagagaaggacaatggtataggtcagaaatttaaatctacataaagacagaaagagcggccaggcgcggtggctcacttatataatcccagcactttgggaggtgggtggatcacctgaggtcaggagttcgagaccagcctggccaacatggtgaaaccccgtctctactaaaaatgcaaaaaattagctgagtgtggtggcgtgcacctgtaatcccagctactctggaggctgaggtaggagaattgcttgaacccaggagacgaaagttgcagtgagccgagatcgtgccactgtactccagcctgggcaacagagtgagactctatctcaaaaaaaaaaaaaaaaaagagcactgaacaaggacaaagtaaaagtaaaacaaaaacttttttactttttttctccttaattgatctaacagataacagttggtttaaactaataataatgatgtacttatgtatgcatttattatgtacatagacatacatttatgtatattgatgtatacgtgaaatgaatgacagcaataatacaggaatgagagagaagaattgggattttttttttttttttttgagatggagtctcgctctgtcgcccaggctggagtgcagtggctcgatcacggctcactgcaagcactgactcccgggttcacgccattctcctgcctcagcctccagagtagctgggactacgggcacctgccatcatgcccagctaatttttttttttttgtatttttagtagagatggggtttcaccgtgttagccaggatggtctcgatctcctgacctcgtgatctgcctaccttggcctcaaagtgctgggattacaggcgtgagccaccgcacccggccaaaacacatcttgataattttttttttttgatggcctccctctgtcgcccaggctggagtgcagtggtgcgatctcagctccttgcaacctccaactcctgggttcacgcgctgctcctgccttagcctcctgagtagctggaattacaggcacctgccacaatgcccagctaattttttgtatttttagtagagacaagctttcaccatgttggccaggctgggcctcgaactcctgacttcaggtgatccacccaccttggcctcccaaagtgctaggattacatgcccggctaatttttgtatttttagtagagatgcagtttcaccacgttgcccaggctggtctcaaactcctgacctcaagtgatctgcctgccttggctttgcaaagtgctggaattacgatatcttaataaactttttttttttttgagacagagtcttgctctgtcaccaggctggagtgcagtggcacaatcttggctcactgcaatctccgcctcctgagttcaagcaattctcctgcctcagcctcctgagtagctgggactacaggtgcgtgccaccacacccagctaatttttgcatttttagtacagacggggtttcactatgttggccaggatggtcttgatctcttgacctcagtgatccacccgcctcagcctcccaaagtggtaggattacaggcctgagccatcgtgcccagtcaactttttttttttttttttttttttttgagacagtatcttgctctgtcacccaggctggagtgcaatggcgtgatctctgctcactgtaacctccatcttctgggttcaagcgatcctcctgcctcagcctcccgagtagctgggattacaggtgcctgccaccacacccagctaatgtatgtatttttaatatagattgggtttcaccatgttggccaggctggtctcgaactcctgacctcaagtgatccacctgcctcagcctcccaaagtgctgggattacaggcctgagccactgcaccctgatgatgataaactttttttttttgtatttttagtagagagggggtttcaccgtgttagccaggatggtctcgatctcctgaccttgtgatcagcctgcctcagcctctcaaagtgctgggattacaggcatgagccaccacacccagccgataaactttttaaaatagaaaagatacaaagtatgctcttagaccatgatggaattaaagtagaaataaacaagacagatagctggaaaatcccaaaaacttgagagattaaacaacacacttctaaataacacatgggtaaaacaaaaaatcccaagagaaattgcaaaatattttgaacttggacgggcaggttggctcccgcctataatcctagcactttgggaagctgaggcgggaggatcgcttgagaccaggaattcgagatcagcctgggcaacatagcaagaactcatccctacagaaaaatttaaaattagccaggtttggtggcacatgcctataatcacaactactctgaaagccaaggcgagaggatcacttgagcccaggagttcaagtctgcagtgagcaatgtttgctccactgcactccagcctggagacagtaagaccgtgtctcccctaaaaataaaaataaatttaaaaaagaaaaaaccagcctgggcaacatggcaaaaccccatatctacaaaaaaaaaaaaaaagtacaaaaaattagccacaccgggtatggtggcacgcacccgtagtcccagctactcaggcggctgaggtgggaggattgcttgagccggggaggcggaagttgcagtgagctgagatcccccaactgcacttcagcctgggggacagaacaatactctgtctcaaaaaaagaaaaacaaaagaacaaaaccccataacttatcaaaatttgtggaatgcaacaaaagcagtgcttagagaaaatttatagcattgtatgcatgtactagaaaagaagaaagaggctgggcacggtggctcacacctgtaatctcagcactttgggaggccaaggccaactcacttgagtacaggaattcgacaccagcctgggcaacatggtgaaacccccatctctacaaaaaaacacaaaaactaggccgggcgcggtggctcacgcctgtaatcccagcactttgggaggccaaggtgggtgcatcacgaggtcaggagttcaagaccagcctgaccaagatgctgaaaccccgtctctactaaatacacaaaaaattagctgggcgtggtggcacgcgcctgtaatcccagctacttcagagcctgaggcaggagaatcgcttaaacccaggtgccagaggttgcagtgagccactgaactccagcccgggcaacagagcaagacttcgtctcaaaaaaaaaaaaaaaaaaaattccaaaaactagacaggcatggtggcgcgtgcctgtactcccagctacttgggaggcagaggcgggaagatcacttgagcctgtgaagcggaggttgcagtgagaaaagattgggccactgcactccagcctgggtgacagagccagaccctgtctcaaaaaaaaaaaaaaaaaaaaaaaagaagagaaaagaagaaagacatctaacaaaagcaacttagccttccaacttaggaaactagataaagaaaagaaaagaaaattaaaaccaaagtaagcagtaaaaagaagtaacaaattagagtagaaatgaatgaaagttaaaaaaaaaaaaaagaaaaatcaatagagaaactcaacaaaaccaaaagctggctctttgaaaaaataaataaaatcaataagcatctagccaggctaagaaaaaatatagaggacacaaagtggctcatgcctgtaatgccaacaatttggtagacggaggcaggaggatcccttgaagtcaggagtttcagaccagccctggcaacagagtgagactccatcttttgtttttttcgctttttttttttgtagagacagagtctcactctgttgcccaggttggagtatggtggcgaaatcttggctctcggcaacctccgcctcccaggttcaagcaattctcctgcctcaggctcccaagtagctgggattaaaggcactcgccaccacccctagccaatttttgtactttaatagagacagggtttcacagtgttggccaggctggtcttgaactcctgaccccaggtgatccacctgcctcagcctcccaaaacgctagaattacaggcatgagccacaatgtccagccaaaacattttttttgaattagctgagtggggtggcatgcacctgtagtcccagctactcgggaggctgaggtgggaggatcacttgaacacaggagtttgaggctacagtgaactaggtcatgctactgcactccagcctgggcaacagagcaagacactgtctgaaaaaaaaaaaaaaaaggaagaaagaaaaaggaaggaaggaaggaagggaggggcgggcgtggtggctcacacctgtaatctcagcactttgggaggccaaggtgggcggatcacttgaggtcaggagtttcagaccagcctgggcaagcaacatggtgaaaccccatctctacaaaagtacaaaaattagccggccatgatggcaggtgcttgtaatcccagctactcgggaggctgacgtggtgcagtggctcatgcctgtaatcccagtactttaggagatcaagggaggtggatcacttggaagccaagagttcaagacccgcctggccaacatggcgaaaccccatctctacagaaaatacaaaaattagccaggcatagtggtgaatgcctgtaatcccagctacttgggtggctgaagcactagaactgtttgaacccaggaggtggaggttgcagcaagtcaaggctgtaccactgtactccagcctgggcaacagagtgagactctatctcaaaaactataacaacaatacaacaatactgtatatattagcaaccaaaaatatgatatacttagtgtagaaagtaaaaaatttgctcttcaaagtttcccttcttgttaaagaataaatcataagtgttagaaataatagtttctggccgggtgcggtggctcatgcctgtaatcccagaactttgggaggccgaggcaggtgaggtcaggagttcaagaccagcctggctaacgtggtgaagccccgtctatactaaaaatacaaaaattagccaggtgtggtggcaggcacctgtaatcccagctactcaagaagctgaggcagagaattcttgaacccgagagatggaggttgccgtgagcagagattgtgccactgcactctagcctgggtgacagagcaagactctgtctaaaaaaaaagagaaaagaaagaaagaatagtttcttgtaaagactaacttccttcaagcctccttgctttgtgctaataactctttgttaagccctatcctatgcagctgttagacataagggaataagtacattctatgtccttgtactttaaccaagacatttgttctggacatgctcaggcatgtcccagctcacagcctatgccccttccttatttgggaatgttattacttttctaagtcctttcataaggaacttcctcttttcctctgttctccattgcttttacctatttagaaaagttttaaattattagccaatcgggttttagtttagatcatgcagtctggctccaactgatggagaccggacacagtagcagggacaaactgcataaggaataaaaattgtttccctcctttgttcaggtgtgctctcaccagtgttccatctgcgaggagcaccctttctgtagaaattaaaattgccttgctaagaaaactttttgtctgaatgctgatttttccttgcagtaccgacgaacaagtattctgtttctaaataaacattttatatataacattattattattatttgtttttctcactttttttctttttgaagcagagtccccctttgccgcccaggctggagtgcagtggtgggatcttggctcactgcaacctccacctcccaggttcaagtgattctccagcctcagcctccccagtaactgggactacaagcatgtgccactactctgggctaatttttgtatttttagtagaaacgggttttcactatgttggccaggctagtctcaaactcctgacctcagatgatccacccacctcagcctcccaaagtgctgggattacaggcataagcaatcatgcccggccttcactttgtcttatggtgctgaccaatagaacttttcatggaaccttttatgattattccaaaacttataaggaagtgtaatcaccaatgatagtcaagactcttctgaataaaaaaagcagaaaggaagacttgtccaactagggatcagaacttactaggaagccatggtacttaataacatgaggtgctgaggcaggagaagacagattaagtaacccagacacagacccatgctttgtatgaaacgttgatgtatgacagacatgttttgttaggtcactggagaaaggaggtattgttcaaaaatggagatggaaaacttagctatccttataaacaaaagttaaaatggatcactcccttataccatattacaccagcaactacacatggataagggtgtaaacatatatatgtatatatatatgtattttgagacagagtcttctcactctgtctcccaggctggagtgcagtggcccaatcttggctcactgcaacctctgcctcccaggttcaagcagtcctccagactcagcctcctgagaagctgagactacaggcatgagtcaccacacctgggtaatttttgtattttttagtagagacagggtttcaccatgttggccaggctggtctcgaactcctgacctcaagtgatccacccaccttggcctcccaaagtgctgggattacaggcatgagctaccacacttggccagggtgtaaatattaaaacaaaactttaaaatttaataaaaaggagagatgaatatttttaaaacattggagtagagaaaatttccctagaaaaaatagaaaaagatgtcatttcctccttccttttttctccttcttctctccttcccctttgttagggctgagctttccactggcccataaagcagaaggagggggcccagtatgttccagtcaacctgtgtgactaggacagagggaaggagtgggattggggaagtgagtaagcacattaaggatgaagggagtcagacttgccactgtaatatgttacacatggaaagagggaaggctggaataaaccctgcagggttggactagaaattggagtattggctgtgattgtgtttttttaatatacatagacatagatgtctattacttgtaccaaaaagtaaggatgtgtgcatagaagaattgtggaatgtcaaaagaatacagaaaccagcttgaaggggttttcattggcctaatctagaaaaaattgaacattaaaatatatcgattgggcatcatggctcacgtgtgtaatcccaactctttgggaggctgaagcaggaagaacacttgaggccaggagtttgagaccagcctgggcaacatagggagaccccatctctacaaaagtaaaaattagccaggcatggtggtgtgtgcctataatcccaccaactcagaaggctgaggtaagaggatcccttgagccctgcagttcaggtctgcagtgagctatgattgccacactgcactccagcctgggcaaagaagcaagacctgcctctaaaaaataataataataataacaataataataataaatggccgggcgaggtggctcatgcctgtaatcccagcactttgggaggcagaggcaggcagatcacctgatgtcgggagttcgagaccagcctggccaacagtgtgaaacctcgtctctactgaaaatacaaaaattagccgggcatagtggtgtatgcctgtaatcccagctactcgggaggctgaagcaggaaaatggcttgaacccaggaggtggaggttgcagtgagccaagaccgcaccactgcactccagcctgggcaacaaagtgagactctgtcaaaaaaaagaaaaaattttgtacaactcaagaaaaagacaattaagaataggcaagggagagcctggcgcggtggctcacacctgtaatcctagcactttggaaggccaaggcgggtggatcacttgaggtcaggagtttgagaccagcctggccaatagggtgaaaccccacctctactaaaatacaaaaattagccaggcttggtggtgggtgcctgtagtcccagctactcaggaggctgaggcacaagaatcgtttgaacccaggaggcggaggttgcagtaagcggagatccagccactgcactccagcgtgggcaacaaagtgaaacaccatctcaaaaaaacaaaaaacaaccccccccacaaaaaagatcacgcaaaagggccaggcacagtggctcaccattgtaataccagtgctttgggaggccaaggtgggaggattgcttgaggctgagatcaagaccagcctgggcaatatagagagaccctgtctctactcacctcccacaaaaaaaaaattagcaaaggacttgaatagacatttctctaaagaagatacacaaatggcaaataagtacatgaaaagatgctcaacatcattagacattaggcaaatgcaaattaaaaccacagttgaaaccctcccaggttcaagcgattctcctgcctagccttccaagtagctgggattacaggtgtgtgccaccacacccggctaatttttgtacttttagtagggacacggttttaccatgttggccaggctggtctcgaactcctgacctcaagtgatctgccaacctctgcttcccaaaatgttgaggttacaggcgtgagccaccacgccaagccaatcaggtggttccttccttccttccttttttttttttctttgtcagagtctcactctgtcgcccgtgttggagtgcagtggtgtgaacttggctcactgcaacctccgcctcccaggttcaagtgattctcatgcctcgctccacaagtagctgggattacagtcgcacgccaccacgcctgactaatttttgtatttttacaccatgttggccaggctggtaaatttggtgatttcttaagcgtatcttgggggaaaaaagtttctgagagcagtaagtataaacgtgtgtctaaaatgtgtgtccttttatttatttatttttttgagatggagtcttgctctgtcgtccaggctggagtgcagtggcgcaatctcggctcactgcaacctccgcctcccgggttcaagcaattctttacctcagcctcctgagtggctgggattacaggcgcctgccaccacgcctggctaattttttgtatttttagtggagacggggtttcaccatcttggccaggctggtctcgaactcctgacctcgtgatccacctgcctcgacctcccaaagtgctgggattacaggtgtgagccactgtgcccggcctggacttatcttttccaatagttattatttcttcctgtacttcctggggccttggaggtatcatgaatccatacctgctttttttttttttttttttttgagacagtgttttgctcttgttgctcaggctggagtgcaatagtgcaatctcggctcactgcaacctccgcctactgggttcaagtgattctcctgactcagcctcttgagtagctgggattacaggcacccaccaccacgcccaggtaatgttttttgtatttttagtagagatggggtttcaccatgttggccaggctggtcttgaactcctgacctcaggtgatccatccacctcagcctcccaaagtgctgggattacaggcgtgagccaccgtgcccagcctttttttttttttttagacagagtgtcactctgtcacccagtctggtgtgcagtgtggcaccatctcccctcactgcaacctccacctcccgggttcaagcgattttcctgcctcagcctctccagtagctgggattacaagcgcacaccaccacgcccagataatttttatatttttagtagacacggggtttcgccatgttggccaggctggtctcaaactcctgacctcaagtgatctgcctgcctcggcctcccaaagtgctgggattacaggagtgagccaccgcgcctggccattgctctgggttcttgatgcctgtcatcacctggagcttgctgggctggcaagaagtgaacatcagtgccctgttggctgaagcccaggatacagctctagacaacaggatataggaaggaacccagaagcaaaacctcctcctgtggaaaggggtggagtcttccttaggaagagagaagtcgccttccttagagactaggaaggaagttcatggacacatgcagggtgaacctgaggaccagaagaggagaagaatccatgaagatgccatccttgagaagatcaagagatgtactgctttactgcatgctacaagggaatgaatggctaagtgagcctgaattgtaatttctgtctcttttataatgtaaattccttctgaaaatgccataattccatgttttccaagcattagtattcatgggaatcacctatagcagtggtccccaacctttttggcaccagggtctggcttcatggaagacaatttttccacagacagggttggggggacgtaggatcgggggaccgatggctttgagatgaaactcttccacctcagatcatcaggcattagattctcataaagaacatgcaacctagatccctcaaatgcacagttacaatagggttcacgctcctgtgagaatctactgctactgctgatctgaaaggaggcaaagcttaggtggtaatggctcaccacccccatcacctgctgtgtacccagtgcctaacaggtgacagacccatactggtctgcagctctgggttcagggatccctgacctctatttgttgtaaatataattcctagaatccttctatagagtctgaattagtagaaaaggcagacagctgtggtttatcctgttcagcatccttcaccctctcttttggaatacttctgggaaacaaactggaggacaaaatccataaggacttattcattagctcccatccccatcagtcagtgatggccccaaggcatcgattctgccacttctaggatgcacgtgtgctagcgctgagcaggcaagagtcccacactgaagtatcagagaagctccagggcaaaaagcaagaggcaccaggtgtgggccaggtgcaatcacactgcacccatgccaaggcagcagagcctgcatagaactggcggtagcagctgtggcttgaaaaagaggcatgggctgggcgctgtggctcacacctgtaatcccagcactttgggaggccgaggcgggcagatcacctgaggtcacgagttggagaccagcctggccaacatgttgaaaccccatctctactaaaaatacaaaaaaattagccaggcctggttgttcacgcctgtaatcccagctacttgggaggctgaggcaggagaatcacttgaacccagaaggcggaggttgcagtgaggcgagattgcgccactgcactccagcctgggcagcaagaacgaaactctgtctcatatctcattttttatttttatttttattttttatttttttcagacagagtctcactctgtcgcccaggttggagtgcagcggcacgatctccgctcactgcaagctccgcttcccaggttcaagcgattctcctgcctcagcttcccgagtagctgggactacaggcgcccgccaccacacccggctaattttttgtatttgtagtagagacggggtttcaccatgctagccaggatggtctcgatctcctgacctcgtgatccacccgccttggcctcccaaagtgctgggattacaggcgtgagccaccacacctggcactgtctcatatctcatacctacacacacacacacacacacacacacacacacacacacacacagaggtatggccaagaggatttgaagtaatgcacaagagatttcccatatgctccacttcttccagctctcagccctgcatgggccctccattaagaccaatccatcacaagaagatgtgtaggaccagctatgttcattaccttcctccgctattccccttctcagtctctctcacctacacccaacattttgtttaatgggtaaagtgacccagaggtaagaaacaaaaccaaaaaaaacccaccaccattaagtgatggcactagtggggatttgcacccgctcagttcttctctagaatttgtttgggtgtttttttgtttgtttttgatatggagtcttgctcagttgcccaggctggagtgcaatagcgggatcttggctcactgcaacctccgcctcctgggttcaagcgattctctggcctcagcctcccgagtagcagggattacaggcgcctgccaccatacctggctaatttttatatttttagtagagacagggtttcaccatactagccaggctggtctcaaactcccaacctcaggcaatctgcccacctcggcctcccaaagtgctgagattacaggcataagctaccacacctggcctagaattggggctttttttttttttgagatggagtctcactctgtcgcccaggctggagtgcagtggcgcaatctcggcttactgcaacctcctcccctccaggtttaagcaattctctgcctcagcctcaggagtagctgggattacaggcgcgtgccaccacacccgactaattttttgtatttttagtagagacggggtttcaccatcttggccaggctggtctggaactcctgacctcatgatccacccacctcggcctcccaaagtgctgggattacaggtgtgagccaccgcgcctggagagaattggggcttttaaccacgcagtgctgagaaaaatttcaaggtaagtggcatctgggttcagtgagaaagaataccataactgattagagtgtctaccaaaggaattggtagatacaacaccaagagaacaagtaacaaaagaaaaaccagactgggcacggtggctcacgactgtaatcccagcattttggaaggccaaggcgggaagatcacctgaggtcaggagtttgagaccagcccagccaacatggtgaaaccctgtctctactaaaaatacaaaaattagctgggtgtggtggcaggcgcctgtaatcctagctactcgggaggctgaggcaggagaatcacttgaacccgggaggtggaagttgcagtgagccaagatcacaccacttaactccagcctgggcaaaagagcgaaactccatctcaaaaaaaaaaaaaaaaaacaaaaaactagatacactggaaattggacatcaaaattagaaacttttgtgctgcaaatcatagacagtgaaaagacaacccacagaatgggagaaaacatttccatatcatatatctgataagggtctaatatccagaatatataaagaactcttacaacttgataatataaagactaataatctaattttttaaaggggcaaaggatttcaacagacgtttctctaaagatatacaaatgaccaaaaaaaaaaagcacatgaaaggtgtctgatgtcattagtcaacagggaaatgcaaatcaaaaccacggtgaggtatctctgtgcccccaccaggatggctgtaatataaacaatggacaataacaagtattgacaaggatgtggagaaatcggatttctcttacactactggtgggaacgtatgatgcggcagctgtggaaaagagtttggcagttctccaataaattaaacagaattaccatatcactcggcaatcccactcgcaagcatatacccagaataactgaaaaaacacatgttcaaacaaaaacttgtacataaatgttcatagcagctctattcacaacagccaaaaagtggaaacaacctgatgcccatcactgatgaatggaagtaaaagattatatatacatactatcaaatattatccagaaataaaaagaaatgaagccaggcacagtggctcacgcctataatcccaacacttagggtggctgaggcgggaggatcacttgagcacaggaagtcaagactagcctgagcaacacagtgagatcccatgctacaaaaaattattttaaattagccgggcatggtggcgtgcacttgcagtcctagctacccaggaggctgaggtaggaggatcacctgagccaaggaagtccaggctgcagtgatctgtgatcacaccactgtacctccaggctgagcaacagagtgagtctctgtctcagaaaaagaaggagaaagaaaaggaaaaagaaggaaggaaggaaaggagggagggagggaggaagggaagggaaagaaaaaagaaaaggagaaaaagaaaaagaaagaaaggggccgggcagggtggctcacgcctgtaatcccaacactttgggagggcgaggtgagcagatcatctgaggtcagcagtttgagaccagcttggccaatatggtgaaaccccgtctctactaaaaatacaaaaattagctgggtgtggtggtgggggcctgtaatcccagctactcgggaggctgaggcgggagaattgcttgaacccgggatgtggaggttgcagtgagccacgattgcgccattgcactccagcctgggggacaagagcgaaactccatcaaaaaaagaaagacaggaaagaaaaagagagagagagagaaagaagagaagagaaagaaaagaaagagagggagagaaagaaaggagggagggatgttgggaaggagggaaggaaggaatgaaggaaggagggaaggaaggaagggaaagaaagaaagagagagagagaaaggaggggggatgttgggaaggagtgaaggaaggaaggaaatgaaggagggaaggagggagggagggaggttgggaaggaaggaaggaaatgaagaactgatacatgttacaacgtggatagacctagaaaatatattgctaatttaaaaatgccagtcacaaaatgcccacatattatatgatcccatgtatacagaaggtccagaatacacaaatttgtagggacagaaagtaggttagtggttgcttagggattggggtcgagggagaagagtgaggagtgaccgctaatgggtatgaggttcgttttaagagggaggaaaatattctaaaataagattgccgtgataatttcacaaccctgtgaatatactaaaaaacattgatatgctcattaagtgaacgaggtatatgggaatataaattctatctcaataaagctgttttttaaaacctgaaagtctcaggctgggcacggtggctcacgcctgtaatcctagcactttgggaggctgaggcgggcggatcacgaggtcaggagagcgagaccattctgactaactcggtgaaaccccatgtctactaaaaatacaaaaaattagccaggcgtggtggcgggcgcctgtaatcccagccactcgggaggctgaggcaggagaatggtgtgaatccaggaggtggagcttgcagtgagctgagatggcgccactgcactccagcctgggcgacagagcaagactccacctcaaaaaaataaaatacaatacaataaaataaaaaataaaacctgaaaatctcaaattctgggaaacctctcaatgctgggcaaaccgggaggtctccctggcaccactcttatctccataaaatttatttatgtatttatctatttatttaattaatttttgagatggctctctctgtcgctcaggctggaatgcagtgtctcgatctcggcttactgcaacttccgcctcctgggttcaagcagtgactctcctacctcagcctcctgagtagctgggattacaggtgcccgccaccatgcccagctgattttttttacttttagtaaagacagggtttcaccatgttcaacacgctggtctcgacctcctgacctcaggtgatccgcccacctcggtctcccaaagtgctgggattacgggcatgagccaccacgccaggcccatacctttttttttttttttttttttgagacggagtctcactctatcacccaagctggagtgcagtggtgtgatctcagctcactgcaacctctgccttcagggttttaagcatttctctctgcctcagccacccgagtagctgggattacaggtgctcaccaccacgcccggctaatttttgtatttttagtaaagacagggtttcaccatgttggccaggctggtcttaaactcctgacctcaggtgatccacccacctaggcctcccaaagtgctgggattccaggtgtgagccactgcacccggcctgccaggcccataaaattaaaaaaaaaaaagggggcgggggggatttggggagagaatgcagtgtctggagtattagtcagctttttgttgtggcaatgttgtgtaaccaacaaccctggaacttagtcatttacggcagcaaacatttctttcttataggtctgtaggtcaactgtggctgcactaggctagctgggctcaactgtacttggcccagctgtactgtgagttaggttccagtctactccaggtgtctctcattccaggacccaagctgaagaagcagcatatccctagggcatgctcttctcagatggatggcacacgcaatagaaaccaagcacacaccatacaattactacaacgcctcagctaagattactgcttacttcatgtctgttcacgccccattggccaaggcaagtcacatggtcacgtccacagtcacaagggtggggaaacattcactgtctcatttgaggcactgaaaagcaaggtaatggggctggacatataatctaattataggagggggtgggatagctggaaacaataagccaaccaactcagaacaaatgcttgccattcttgctctacgagacctttagggagcaggtcaagaaggattcatcaggccaggcatggtgactcacgcttgtaatcctagcactttgggaagccgaggtgggaggatcacttgagctcagcagttcaagtggcagaacatggcagaaccctgcctctaccaaaaaaatataaaaattagctggacgtggtgggatgtgcctgtagtcccagctactaagggggctaaggtgggagaactgcttgagcccaggaggttgaggctgcagtgagccatgttcgtgccactgtactccagcctgagtgacagagtgagataaacacacataaaaagataagaatcgatctattttgtctaattctgctgcattagcatcttgtgtttttttggttttggggggtatttttgagatggagttttgctcttgttgcccaggctggagtgcagtggcacgatctcggctcaccgcaacctccacctcctgggttcaagcaattctcctgcctcagccttctgagtacctgggattataggcacgcgccaccatgcccagctaattctttgtatttttagtagagacggggtttcatcatgttggctgggctggtctcaaactcctgacctcaggtgatccacccgcctcgggcctcccgaagtgcagggattacaggcgtgatagggtctttttttcttttttccgagacggagtctcgctttgtcgcccaggctggagtgcagtggcacaatcttggctaactgcaacctctgcctcccaggttcgagcgattcttctgcctcagcctcccaagtagctgggattacaggcacccaccaccacaccaggttaatttttgtatttttagtagagacagggtttcaccatgttggccaggctgctctcgaactcctgacctcaagtgatccgcccatcttgacttcccaaagtgctggatcatgcctggccaggtcttttcttaaaaaatagaaatggcattttaaattctgattataaaagcaaaaatatcagacaatacaggatactttaacaaaaaagtaggaacagcttccaggaataattctatgcccgccaatctgactcacctcattttattacaccaacgtgcagggcagaaagtcatttggtgatacgaggatgtaaacagtgcctagcattgaacacacacgtggacagaggaggagaaacaggtttgacatgtacagagctagaagctagtctgtgggaattagtggcccatctcctgccatgtggaaaaagacaggctgcaggaaagggagtatggctgatgtacacaaacagaggcagagactgggggtgaaaagaacgtcctggtagcatttatgtcctgggtccggttattcctaaagtcggcctgtatccctgcccttcccacaattgggcattcagcccttccttcagttccatgagccaataaatcccccattttgttcaagctagtatatttatttatttatttcttgagacagtcgcctaggctggagtgcagtggcacgatctcggctcactgcaacctccacttcccgggttcaagcgattctcctgcctcagcctcccgagtagttgggactacaggcgcctgccgccacacccagctaatttttgtatttttagtagagacggggtttcaccgtgttagccaggatggtcccaaactcctgaccttgtgatctgcccacctcggtgtcccaaagtgctggggttacaggtgtcagccactacgcccagccaatttttatatttttaatagagatgaggttttgtcttgttgtccaggctggtctggaactcctgacttcaggtgatccacccacgtcagcctcccaaactactgggattacaggcgtgagccatcacacctgaccttgagctagtttagattgagagttctgcaacaagaaccctaaaatgtggccacccagctggtgctaacaccacagattctgggctgatgctgcaactataaagatggacaaaaactggtcctgcaaacaaataattacagcacaacgtgccaagtttcataacagtggggttccaacggatgtgggaccaagagatggacttctgaccacacacaacaactgaataaaatttcaccaaggagtgctaagttttaggggctgaactgataccaacattgctgttaggtcattacttttcttcttttggatgactttaggataagctggcaataggattactgagctgaagagcatggctatatatttattatggcttttgctaaagaccactactaaatgccaagccagttaagagtgaagcccccctgcccttacctaggcttcagacagccctctcctcacttggagctgggtctagtccacttgctacagcagcccacccatatttctttttctttttcttttgagacggagtcttgctctgtcacccaggctggagtgcaacggtgcaatctcggctcactgcaacctccgcctcccgggttccagtgattctcctgcctcagcctcctgagtagccggaactacaggtgcgtgccaccacctgtaatttttgtatttttacaaaaattagcagcctggctaatttttgtatttttagtagagatgaggtttcaccatattggccaggctgctctcgaactcctgacctcgtgatccgcctgcctcagactcccaaagtgctgggattataggcatgagccaccacgcccggcccccatatttcaatatccccacagctattcccacttgaggcagtccactcgctgtctcagcttgtcactggtgtcctaaaatgctaccaacaataaaagctgtgccaaaaggaaatgcttcctccagcttgggcctccagcctaggggacaccatggggagtggcctggagcaactatttgctgggacagaagccattggttctccactcttcctgttttcagtctgtcctgccccgtcctaggaatctcatgtctcaaggccaaattcgctaagtcaaaagacgagttacagacataacttagattagtaagggtctaccctctctcctccacaggaagctgtctcaacaattaagattcctggctgggcacagtagctcatgcctgtaattccagcactttgtgaggctgaggtgggaggatcgtttaagcccaggagtttgagaccagcctgggcaacatagggaaaccctgactctataaaaatacaaaatggggccaggcgcattggctcacacttgtaatcccagtactttgggaggccgaggcaggtggatcaccaggtcaggagttccagaccagcctggccaatatggtgaaacctcatctctacgaaaaatacaaacaattagccaggcgcagtggctcacgcctgtaatcccagcactttgggaggctgaggtgggtggatcacaaggtcaggagatcaagaccatcctggctaacacggtgaaaccccatctctactaaaaatacaaaaaaattagctaggcgtggtggcgggcgcctgtagtcccagctactcgggaggctgaggcaggagaatggtgtgaacccgggaggtggagcttgctgtgagccaagatcacgtcactgcactccagcctgggctacagagcaagactctgtctcaaaaaaaaaaaaaaaaaatacaaacaattagctgggcatggtagcgcgcacctgtaatcctagctactcaggaggttggggcaggagaactgcttgaacccaggaggcagaggctgcggtgagcagagatcgtgccactgcactctagcctgggcgacagagcaagactccacctcaaaaatatatatgtaataataacaataaattaaataaataaattccaattcttggccaggcacagtgactcacacttgtaatcccagcactttgggaggctgaggcgggaggatcgcttgagcccaggagttcgaggctgtggtgagctatgatttcgccactgtactccaggctgggtgacagagccagactctgcctctacaacaaacaaacaaacaaaaatttgattcctgtatatggcactttctatgtagctgtgtagctggtggaggagaattcctggaattcctaataactccactgaagatggtctggagtcttccctcagagctcagcgcagagaaggtttgctcagcagagcaggtatgcaaggcagaaggcctggctttgcaggccgaccaattcgcttctgtgactttcatgttgtttgatttggtttcttcatctaagcattgcagtgtttaagagcaaggacaggggatagagctagggttgggtcctgccttagcaactagccacatttcattaaatctaggacatcatggtttgcaagatgaaccattattttatgtatccccaaagaaaaaaatactgccaaactatgacaatgatctcttatcacttggaattttattttacgtttattaaaagagctcttttggccagactcggtggctcatgcctgtaatcccatcactgtgggaggccgaggtgggtagatcacttgaagtcaggagttcaagaccagcctggccaacatgatgaaacctcgtctgtactaaaaatacaaaaattagctgagcatggtggcacatgcctgtaatcccagctactcaggaggctgagacaggagaatcgcttgaacccgggaggtggaagttgcagtgagccaagatagcgccactgcactccagcctgggcaacagagcaagactctgtctcaaaaaaaaaaaaaaaaaaattaaaagagctcttttaggccggtgcagtggctcatgcctgtaatcccagcactttgggagaccaaggcagtcggatcacttgagatcaggagttcgagattagcttggccaacatggtgaaaccccatctctactaaaaatacaaaaaattagccgggtgtgatggcggacgcctgtaatcacaggtactcaggaggctgagatgggagagtcactgaaacctgggagatggaggttgcagtgagccgagatcgtgccactgtactccagcctgggagacagagtgagactctgtcccaacaacaacaaaaaaaagagctcttttagacttgcagattttttttcttttttttttttgagacagagtcttgccctgtcaccgaggcaggagtgccgaggcaggagtgcagtagcacaatcacagatcactgcaacctccaactcccagattcaagcgattctcatgcctcagacatcaaggtagctgggattacaggggcactccaccacaccaagctaatttttttttttttttttttgagacggagtctcactctgtcgcccaggctggagtgcagtggcgtgagatcggctcactgcaagctccacctcccaggttcatgccattctcctgcctcagcctcccaagtagctgggactacaggcgcctgacaccacgcccagctaattttttgtatttttagtagagatggggtttcaccatgttagccaggatggtctcgatctcctgatctcatgatccacccacctcggcctcccaaagtgctgggattacaagcatgagccaccacgcccggccttttttttttttgagacagagttttgctcttgttgctcagcctggagtgcaatggcccaatctcagctcactgcaagctccacctcctgggttcaagtgattctcctgcctcagcctcctgagtagctgggattacaggggcccaccaccagacccgactgattttttgtacttttaatagagatggggtttcaccatgttagccaggacggtctcgaactgctgacctcaggtgattcccctgcctcggcctctcaaagtgctgggattagagacatgagccactgtgcctggcaattttttttttttttttttttttgagatggagtttccctcttgttgcccaggctgcagtacaatggcacaatctcagctcactgcaacctgcgcctcctgggttcaggcgattctcctgcctctgcctcctgagtagctgggattacaggtgcccgccatcacacccgactaattatttgcatttttagtagagacagggtttcaccatgttggccacgctggtctcgaactccgaatctcaggtgatccaaccgccttgacttcccaaagtgctgggattacaggcgtgcgccaccacgcccagccatccagctaatttttgtattttttgtagcaactgggtttggacatgttagccaggctggttgcgaactcctggcctcccgccttgacctcccaaagtgctgggattataggtgtgagccactgcacctggccctagatttgttgatattttaacataggttttcatgatatatcactcttcatatacatgaaaatgtaggcaaaataaattggttggggttgtcaaagccctgtgaccaaggaccaccaggaacacacttgtaaccaaaattaggtttaatttgctgcagtgaaggagaatacatcccagggaaaccctcaaggcaccctcaggaaactccttaaatttggcctcgttcccatagttctatggaagaattagggaaatggaactggttcaggattgaatgctgtcaagaaacaggggcagttcagaaactgggtatcttttttttttttttttttggagatggagtctcgctctgtcacccaggctggattgcggtggcgcaatctcgactcactacaacctctgcctcccgggttcaagtgatcagcccgccttggcctcccaaagtgctgagattacaggtgtaagccaccacgcccagcctggactacagtaatttttgctaaagagaaatagcaattgctccaaaaaaggtgaagtcaggccgggcacagtagcgcacacctactttccagcactttgggaggctgaggcaggtggattgcttgagtccagcctggacaacatggtgaaaccccatctctaaaaaaaaaaaaattctttttttaaaaaaaggcaaagtcggccaggagcagcggctcacacctataatcccagcactttgggaggccgagacaagcggatcacctgaggtcggagttcgagaccagcctgaccaacatggagaaaccccgtctctactaaaaatacaaaattagccaggtgtgatggcgcatgcctgtaatcccagctactcggcaggctgaggcaggagaatcttgaacctgggaggcggaggttgtagtgagctgagattgcgccattgcattccagcctgggcaacaagaacaaaactccgttttaaaaaaaaaaaaaaaggccggaagcagtagctcgcgcctgtaatcccagcactttgagaggccgaggcaggaggatcacaaggtcagagttcaagaccagcctggacaagatggtgaaaccctgactctactaaaaatacaaaaattagccaagtgtggtggcaggcgcctgtaatcccagctgcttgggaggctgaggcagagaattgcttgagcccgggaggcggaggttgcagtgagccgagattgcaccactgcgctccaggttgggtgacagagtgagactccatttcaaaaaaaaaaaaaaaaaaaaaggcgaagtcactttgtggtcatgaagtggcttcatctatgtctcattctaaacatagcttactttctgctggtaacagcacagtctgaatgccagaaaagccatctttcactttcttgatagtcctaaacttcagtcctaaacttcacgttgatgttgattatagaaagcatcaccatttgagggatattaaaatgtgggggaaatattcactctaggttggatgaaataagattcttgctgtattaccttgggcaagtaatctaaccctttaagcttcaacttcttgctctataagctgagaataatatgacctaaaagaaataatgtctactaattgggtggtacaatactgggtgtatcactcaaggttcaaccaggaaaataggaaccactttttttttgagacaatctagctctgtcgcccaggctggagtcaagtgcagcggcatgatcttggctcactgcaacctccgcctcctgggctcaagcaatcttcctgactcaacctcgtaagtagctgggattacaggcacacaccaccatgccgggctaatttcttttttcttttttcttatggtagagacagggtttcaccatgttggccaggctggtctcgaactcctgacctcaagtgatccacctgccttggcctcccaaactgctgggattacagttgggagccactgcgccccgccaggagggaaccactttaagtattgaaaacagagagaatgtaatgcagggttttggtgacacgattaacaggggttaacagggaggtctggaaagcccagcaggggacagagagaggcagtacagagactggcaaaagcaagaagctgcctacaactcctaacctgcagggacaaaaagaggaggtggactgagtagagcccaggggcatggatcatcctacagatgttgggaccacagctacctatccatgagctggagccacagagaggcctcatctgctgctggagatgtcacctgagcctgagcaagagagagaaagagaagaaataccatggctctttctttcctcctgccttctcttctcctgccactgcctcccattggctaaaccgaggcctgaagccagatgctctgggagcctgagaaactgccccccgcaagactcagcccactgcaatacagagcagagcagaggggcacggaagggatctgtagcaaatggtagagaatgaccattcagcagaaatagttaaacaggcttggtaatacctttgttgtaaaacctttaaaatatcagatacacttgcacataacaaaataattcccttaaaaatagactgcaaggccaggcgcggtggctcacgcctgtaatcccactttgggaggccgaggcagacggatgatgaggtcaagagatcaagaccatcctggccaacatgctgaaaccccgtctctactaaaaatacaaaaattagccgggcatggtggcacgtgcctgtagtcccagctacccaggaggctgaggcgggagaatagcttgaacctgggaggcggaggttgtggtgagccgagatagcgccactgcactccagcctggtgacagagcgagactctgtctcaaaaaaaaaaaaattaaaaaattgactgcaatccatatagactagttcacacctcttctcacacccccatcctactacgcgattctgaatactactgtgtctggtctgatataacgacattcgaagatggattttcagtgtcagacattttgcattttctgagctgaaatctcatgagggttgctatagaagagggagatgcacattccatgtcacagaagtaaaagctcacccagagtgtggttatagggcagcaatgtcatggcaactggactctggtcttggggctctcaagggattgctgtgtgtccttggagagggtcacaaaatctccggactcccgtgccaaaaatggaaatcatacccatcagggtggtttatgtccgctcacagtccactctgcttctcttctttgccttcccagaagggtccaaaatggtttttgaaagaaacgatgagccggactaagaaaacagataatgtgcccacggccacggagctggcagatgagaaggaattcggtctctgcgtttccataccaaggccctttccactcacccaccgcttctcttcctgcccggggcatctgctggcggaggaaggcttgtccacggaaaggcaaaagcgactcccgatcaaaatccgggggcacctggtagcgctctccacgccagcagaaacgcccaactgacttcttaatggagggaaaccccgggcttggcccgcagactgaggggcccgcgttgcgggttttgggggcccctctgcctctgcgcaccgggtggccccgggtcccctcggcccttcccgccgcctcccgggtccagggtttctaacggggccgcgtgcccggggcggggccacgcgcgattggccgcgcggcatcgggggcgggtccgcggctggccggccgggcgggcgccgacaatgagcctccataaaagggagcggcggggggcaggggccccggattgagccctccccgcccgggctcccgacgcgccgaggtctcggggaggcccggacgcgccggtcgcaggcccggccggcgagcggcgggcgggcggcggggagggggctgcgcggggcgggcggcgggcccggcgctattccggccaggaggcgggaggcggttgccggctgcgcgccgaagcctgcgcgccagtcctccggccactgctatcgcccacggccgcaccatggccctaaaggccgagggcgccgcactcgactgcttcgaggtgacgctgaaatgcgaggaaggggaggacgaggaggaggccatggtggtggccgtaattccgcggcccgagccgatgctcagaggtgaggatggaggggattccacttccgcgtcacggtgcggggccggggctggggccgtccctccccagtcggggtccgggacccgggcaccttctcacccccttcagccttggggcccaggtttccctctcggatctgggtccagggcgcgctcttgcacctcccccaccatggtttagaagctcaggcctcctcgatttccccctcccttcccctttcccccgcccagggtctggagacttcgatccacgccccgcacgctccggatcttccggtgcccaagcgccccctctcccgggcccagcaccagaggccggatccccagaggcgctgggtggttgcggccgccgtctcacagcctgggaaggggaggcaagcacaacggccgggctgtgttctagtccgaggggcggcgaagcctctaggccggaggctacaggcgggcgccgctgccgacctccaggagaattttaagggctctccgagcataacgcttccctgcccaccaccccgcttcattcccattcccgggccttccacttgcaggagccacaggtgtcaagttctggagagaagggatgaatgggactgcatacaacagctagtttggaaaagcagtgcagtgctagaacgagattagctttgggaggggatgggaggaacaatctcagaacactcgctctcccctcccccttcaccgatttctagtcctcaggagcttgcaaaccgtaagaaaacaaagagccatctttgtgggagacttaatatgcatgaaaatgcaaatatatttccattctcccaccccgcttttcttaggcgggatagtacccaaaagaggttgagagcagcaatgccattcattgaacttcagccgaacagaatgatgtctgcctgcactgcctgtcatcctttttggaactggaagggttataaaattcatgagggaaataaaggtcacctcccttctcggagcatttagtccaaaagataggttgttttcctacttctgctaatatttgttgagtgttcattgggcattgtcagaggctgtctcagttaatcctctcaaccctgcaagggtggccttatccccactgttagggcaggaatagacaggtgaattcattcaaccaatattcactggacgtctactttaggctgtttaggctagtgtttttaggctgggaagtagtagtaaacagagcaaccgaaaccctgctcttgaagaacatatatataccaatggctaaagacagagaaataggttcatgtatagtatgttgggtggcaataaatggttcagagatcactaaagcaggaaaaggagaaagaggaggaatgggtatttaattgaatatatcgagtggttcagaaagggttttctaataaggtgaattttgagcacagacccgaaggaagtgaggatgccaaccttgcagatatctgcaggaagagcatttcaggccgaatagcaagtgcaaaggtccggcagcacaagcttctggaaagatttcggtggagagaggaagaaagattgaattcaaggtttttggcctgagcaactggaggaagagccttcccattttccgagatggggaaggctgcggtgctcttgggagactgggagtgaaagtttgaatatgattacgtttgagatgcctatttatgacatattcaggtggagaggtcaactaagcagtcagatacatgggcctagatttcctggaagtatctagctagtggcgtaaacagaaattgccagcaggcagacagtgggaagagaaggaagtagagaagtgtctaaggactgagtcctgggaaactccagtgatggcaggttggagaccgagtcagtccctcatcacacattactaaatgccactgcatgcgaggagatacagatacagatgctggagatacagatgcaaaacatcagaaatctgtatggtcatggattttttttttttttttgagacggagttttgctctttttgcccaagctgtagtgcaatggcacaatctcggctcactgcaaccttcgcctcccgggttcaagtgattcttctgcctcaacctcccgagtaactgggattataggcatgtgccaccacgcccagctaattttgtatttttaatagagatagggtttccccatgttggtggggttggtcttgaactctcaacctcaggtgatccgcccacctcggcctcccaaagtgctaggattcaggcgtgagccaccgcacctggccgtggtcatggatgctatggtgtggtaaggagacaggcagtgaacatcccaaaaacaagtgccaggtggtgatgtgtgctgtgttggaggtgatgcataaggggaatggggtgctctagtgaggggagatggtcttcagcaacaagccagaggaagggagggaatattgagaagagatgaggaagaactagcacacataactgagaaagagggccagggaagcaaaagaagaaccaacagaaggtcatgccctagacgcaagtgatgaaaatcaagatggaagaggtgatcggcagaggatgaagttgagaaactgaccgcagagtttagcactgctgacttggatgagagctgttttggaagactagtagggaagaaagctgattgcaactgagaggtcatttctgcccatggtcgcatgagagataggtacaagacatatctcgtatctctttcagacaccacctcttgtatccatgcaagccgaggctcctatttctcataccacctcttccatgcagcccccaggtattagggcctcctgtgttttaattttgtcccatcctctctggaaggtaggagggagatgcagccgtgaaggatcatgggcacttcgtaaaagcactgagcttccaggctgatgcaggtctaaggctgccttctttgctgaactggaaagggtgatgccctgtgaaagcttatggtctgtctgtgtacacaaagagcaggtatcaggcagcaataggagtgggaccatggctgtaaatgctctgtgagcactgagaagggaggcgagttctgaggggatggggtggcctttagaacgggcatggtggctcatgcctataatcccagcactttgggaggctgaagcaggaggattgcttgagcccgggagttcacaaccagcctgggcaacatagcaagaccccatctcttaaaaattatttttttgtttgttaattagctgggtgtgatagcatgcatctatctgtagccctagctactcaggtggctaaggctggagggtcccttgagtccaggagttgaaggcagcagtaagctatgataacaccactgtactccagcctgggtgacaaaatgagacccccatcttttaaaaaaaaaattattagccaggcatggtggcgctcacctgtagtcccaggtgcttgggaggctgaagcaggaggatcgcttgaacccaggaggtcaaggctgcaatgagctgagattacgccattgcattccagcctgggtgacaaagtgagactctgtctcaaaataaataaataaaatttaaaaattaaaagaatttaccttcctcatcctcaagaaagtgtagaagtcagatttggatgaaatctattgtcagggattggggttctggaaagcttcgcagggatgatgttgcccagcccaattagggtggtctggacagatgtgcaaaggctggagacctgcaagaatgcagcctgttgggaaagtatgtgtagttagtcctaaggtccaagactagatcaagaggaagtatagacgcgagagtcgtgggatcccgggcacatcggctgtgttgagtgtggcgtgtgcctcatgggctccaggggaaggaagaagaacactttggccagaaatgctctcctcccccatcccactcaaaccactgagtctggagacgtgctaagtgttgttggttgtgggcacctttagtgataacaccctccccctctcccctcgcagtgacccaacaggagaagaccccaccgcctagacccagcccgctagaggcaggcagtgatggctgtgaggagccgaagcagcaggtgtcttgggagcaggagttcctggtgggcagcagcccaggaggcagcgggcgggcactgtgcatggtgtgtggcgctgagatccgggcaccctcggccgacacagctcgctcgcacatcttggagcagcaccctcacaccttggacctgagcccttctgagaagagcaatatcctggaggcctggagtgaaggggtggccctcttgcaagacgtgagagctgagcagccgtccccacccaactcaggtagttggtcctggggctggcgaagggagaagtcggacttgttggggcactagaagctcattgtgctcttgctccctgcagactcgggccaggatgcccacccagacccagacgccaacccagacgctgccagaatgccagccgaaatcgtcgttctccttgactctgaggataacccatccctccctaaaaggagccggcccaggggactccgccccctcgagcttcctggttagtcaacagagaagccagtgagccccggtggaggtgggggtttggggacagggtgaaatacaggccctgtgttctgggcaggtatcttcaggagccctggggtggcagggttcggggatggcctctttaaaagggtatgaggtcttttctttttgcagctgtccctgccacagagccaggaaataagaagccccgtggtcagagatggaaggaacccccaggggaagagccagtcagaaagaaaagaggcagacctatgaccaaaaacctggaccctgacccaggtgaaggggaggcccgggggaggcgtgggctctggccgcagtgctctgaggaaatccgcatcagtgaggatggagcagggcctgggcgcagggcgcctgcagctcctgaggctttttcactcacagttccatcccgtcctcccttccagagcccccatcgccagactcgcccacggagactttcgcagcaccagccgaggtccgacacttcactgacggcagcttccccgccggcttcgtcttgcagctcttctcccacacccagctcaggggcccagacagcaaggactcacccaaagacagggaagtggcagaaggaggccttccccgggcggagagcccctctccaggtgagccctcctgagagggaagcacagtagggacctcgcaggcagcgctcctgggccaggcctcagagaggctgctctatggcagagcccacagtaggggtgggtggggtgggtggggtgggtggtgctcaggtttcctggtacacggggccggggcaggggatctgaatgatgaggaaggctggcctgaaagctgagcttttctttttctgtttgtttgttttttgagacggaatcttgctctgttgcccaggctggcatgtagtagcacaagcccggctcactacaacctctgcctcccaggttcaagcaattctcctgcctcaccctccctagtagctgggattacaggcgtgcgccaccatacccggctaatttttgtatttttagtagagacagggttttcccatgttggccaggttggtctcaaactcttgacctcaggtgatccaactgccttggcctcgcaaagtacaccacgcctggcctatttttttattttttattttttgagacaagagtcttgctctgtcgcccaggctggagtgcagtggcgcgatctcggttcagtgcatcctctgcttcccaggttcaagcgattctcctgcctcaccctcctgagtagctgggattacaggcgtgtgccaccatgcccagctaatttttgtatttttagtagagacagggtttcgccatgttggccaggctggtctcgaactcctgacctcaggtgatccacctgcctcagcctcccaaactgctaggattacaggcgtgagccaccgcacctgaccaggtgggcttttcttagtgtttccttgtttcctggaattggtcactgggtccgggtaggccagtgtttcccagaagcctgatactgatttccacacatgcagtttgttctagctagagcctgaggggtgcccaccttaccctggtggagctgaggcccagatggggccactcagcaattcagttaggtgtccagagaatagataagatgagcagtggacagacacctccaggggacaccagctcagtaaattgcctcataacagcagtaagtgcttgtgttgtttgggctcctactgagtttaagaagcttacatacaaggcaagtcgtggtggctcacgcctgtaatcccagcactttggcaggctgaggcgggcagatcacctgaggtcgggagtttgagaccaacctggccgatatggcgaaacctcatctctactaaaaatataaaaattagccaggtgtggtggcaggcgcctgtaatcccagctacttgggaggctgaggcaggagaattgcttgaacctgggaggtggaagttgcagtgagccgagattgcgccactgcactccagcctgggcaacagagtgaaactctgtctccaaaaaaaaaaaaaaaaaagaagcttacatacagtttatttggcccttacaaaaataacttgtatagaagggcagatgtccattcctttttccaaaagggaaaaccatttctcaaagaaatggttccttcttccccatggtccttatgtcagtttcctatttgctgctgtaacaaatcacacaaatctaatggcttaaaacaacacacatcgggccgggcgcggtggctcacgcctgtaatcccagcactttgggaggctgagacgggcggatcacgaggtcaggagatcgagaccatcctggctaacacggtgaaaccccgtctctactaaaaatacaaaaattagccgggcatggtggcgcacgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaacaacacacatcgcttgtgcctgtagtcccagccacttgggaggctgagacaggaggattgtttcagcccaggagttcaaggctgcaatgagctatgatcacaccactgcactccagcctggacgacagaacgagaccctctctaaaaacaaaacaaaacccaaatttattattttacagttctggaggtcagaggtccaaaatgggtctcactgagctaaaatcaagctgttggcagggctgtgttccttcctggaagctctaggggaaaatctattttcttgacttgcccagctcctagaggctgcctgcatttcttggcttgtggcctccttccatcttcaaagccagcagtggctagtagagtctttctcagatactgtcctgggttccggctcatctgcctcttccccattcaaggaccctcatgattatattgggctactcagtccaggataatctctttttgagtccgctgatgagcaaccttaatttcatctgtaaccttcattcccctttgccatgtaacaaaacattcacgggttccagggattagggtgaggggcatcattctgccaaccacacatgacccagcagacagaattaggatgagactggaatgtagtccagcagggcagagaccaagcctagtcctctgttcacctctccatgccaagcatagtttacaggcgctcaggaaatgcttcttgaagaagtgaataggtaggagtgcacgtctccttgtaccaacttgtctgaaatgtgtgtttgaaactagagccatagaatgatggccaacgaggtggctggaggctctcctgagagtagggctctcaaaaagcaggtgtgcttttgtttttgttttttgagacagagtccctgcccaggctggagtaccatggcgccatcatagctcactgcaacctcaaactcccaggctcaagcagtcctcctgccacagcctcctgagtagctgggaccacaggtgtgcatctccacaccaggctaattcttaaattttttgtagagacaggttttcactgtgttgcccaagctagtctccaactcctgggtgcaagcagtcctcccacctgggcctcccaaagttctgggatgacaggtgtgcttttttgcataaagaaaaaagccttggctaggcacagtggctcacagacctgtcattcccagcactttaggatgccaaagtgggaagattgcctgaggctaggtgttcgagaccaacctgagcaacataaggagactccatctctagaaaaattttttaaattaactgggcatgttggtgtgcacctctagtccctactaagactagaggctaaggcaagaggatcacttgagcccaagaatttgaggttgcagtaaattctgattgtactccaatcagattgtactactgtactccagcctgggcaactgagctagactgtctaaaaaaaaaaaaaaaaaaaaaaaagaaacaaagaaaaaaggcagcgtattatgtactcctttagtcacactccactcacccctcacaaagtttttctttgtgttcactgctataccactcttaatttggtttgtatccttcagagagagctctctgtgtgtttgcgtgtgtgtgtagttgcttttgtttatttgcctaaatttgagccccccgttttctgatctcgaggcaggcctcaccccttcacgtagatcacagttttaactgtctcaagtttcagcttgagtcacattccagtcctggctccctgagaccgagtgtgctgcttggacttgagcgtgtcccgagtctcctggtcctctccggtggatccctgctctaaatggctgacctcttccactgtctaatgggtcttctgatttcattctcgaaagggagccctcatttcaagtcctggggtaccctgtgcgcaaactccatctatctggagtggtgagtagatgagaagagaatccctgagattctaggtttctttggggtgagtgggcaaagtctgagaggaaggggcttcagcaggctgcttgagtgatctgagggggcggaggcaattgtagggtgttgtcagcagtggcagccttcgtggaggttggagatgcctgggaaaccatagaggatacctcactggtacacaagtgttcctggagcctgtgcccgagggaggcaccctgggagatggcatgagtgagacagcctttgtcccccaaaattctgtgtccaggtatataggctggaggcagtaaatctttaaaaaccaggggcccccgtggcggttctttgcggagcagaggctctggacctgtggtttcagacgatctcacgaacccaaagcttggacagatttctcagaaacctgtgaggcttcgaccaaaatgtctctactttctgtgttgttatgtacgtattgaagttctctgaagactttatttaaataaagatcctgccactttaaaaaaaattagaggtgtaaaaatcgtggatttaacagttggaaaaggccacctgtggtcaggttagctgagctgatgaatgtgaatgtgaggtagtccaggaagactctagaaccttctgaggaccttgccagaggaggatggggagagtgtgcaggccaggagaggaggtgggccacaatgacccactgacaagtaatggaaagaggagcctctctgtcttgctggtgtttttcttttttttattttggagatggagtctcgctctgtcgcccaggctggagtgcagtggcgtgatcttggctcactgcaagctccgcctcctcccaggttcacaccattcttctgcctcagcctcccaaggagctgggactacaggcgcccaccaccacacctggctaattttttgtatttttagtagagacggggtttcactgtgttagccaggatggtctcgatctcctgacctcgtgatctgcccgcctcaacctcccaaaatgctgggattacaggcgtgagccactgcacctggcctgtttttctttttcttttttttttttggagatggagttttgctcttgtcgcccaggctggagtgcagtggtgcaatcttggctcactgcaacctccgcctcccaagttcaagcgattctccttcctcagcctcctgagtagctgggattacaggcgtgcgccaccacgcctggctaatttttttgtattattagtagagatggcgtctcaccctattggccaggctagtctcaaactcctgacctcgggtgatccgcccacctcggcctcccaaagtgctgggattacaggcatgagccactgcacctggccggtccttctctttatgatctcgtggttacggtgggctgatcactcactccttcctggagacaactttcttcccttggcttttcaggcagctgctcgcctggtgttcctcttccctcactaactgttccttctcagtttctcttgccgctcactctcagctcccagagttggaacacgtcgtatcattgtctgcctttccctttctagaatgtaagggcctgcaggttagggtgtttgcgtcctgcactataatatctgcggtaaccagaacagtgcctggcacagcgtaggcccggcttatgtgtttggtgaatgagtacgtgcttaagtatccgcagccgtgggtcagtgtcggtactcgctccctgggagatctcatccaggttcacagctttcaatgacatgtgtgtgctcataatgcccaccttggctgctccttcctggttccatcctcttttccagttgcccaggtggcgtctctacatgggtgtctaaaagatctcaaacattgtgccaccgcactccagcctggcgacagagcgagactccatctcaaaaaaaaaaaaaaatctcaaactcgccacattgaaactgaacccccagtctcaccaatgcaccctacccctagactccacaatcttccctttcccagtgaacaggcagccccaggcttcagtttgctgtgaccacacccacacagtcatcctcttctttctccagcccagcatctgtccagcagccgatcctccaaaacaagttcagagctcacactgctgtcaccacatccactgctgctaccctagtcagggccggctctcgcctggttcctgtaacaaacctaagccaggtctcctggctgctgagctttgcccgctatgctctgctctcctgtagcagccagagtgtccctgctgagaacacaagtcagatccagtcactcctctactcatggcctttctgtgctgctcctgttgcactccagataaaagccagagccttcatggtgactagtgagctccccacaggctcctgacctctccccccacatcccgctccccgcacaggcactggccttgctgttcctggggaagccagcgtgctccaccagggcatccacatttgctcctccctctgctcaaaatgctgttccctccctgtctgcctcactggctcctcactccctctgtgtctgtggtcccctgtcagctttctgctatcctattatcctatctcctttccctggtgtactttgctactttgcatctgtccatatataacatactgcattttttatttgtttatcctatttattagctctgataaatagaatgtgaagtcccagaaggccacttagggagctccattcaccgctgtacccctagcaatccaaacggcattgggcatatagtactcaataaattattgtcaaattaatgaacaaatggggttcagtgttccttcagggagcctatagtttatcagggagacaaactgtgttctgggaacacagaatagcatttggtaggtgataaaaatggggtggcagccactaagtcattttaaattccagcacatcgcacagcaaaattgtacctgttttctgtgccacattttaaataatcgtgtctctaaaaacagggtagaaaaggaacacacacaaataaatccttcccaatatagacagtgcagtagttgaaatcaccatcttctgtttttgcctttcaatgtaatgtaactttttttttttttgagacagtctcactctattgcccaggctggagtgcagtggcgtgatcttggctcactgcaacctccacctcccaggttcacgcgactctcccgcctcagcctcctgagtagctgggattagaggggtgcaccactatgcctgcctaatttctttgtattttagtaaaggggttctccatgttagccaggctggtctcaaactcctgacctcaagtgatctgctcaccctggcctcccaaagtgctgggattacaggcatgagccatcatgcccagccctaatgtaacgtaacctttgcacacgtccctgttgcgtgctcgttttttatggctgcacgcagccacggcagtcctcagtcctctttcctctgcctcgaggcccagctttgcccattatgagtgccttctccatactggtaaggtggacacctggtcttggtgatgtaggtgttgacactcaggagataaagagcctggtggaagttcgccaggggtcttttctgtcccccacgtagtccctcatgagctccttggtgggcacagctatgccttagactgcttctgggtgttcccaccccatcacctctgccccactcaggcagaacccgttaggctaggatgcccagtaagtttgagataaaatggagttggctgcaggtaggagttacaggaagaggcacgagcaccaggcgtccctgtgccaaaatacacacaggaggaaggctgcctggcttcagctggcttgtccctagggaggctgtgcgcctcattttctagctggcagcagtcctcgatcacccaggagtggagctccctgccatccttgggcttcccctcatgccaggcactgggctgtggacataatgaaagccctggaaatgtgggtacagtttgcggagcttccagggggcatcctcgtggtggggtgtctggggggctctgactgctctctgctctcatccctgcccagctccccctccggggctccgcgggacactggatctccaggttatccgcgtgcggatggaggagcccccagcggtcagcctcctgcaagactggtccaggcacccccagggcaccaagcgtgtgggagcaggtgacacctcagactggcccacagttctgtcagaatccagcaccactgtggcagggaagccggaaaaagggaatggagtgtaaattcttgctttcctggggagggagggagggatgaggcagcgtcccccagtggcttataactcagagctgcctggctcacccacctggtggagagagtagaaacaggtgccagggcaggagggggctggggcagcatccactgttatttcggggcactggaaagtgtctgttcctggccaggcctgaggtcggcgagggtggctgaggctgttgtgcagtagggcactgggcctgtggagaacacctaccccagtccttcgctgacccccacctctgtttgtcccccatgacctcctcccaccctccccctgctccccaccattctcccttggcacagtgccttacacaagagtggtcataagggggtttgaactgagtcccactacctcgggggacacctctcctccccacttgttcaggcttctaaaccaggaggcctccattacctcttcctgtcccacccctgcagaggcctgaagctgggcctgggcaccccattcactcccgttctcatttacatctgttttcctgttgtatatatcacctttgttgacaataaattatttttttttattaagagttccgtctgggccatcattgggggagagggtttgctagcaggatacctggccacctagagcaaccctgaggggcaggagggttggaagatggtcctggggggagccagggagccacctctcctgaaggtgggacagcaccagggcaggcctctgtggagcccaggaacgagggctgacttgtgctatcagtcacctgtgggcgtctcaccccctcccttcctctctgctctggaaagggggtcagaaacaattttctttaacattgtaccttctggctcacctggtaggcctctgcccaaaagaggtcactgtagaagcccaggggtgctcacaaccagggagctgggaattagcctgagcttgcttgcttgcttgcttgctttttcttttcttctttttttttttttttttttttttttgagacagagtttcattcttgctgcccaggctggagtgcagtggcgcgatctcggctcactgcaacctccacctcctgggttcaagtgattctcctgcctcagcctccctagtagctgggattacaggcacccaccaccatgcccatgcccagctaattttttgtatttttagtagagacagagtttcactatgatggtcaggctggcctcgaactcctgacctcgggcgacccacctgcctcagcctcccaaagtgctgggattacaggcgtgagccaccacgcccggcttatcctgagctttctaaagtgaaatggcggtaaccagcttgcaggtagaaagatgcctctcctccctttccgtatgatggtgaggggcacaggggtcctaaactcagccccgccttttccagccctacaggcctgcaccctcagctgtccaccttcatcccccccaacccttggcttaattaaacccaaacacttgctggtttcccctattccctggatcatgaggaggccacttttggtctcttcaccggattccttaccttcctaaactaaaccaacaggggccagatctgtgcgtggttttccctttggtgagatggagcacacaggcagccccttctcaaaccccagctgtactgtcctgtttagagcccatggcaggtgtggtaagcaggactgtatacctctgcacatgctgacaaatgtgcacataggagaagtgggggcacaggtgggacttggagggcagctattcctgtaggacgctgacattggcacatttttttttttttttttgagttggagtcttgctctgtcacccaggctgcgatcttggctcactgcaacctctgcttcccaggttcaagcgattctcctgcctcagcctcccgagtagctgggattacaggcgtgcaccaccatgcctggctaatttttgtattttttggtagagatggggttttcgtcatgttggccaggctggtctcaaactcctgacctcaggtgatccacccacctcgacctcgcaaagtgctgggattacaggcgtgagccactgtgcccggccaacactgccagattttgagactaaccaggaagttcatctcgggcaggcagggtctgggcctgggcagcgtgtgctgtgtgctcacctgatggggtgtcaccatgtgccaagccaggtatgagggatctcacgacttggtgggctcctgggacatgatcccttctccccatctgataagctcaggaggagcctagaaatatacagggtctttgtctaggggacattaaaagacaggtgtggtggacagaaggcagtggccaaggcttcaggatgccttgtatctagtgtggctcccccactgcatgatggcaggcaggcaggccggccacggaactcccatgtctcaaacaccattatccacagattggcaaaacttgtatcctacctgataggagggaataaataatgctaaaaatctggttctgcaagcacaaatactgcaaatggttttctctcatcctttcaatcctgtgacttgtgtttacatttatgccaatgtgcttttaaaacaacatggctgtgttgctgggtgtttacacttgagaaaacgtatgtaaaagtttgttgtaaaattgtgaagccaaatgcccctttgctgttctatgattaatggcttggccttctagactgtgagctcctgggcagggaccaggttgtattgactttgttttccaagtgtcctgcctggggcctggcacatagtaggtgctcaataaatgtttctcgagtgccctctgagtgtgtattcctgtgtgacatttttctagtgcatgttggtccctggagtgtggttctcagcacagggtggttgctacagtgactgtgcagggtgggaacttcatccccacattgtggccaataggggtctccccagcctcagccagggccctggggactatgtgagtgtgtgtggccagcagctgtgtgtggcacctctgggcttccaggaaagagttggagaaagtggggctgaggatatgactccagcccaggctggaaggaccttactgacggattgcccagggctttcctactccacaccggcttggagtccgtgacgctggtcctgcatcctggtgcaacaccagggaagctctgcacgaatgtcggtgactctcagggctggtggtggcaccttcatccatgtggtgctgtggcccaaccatgtgtttggttgaagaagttggggaagagggtgccgctgcccctgactgctgagccacacacccatttcctgacttcccagacctccttggctctctgaagccagccacctcctgccctcccagctgccttccatgggatccaggtgtgggagatctttttggatacctaacaaggaaaaactttctacattcccagtacttctgacaccaatgttagtggggaggggggcgcccacatcaattctccgactctccagacaccagccagctgttctaaaattcagttctgacactcactacccagagttagcacggtccctgcaggtgaagggctcagtcccagcagactgcccctgcttcagataccagttctaggtcccagcttgtcacctgtacttctgaccagcccaaatttggaagttcccacaaccccctcctcagttttgataatttgctgtaatggctcacaaaaatcacagaaacaggccgggcgcggtgacttacgcctgtaatcccagcactgtgggaggccgaggcgggtggatcaactgagatcaggagttcgagaccagcctggccaacatggcaaaaccccgtctctactgaaaatacaacaattagctgggcgtggttgcgggtacctgtaatcccagctactctagaagctgaggcaggagaatcacttcaagtcaggaggtggaagttgcagtgagcagagatcacgccattgccctccaacctgggtgacagaatgagaccctgtcaaaaaaaaaaaaaaattagggaaacatttacttacatttacttgtttataaaggatgttacataggatataaacaaacaggtgatgaggtactgagggcgaggttcagaagggttccaagcacaggagcttctgtcctagtggagttggagtgagccaccctcctggcatgtggatggggtgctgtccctgacctggaacctcccaaaccccattatttagggtttttatagaggcttcattaggcacgattgattaaatcattggccactggtgattggctcaatctccagcccctcttccctccccaaggtcttgggtagggatgaaagttgcaatcccctaatcacgtggttggtttctctggccaccagccccatcctccaagagtcatctcattagcgtgaactcaggtgtggtgaaaagagactcattatgaataacaaaagatgctcctctctccccatcactcaggaaattccaagagttttagttctggaccagaaacccggatgaagaccagatatatatgtctcttttttttctttttgagtcgtaatcttgctctgtcgcccacgctggagtgcaatggcatgatctttggctcactgcaagctccacctcctgggttccagtgattctcctgcttcagcttcctgagtagctgggattacaggcacctaccaccacgcccagctaatttttgtatttttagtagagacgggggtgggggggtttcaccatattggccaggctgttctcttggccagactggtctcgaactcctgacctcgtgataactcctgcctcggcctcccatagttctgggattacaggcgtgagccacctgcgcccaggtgtcttttttttttttttttttttttttttttttttgagacagggtctcgctcttgaggcccaggctggattgcagtggcacaatctcggctcactgcaacctccacctccagggttcaagcaattctcccgcctcagcctcccaagtagctgggattacaggtgcttgccaccaccatgcccagctaattttttgtatttttagtagagatggggtttcactgtgttgccaaggctggtcttgaattcctgacctcaggtgatccacccgcctcggcctcccaaagtgctgggattacaagtgtgagccaccaagcctggccgatatatatgtctttttatatcacaatgctggtaatcctctctttcttggggacaaagccagtctgagacaagggaacagtcacccctgccctccttgaagagaaactggagcatgtgggagtgtgaatgggaatgggggacactggctgggcccctgccgcaccccagtggtggcactggtctggtccaggccttgaggctttctagcagatgctcctgcaatctgagcttcctgtttctctgcagaaaatgcggcagtcacccccacctccaccccacacacagctgggctgctgtgtggctcaaatgagactctgcatttggggccctttgtaaactgtaaaatcctgcacacccctaaggtgtggtagaagatgggggctgggatgggagagggtctctaatgggcttgcagaccctctctgccatcggagtctcttgggaggggggcaccctactgaggctgcttgcaggtgcagggacagggaagggactgcaacacctcctggggtgtctgccttcctacctccctggagccaggtgcctcagcccagagccatcatgccaccaaatttgctcagtccctttctcccctagagagaacaccctcattctcaggacaaatgtaccagcgtccaggaaggaagaggagccagcctttgggttcccaacaccaatgtcaatggcttggatctcctccagccccacatctggtgggggtgggcagaggaagcaggaaaagcaggtgtgtgatgggagatggggtaaccaccctgtgttgcttagatcacacaagcatcagtgaaggaccccatgggcaggcactgttagaaactatggggtacagacaggacacctaccctggcttcatcacagatcacctcatattgtgcccattatacaggtgaggaaactgaggtacagtgagatgaatgcagtgacttgcctgccattccagagctagtaaaggaacagctctggccaggcatggtggctcacgcctgtaatcccagcatcttgggaggccaaggggaggcggatcacctgaggtcaggagttcaagaccagcctggccaacatggtgaaaccccatctctactaaaaatacaaaacttagctgggcatggtggcaggcgcctgtaatgccagcttgggaggctgaggcaggagaatcacctgaacccaagaggcagaggttgcagtgagtggagatggtgccactgcactccagcctgggcgaaagagcaagactccatctaaaaagaaaagaaaaggaaaaagaaaataagaaaaaagaaacaaaagggaaaagggggtcttactctgttgcccaggctagagtgcagtagtgcaatcatagctcactgcaacctcaacctcctgggttcaagtgatcctcccacctcagcctcccaagtagctgggactacagttgtgccaccatgcctagctaacaggggtctccctatgttgcccaggctggtctcaaactcctggactcaagggatgccccccaccaaatttggcctcccaaagtgctgggattacaggcgtgagccatcacacctggcttttattttatttatttattaatatttagagacagggtctcactctgttgcccaggctggagtgcagtggtgtgatcatagctcactgcagcctcgacctcccaggctcaggtataatcctcctacctcagcctcctgagtacctgggactactggcaaattttttgtattttttgtagagacgggggtttgccatgttgcccagactgctctcgaactctttagctcaagcaattcattcacccacctcagcctctcaaagtgcagagattataggcatgagtcaccatgccgggtcaggccttaatttttttaagaaaagggctaggtgccatggctcacgcctgtaatcccagcactttgggaggccgaggtgggcagatcatgaggtcaggagtttgagaccagcctggccaatatgattaaaccccgtctctactaaaaatacaaaaattggccaggcgtggtggcgcacgcctgtggtcccagctactcaggaggctgaggcagaagaatctcttgaatcctggaggtggaggttgcagtgagctaagattgcaccactgcactccagcctggagacagagggagactccatctcaaaaaaataaatatataaatacgtaaataaataaatttaaaatttgaaatgtttttaaatttaaaatttttgacacattttattcagatagtagtctgatcacatatggtctaagaacagtcaaatcataaatcaaatataaatcaaatgttaaagatggatcttcaaacattgtagccagtgatgccacactcacctatgatctctgtgacataaaaccacatccacaccccagtgacctctgaaacattcaacacagcttccttgactgtgagctgtttgaagctaccagtttgagcgctattgacttttttttccaggccctgaataactctagggatctcagcagggtttggaggaaccaactccacctcggcgtagtactgaaatgtggccaatcaaggcttcaactgagtcacagcagcgttcaccagtaccagggccttctctggcgaggtggtggacaaatcaggtcatggttctaggatggaaagtctgtcgccccgaagggcccgctgaatgccaacacctcccggcagttttactctctgtgtgtgttttgttttcagttgttcaggcgggaaagcctgcaatcgtctttaactcccctctttcataaccccaacccatccgaaagcctgttggctgtacctttcaaatatgtcccaaatctgatcacttctcactacttccactgctgctgcctggccccaagccactggcatctctcccttgaattgttgtaaaagcctccttgctagtgccccgggtctgcttctgtcatgccctttcactctgttctcagcccagcagccagttagatcatgttactccggcggcaactcatcccactcccagggaaaaccacaacggtagcccaccaggcctggttcccgtcgccacacacctacctcctcactcactctgctccaggctcattggccccttgctcttcaaacaggccaggtatgctcctctggctgggttcctcttcccctagatgtctgcagagctcatgccttcacctccttcaagtcttttttttttcttagcctcccaaagtgctgcgattacaggtgtgagtcaccacgcccggtctccttcaagattttactcaagtgtcaccttctcagtgagggctcatgaaccccctcagtactgtagcttgtcttccaccctctcacccctgtaatcctggcttaactggctctgtttttttctgatatcacttaatactgactcttttgtttgttgtatgtcttcctcaaaatgaaaagtaagctccccaagggcagagttgttttttttttgttttgttttgttttgttttgagacagagtttctctcttgttgcccaagctggagtgcagtggcgtggtgatctcggctcactgcaacctctgcctcctggtttcaagcgattctcccgactccacctcccaagtagctgggattacagacgcccaccaccgtgcctggctaattttttgtgtgctttttttagtagagacggggttccaccatgttggccaggctggtctcgaactcctgacctcacatgatcccctcaccttggtctcccaaagtgctgggattacaggcatgagccaccgcgcctggcaggcagagatctttatcttgttcactgatctacctaaaagcctaaaacaatgccttgcacatagtaggtgctcagtagggatttgctgaatgaataaatgaatttgcagatttagagagggggtaaatgtgtggcaataattcatctttgaggagaactaggagggttcatggatttgagtaggtgagatttgaactggatcttgaagtggttctggaagctgaggtggatgatgggcaatcatctatcagcttgaccaaaggcatggaagtgagagagactggcagcggggtaggagttagggagaagtgtgatcagtgatagttggagaggttattgtaaggcaatgtgaggccagattgagcaaagttttaaatgcaggctaaaggcttttcctacagccaggaccagctacataatttgtggggcacagtgcaaaatggaaatgcatggcccccttggtcaaaaatttcaagataatgggccgggcgtggtggctcacgcctgtaatcccagcactttgggaggccgaggcaggtggatcacttgaggttgggagttctagaccaaactggccaacatggtgaaaccctgtctttactaaaaacacaaaaaattagccgggtgtggtggtgggcacctataatcccagctattcaggaggctgaggcatgagaatcacttgaacctgggaggtggaggttgcagtgagctgagatcgcaccactgcactccagcctgggagatagagcgagattcagtcttaaaaaaaaaaatttcaagatggtgacagcagagcattaatccaagctcagggtccacctgagcacagggctctgtgtgactgcatggggtcgtgggcccaagaagccagccctgcctataaccagtgagggagctggtgatagctttctagcagagcagagatgttattggagctggactttgggaagattattctgacatgtctggtgcagtaggttggagggagtctaggcggggagacaagctcagcagccttgtgcaaagctagcaaggaagagaaaggataggtagggtaggggttggggatgaaggtcaaagggcaggggtgaggcaggggttagagctagagtgagaagcttggagaagatggagtctatttagacgagagtgtggaccagggagagactgctggaacaccaaccaccaactgcttcctctctcttttccctgctttccagaccctggcattagaggtgataccaggcacaggaatcagcaacgtgtctccctttggccaccagagggcagatgattctcaaggatcgaatttgggttggggagtgaggtgttctctgtcctcctcttctctctttccctcaccttcatgggtgtgccttcaccttcttcctcaacggttgggtgcctgaatagagctggtatggggcatggggagcagtgctgaagtcccaggatttactaagagtgtagtgatacctgttgccttaggaagtactttcataccctggtaattacatctgctcagatgcctatttctctgattgatgggatgaaggctggctcaagatgctgtagctgggagttggaggtcaagtagcaggggtccaatcagcagttttcccaataactcctggagcctctctgctcctgtacctttgggaacctgttgcctgagtctggtttctgactcctgcggggcctctgcctcctgcccaccttaagccactgatgggagggtgtggttccaacgtgttccaggtactatgggtgaggacagcttggcgctggggaaatcagcccaggatactccctgtccttggtaacgcagtgtaaggggaagtgaggaatggactgcagttgccatacagacttcctgttagtcaagggctctccaaagctgagaaggacctccgagttcatgaatccaatggcttcactttactgatggggaaaatgaggcccagaggaggaaagaaaagaaactttaaatgccttatcttgcagaggcattttaaaaggtaactggaattcagaaatgtcattttgaatgtcaacgcaggagcaaaggcaaaggaaagaggagcctaaactcagtgatgttatgtgatttttccaagatcacgcagcattggcacttggcagagctggggctgaaatgcagggccctggacgctcccgcatccggtgcagaggacgctgccctgggcctgcctggggccttgccgagccctgcggactagatgcgggaatgcacggatgaatccacagaagccaagatagacggtggcagacaggcaatagactgatgctgcatttgacaggtatattgataggctagatgataaaaagaagatgaattttatgagctgaccgacagatggacagaaatgcagacaggaagctgctatagaaccagaggatgccaatcacagggacggctaacaatcttgttttgtatttagtcaaatcacaagcacagacaggtgacccacgcttcctgttcaaggtttgaaaatgcccgaaaactgacggaaagacacgaagcgaatcagactccgagagccacccggggaaacgaccgggtgctcggagggcctcgggtgttgccggaaatggccgacgaccgccctcggcagggctgtgggagggggcgtggccggctcagcacgcggagcagcttcgggtatttccggaaactgccgaaagcccccttgaagtgggcggggaaaggccggtgggcgtggctggatggccgtggacgggggcggggggtaggcacccggggtcgcttcgtggatttccgtaaacagagccgaagcttcgtcttcggaatcgaggaggagagcgcgtccccggggtttaccttcttcggctgtttccggaattcacccgtagtctgtggccgggaggagaaggcgcgccccacctcccgtttctagccgcttcggatgtttccggctgctgccggcgaaaagagccgagggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcaggtaaggagccccgagggctccccgaattctctggctgggccctttgcaccttgcggagcctcctccctcttctgctctcctcgtgcccctgctgccatcctgcaagcctcggctgccctgtcatccggctcctggctccggctccgcacatcccgcttccgagtcctgacctgggacccacctcgtcctgactccaagctgcacacttgtctttctgccaacccccgtctcccctcaccgccctcctgcgctcttccgtgtcacctccccagcttccctttctcttccctttttctctcaggggcctttctggtcttcctccacccacgcttaaagcagccaccctcccgctcctcgaatagcagcaccccgcgatttgccacagatcgttgtccacctctcccttcgtctctcctgcctcgcttcccctccgcccgcaccggttctgccagtctctgggttatcaccctcagggtccttgccctggactgcgctctcgatccctggccccttgcagttcccccagctttttctaccctgcttcttcgttttccaaattgtgctctccctcttgcttgcaacccaccagctccaccctcatcacctttccaaatccttcgcctactctttgctcatcactttcccttctttgctccaggagctccctggatcctggcgctggcatttgtcgcttccgtgtttccccacagctgtcatgcgcatagttttcccacaggttgcgtttggggttccaatcatcactcccttcagagtctttggatccctcttgttctcttcccctcgggtttggcttttaggtccctgggcctcttgtttctctctgtgagtgttctaccagccttctactgggctctttctcccaacccaaagacacttggccccaccgtattaacacaacctgttgctcagtcctttcccagacctcgctgcatcacagtttttgcctttctgtcttcgtacgctggaacacaaaccatgatgactttctgtgtcttcactcccgtgcctggcacttagagtattttctttcttgcttgttgccttcctgtttctccaccctcaccccatcttccttactgtgccttttaatcagcgttgcctttcatctccgcattagtctcctgccttcttcatgtcctgtgtatccccacaccgtgcttggatccattctgttcctattggctaagtctctgtaatgcccaggaagtccaggtgttttgcatgctagtttcttgagctacacctcagcctcacgactctacacggtccccctcatcctggcagtcactgctatgtttttcacccaagtcttagcctttctgtgtcatctcacttttgatcccagagacgtccactttccacacctcccctttctttcaccatctctagcgtcctttgctgactgctctgtgcagagtcccctgcctgtcatacctttcttggtggagaactttactaggccaaaaaaacttgacttgaaaaagaagtgcttctgccccggggctgctgtgctttttgccttctttcccctccttccatcctttatgtttccctcttactcccttctttctttgtagcccggtagagcagttgttgtattctcttgcatgtgaacattcttctttgaaaaatcttacctcctttcttttactgtgtttttctattttgttaccccctggccctctgtcacctgggcagttaggaactaaagagaagttctaggcagagtttttctctgcagggttgacccttttattacttgtggattatttgcttctgggggtgaaataggggttgagagggagggatggttgatttccatttcatcactgggtttggcagctggttctgcatgggacaggggtctttggagacagaggagcatgttctgtgtctcgcagtctttctctcccttgcctaccggctgtttctctctccttactgggaattgctttctctgggccctcttgaggttgcttattccacccattttcctctcacaacctttgttttagcaggtaaaccctgcttaaccagagaactttcccagactgttgatcgtgagctggtaggaggaggccaagtgactgactggcaccctcaggcatttggggagtggcgatggagtgcctactctcagtgaggctggtggggggcattgtgttcagcagagcagagtaacagactgcctcagtgtggtttctttgtgctgcttactacatgtaaatgtattattgccatggtatttttcctgtgatgtgtgtgttgatttcctttcttccttacatgcctagcatactgctgagcatatagtaggaattccaccgtagtgtgcatccactgattccatgatagcagcaatcagtgaccatttgggaatgtaagtaagctctttgctctttgataactttgcccagagcagtagctgcatacattgtcatcctgttaggattattaattacccatcctatttctactctttatggacttagattctccttagccccttcataccttctactgttgttctcagggtagccagtcactgtatcgatttaatattaagtctcattccagtaaaagcagggactttggaaaaccttggatgcacctattccagacagattcctgtattcttttttttttttttttttgagatagagtctcgttctgtcgccaggctggagtgcagtggcacaatcttggctcactgcaatctccgcctcctgggttcaagcgattcccctgcctcagcctcctgagtagctgggactacaggcacacaccgccacgcccggctaattttttggattttagtagagacagcgtttcaccatgttgtccaggatggtctcagtctcctgtcctcgtgatccggcctcccaaagtgctgggattacaggtgtgagccactgcgccgggcctgattcctgtattctttaaaacgggaaaaaagacaagcagcagctcctcaggtcacaaggccaggtatatcaaacactggcctccgagaatagatcatgccaccaagtgaaagaaacctcttcttggtcctgttgtgattttagataaagtagtcatggaagcttggtcattactatagtcttaatgttattttttttaaaaaggggatttagttgggctgatttcctcccctaaaggtcctctgtcaccttatttaaatttaaaactggttttaccagaaaataggtaaacaaacaccactggttgtctccagtctcttttcttgctcttcctctccctcttctttaaaaatgtggctgatgagaacctgtttccaggagccctttaatcactctgaaacacacagacactgaaaatgttgaagcataaaaataaaccttgcgttacagggagattgcctgtgtgctgtccacttcgcttataacagtgaaagtaggagattaaaaaaaaaaaaaagttaagccctgtctttaagatggtttttgtgacacctgattccagatgtgctttttcacagccatagacttcctgcttttgcagaaggagggttctaatctggggctcgtagcttgggggattcttagtttgtgagctgagctttttgttcacttcttttccaaatgactctgctggcctgaagcttggcagttgtgaaagcaatcagcaagatgactgtttgtcttccagccagcagcagcagtcacaggcaagcctggagaaaggtccagcttccagagttcacctgctagagttttccataacacctgggggagaggctactccatctgggacctgccccacctctgggcctcagaaactatgagagagggattgagagaaaacttgccccacttctgctgcagtgggaagggagggggctgctgtcaggcttctaggcagtgagcggcattgtttattctctcagttctaggaaggggagtttagaagtactggtgaagaaaacaaagttacaagatcctataaggaacagctgaactactccaaacactctcactggacccccattgttgattctggataaaaatatatatatatataaaactctttttttttttgacacagagtcttgctctgtcgcccaggctggagtgtagcgatgcgatctcggctcactgcaacctccgcctcccgggtcaagcgattctcctgcctcagcctcctgggagtagctgggactacaggcgcccaccaccatgctggctaatttttgtatttttagtagagacggggttttgccatattggccaagctggtctcgatctcctgacctcaggtgatctgctggataaatattttttttttgcttttggtgtaacttaggtagattggatcggctagctagcatctcagtccacactctgagctgtgcagcagtgtgccctggtgctaattctcactctgtcctttgattctggccagggggtccttggtggtgctgccttctggtcaggaatgtgggtgaatgtcagaccaaatagtgtcactttcggcttggccctagagatcaggaaggaagtgttgttagagcaagggctttgggagtccttggagttcgtaacctttgaatctgaaaagtaactgtacctagtaaattagaataatttctctctggtcaggcaccatggctcatgcctgtagtcctagcactttgggaagccaaggcaggaggattgcttgaggccaggagttcaagaccagcctgatcaataaagtgagactccatctctacaaaaaaatttttttaaatttagctgggcatggtggcacatgcctgtggttgcagctacacagaaggctgaggcaggaggatggcttgagctggggaggtcgagactgcattgagctgtgtttgtgccactgcacttcagcctgggtgacagagcaagacactatctcagaaaaaaaaaattacttttctccaatttatggacttcggaaagtagctaaacagatggatataagacagttgttgaaactcggcctgctgcagattaaaataaagtttgcacaaggataacttaatctttcagaccaaccaaagtttgggctggagatttttctcagcataaatgtcctaagcagagttggtgcctatgaggtaggaaaagattgagactttgcttgcctaagaggtttgcagggttcgagcttttgggagtcagaacttctcagactagattgtttcccctttggacagaacaacccaattctcagtgggcatttgatcaggactaacccaggccttcatgaactctttcccattgagcacttagccacctggctggcatttctcttctcccaggagcttccatgaggttcctacttatgtattatgtcgacttgaatgaatattttatgtctagagtgcagccaagcctcagactttgtggcccattatcgacaaatggggtagggggtgggcgccacctttggccccgtgatagcttctctgctaaatggactccccccagcagcactttgaagcccattaatggattggaatgaagtaacctcagcagatggaaagggtgaggagggtggtcatcttccttccctgagactgcctgatgaggctttcctacagtaaccaggacaagcccctattccctctgcttggttaagctgtggactggagctactaggcctctgctttgagaggaagtatagaaaggatttgattctcttttagccatggtggggccgccagtttccccactttcccatcaaagcaaaaattgagaaggatgtggaaagggtgggtggagtttaaagctggcccttcctccttcagtggaagttcagcaaaatgacaaaccagataggtggctaaatttccttctcttgatgggagattccagtatttgtacgttttgtgcttgtagcttggattctccaggcctcctcccagctttcatcaaacatgagtgagtcactgaagtgttgtctatgcattttctcccttctgtctctgcaaagggaagagtaagcctttacaaacctgtgggggaggaagtcaccctcttcccactgctggagagccaggctatccccaggttaaccctgaaagtgctaactcctgagcagaatgttactgccacccgcccccttcctttttgttataggccattgaaggtcattgctcgtctttttttttgagacagtcttgctctggtcacccaggctggagtgcagtggcaggatctcagctcactgcaacctccacctactgggttcaagcgattctcatgcctcagtcttccaaataaccaggattacaggtgcgcacctccatgcctggccactttttgtatttttagtagagatagggtttcaccatgttggccaggctggtcttgaactcctggactcaagtgatccgcctgccgtggcctctcaaagtactgggattacaggagtgagccaccgcgcccggcatcattgcttatcttttagactgagatagtacagctgattctaaacagcacccagagagaatctggcctcttgatttccagttgtgtctcagaggaggaggcatcccagttcctcctcttgccctctagacatctcctcctctgataagtataaataggctagatccctttatcttcatatctgtttttgtctggaatgtttcaagtttctcaagctaggtgtggtggctcatatctgtaatcccagcacttcgggaggccacggcaggaggatcacttgagcccaggagttcaagaccagcctgagcaacatagtgagacctcatttctacaaaaaaaaaattttttttttgagacggagtcttgctctgttgcccaggctggagtgcagtggtgcgatctcagctcactgcaacctccgcctcccggattcaagtgattctcctgtctcagcctcttgaatagctgagattacaggtgtacgccactgtaccccgctaatttttgtatttttagtagagatggggtttcaccatgttggtcaggctggccttgaactcatgacctcgtgatctgcctcagcctcccaaagtgctaggattataggcatgagtcaccccgcctggccaaaaaaaattttttttttttttttgagacgttgtcttgccctgtcgcccaggctggagtgcagtggcacgatctcggctcactgcaaggtccgcctcccggattcacgccattctcctgcctcagcctcccgagtagctgggactacaggtgcccgccaccacacccggctaatttttttgtattttcagtagagacggggtttcaccttgttagccaggatggtctcgatcttctgacctcgtgatccacccacctcggcctcccaaagtgctgggattacaggcgggagccaccgcgcccagcccaaaaaaatttttaaaaagttacctgggtgtggtagcacatgcgtgtatcccacctactcagaaggctgagatgtgaggatcacttgagcctgggaagttgaggctgcagtgagctgtgatcatgccactgcattccagcctgggcaacagagtgagaccccatctcaagataaataaggtttgtcagtccctgtggtggttctttccgcagatgtctgtctttgggttggcacttatttccccctacttgcagttattccttacatttctcattagaaaatggcaaaaagggcaaaagtaaattcatttcctttttacaccaaatcattaattttaggcttataaaactaaatgaacagaagatttggtaggagaggaggggagatggacactgatactggtggctaggtgatcctgagggacaactggtgcctggcagaaagagaggagggctgtgttcagtgactggctcccagccacctttttggcctttttctttttaacatgaggaaggcggagcagaccaggggcttctctgtagaaccagtcaagctggttttgggcagccttggcctattttcttgtgtgctctttgggaagttggcaatacaaaggtctgcctcctttggggctgtgttcgttgaggcgaaagtttggaagacaactatctgtcaacaacccccttctccccaaacactgaatgggtctctgagctggtccttcactccagggaggaggctttctctccaccctatgctgaacctgaaggcagctttgctttatacacctttcactgaaagctctaagacattaactccttttttggactcccttcccaattcacaacttggtgaaagaccctcagcctagccaggaggaagggactgggtctgcctttggctcctcatttatgggtctgggaggggatcaggactccttactgctatgatctggctgctaaattcagtgacatcccaggccttttttcgtccacgcaatgggactgtctgtccaggcctgctgggaaagaaaagagagaaaaaatagtttttgctctttggcagcttacagggacttcagccataggaaacaacctgtaggaaaggtgggagcttccggtcaccatgtgtgctgacacttcctgcaatagcactaggaagtctttctcagggagcaaggccagccaggtaggattatttcccagtctcccagctaagcaggaaatgccaaaatatgaacgtttagtaattagtgagtgtaactacctgctgacagagctccagcctagaccttgtccttgggggctggttgcccctgttgatactacagtgagctactcattgcttctgattaccatttcagtatgagttttgctttggtttctgatatcccatgtgcggctgccttttttctccaccttctttttgttgtgtctttttgtttttttgagacggagtcttgctctgttgcccaggctggagtacagtggcacaatctcagctcactgcaacctccgcttcccaggttcaagcaattctgccttagcctcccaagtagctggtactacaggcatgtgccagcacacccggctaatttttttttttttttttttgagacagggtctcgctctgtcgcccaggctggagtgcagtggcgcgatctcagctcactgcaagctctgcctcccgggttcacaccattctcctgcctcagcctcccgagtagctgggacttcaggcgcccaccaccatgcccagctaattttttgtactttttttttttttaaagtagagatgaggtttcaccatgttagccaggatggtctcaatctcctgacctcatgatccacccacctcggcctcccaaagtgctgggattacaggcgtgagccaccgtgcccggctgtaacacctggctaatttttgtatttttagtagagatgggatttcaccatgttggccaggatggtctcgatctcctgacctcgtgatccgcccgcctcggcttcccaaagtgctgagattgcaggcgtgagccaccgcgcctgaccttgttggtgtttttaagagacagggtctcaccctgtcacccaggctagtatgcagtggtgtgatcatagcccactgcggcctcaaatagctcctaggctcaagtgattctcccaccttagcttccagagtactgggactacaggtcacacctggccccctcaaccttctggacttttcactcaccccatcactccctacttctccgccacagaagactgtcattggctatctttgcaagtagtattgaagccactcggagattgttgctttgtctttttgctcatgaaagtttgaattactggttctccagtcacaggaagtggggctccttaggccagctccatctcacgtagtgtactgattatgttgagcttatggcacagctgagaggagagtccaaactttttgaacactttttgacttccaataagtggttccactatggttaagagcaggtttggtgggccgggcgcggtggctcatgcctgtaatcccagcactttgggaggccaaggcaggcggatcacctgaggtcaggagttcgagaccagcctgaccaacatggtaaaaccctatctcaactggaaatacaaaaattagcccggtgtggtgttgtacacctatagtcccagctactcggaaggctgaggcacaagaatcacttgaatctgggaggtggaggttgcagtgaacagagatcatgccactgcactccagcctgggcaacaaagcaagactttgtctcaaacaaacaataagagcaggttttgcggctagatttcctgtattggaatcctggatcatcctctcctgtgatcttaggttccctctgtgtctgtttgctcatctgtaaaatgggagaagaatagtacccatcttataggtatagctgttatgagtattaaaagagttaatgaatagaaagcatttagaatagcgcctggcacagcagaatgatcattgtcattattgttccagttgaacaacacagtgaattttatctgagcaccacacaactctaggtcagtataaggggtgatgtttgggatttctctgtaatcagttgaaaaaatcttgttctggcatcttcaagccactggggtcctataggtgctttttctaacatttctgtttttttgtttgtttgtttgtttttttgagatggagtcttgctcttgttacccaggctggagtgcagtagcaccatcttggctcactgtgacctccacctcccaggttcaagcgattctcctgcctcagcctcccaagtagctgggattacaggcacctgccaccatacctggctaatttttttttttttttttttttttttggatttttagtagagatggggtttcaccatgttgaccaggctggtcttgaactcctgacctcatgatctgcccacctcggcctcccaaagtgctgggattacaggcgtgagccactgcacccgccctagtttgcttttttaccaatcacctatctgaaaaaaaatggaatgctactggagagattcatgtacttctgagaacacttttagctcattttttataaggcatcaatattagatagttttcttgattaaagaaaaaaaaacaccacccactgcctgcctatatttctgggttgcaaatgatggcggtggatgtgcagcctcatccgtggctagaaggccaaatccaaagtcaccagagcttgagttttttgagagttgagatctgtgtgtcaaaggggaagccctagggtggttctctgcagcaccaagagcagggattcataccatcatgttcctttcttttttcttttctcgtcttttctttcttcctttctttttgttctcatgagttctcactgtgttgcccaggctggtcttgaatatttggcctcaagtgatcctcccgcattggcctccccaagtgctgggattacacactcagccatgttcctttcttcaagtacggtattgaccctttggccacaggagaacgtgcccagtttttcttaaagaccacgtgggaactcagcagcccatgattgtaggttcctttttccctcatagagtggccttcaagggcaggttcttgttatctgcgtttcagagacccaaagggacacaggcatttctgctcctgggaatttgcggactttgaatcttgagctcagattttggtctctgttggttgcttgtttatcttcatctcttgtcatttctggagcctgcatgccttctcagagcagcaggtaagttgcttagttttttcacattgaagctgtggctgggggaaggtaacagtgtcccctcagaactcatggagatgccaggcatagtggaggctgaggcaggagggtcacttgaggctggaggattgcttgaggccagcctgggcaacatggtgagagctcatctctaaaaaatttttttaaaaataactcatcaggggctatttctttcattgtattttcctcttccttttgaacccctctgctgacttgtttcactttctttttttctgtttggtttctttgaactccctttcttcattatcatgtcctcattcccgtccatcttaggtttttcatttccttgttccactctccctaacctgtttctgtgccctgtttatggcatggctcaggatatgaattttgatctccgtctgagatctccttcaggtatagaatcccagaccacctggtccttttgttctctcattcctctgatttctgtacatttaaggattcactgctttagaaaactttttttttttttcttgtttctggagccacctctctcagtaaagccaggcttggcaacttattagggacagcattctggtttccctggtgacagggtttaagctgattctaggctgttgcctctaacccatcaggaatgccataagtatagaccctgtcttgggagagatctggagagatacttgagaattttggacactgtaatattgaatttggttctaattgtgatctagagaccctcagactctttcaggtgatgcacgaagtcaaaattctgttcatagtaacgttaacacagtgttgctttttcactctcattccctcaccagtatacagtggcattttccagaggctaaatgatgtgtggtaacatcacattcttctggctaatgaaatgtgtaattctgtattcttgtgttttctataatttttaaggtagtactttaaggtaaaaatatggaagttttcattgatggactcagtttgttcttagtacttctgtgctcttactaggtttcttcagttataactgctatcatctttttgtacacttcattactgtctaataaatccttattttgaaatcccagcattttcctggaacctttgagaaaatataagaagtaagtactacttgtaaaacttgcttgtaaaaacttttgggaaaactcctaattttaaaaattttattgacaacttattttagcactttattctaaaatagaaaaaaatttatattatttctcttatatgtaagggtggattgttggcttaaaaaagggagattagaagacttgctttttcaacccatagctgcaacttgtatgttaaaaatactgaagtggacataccaacaagtataaaggaggactttaaagaatctgggcagaactgtaaataagaactaaaaaaaaaaaaaaagaaaagaaatgaaagtgtaatgaaagctaccttctcagtttcataaatgttcataatgtaccttactgcgtcttatgcgacagaacattttcatgtagtattatggtaccagttaagttgtggcattctttcaagatcatttagagtttaaagaaaaaggaattgcatattttatgcgtacgtactatgagctctttaaaagccaaaatttcttccagtttttaaactagaaataaaaaagtcactgaagcctctatctaacaggataagttgccacattgctttggctggaaaagcccacacagaaactgagagacgaatgaagtcttgaacagctgacattcctgaatgcccactggatgaaaagtcagtaaaattcaaggcagtgccgctttaaatgttaccaggattcattaaattaaagatttagccaggcgcggtggctcatgcctgtaatcccagcagtttgggagaccgaggcaggtggatcacctgaggtcaggagtttgagaccagcctggccaacatggtgaaactccttctctactaaaaatacaaaaattagccaggcgtggtggcgcatgcctgtaatcccagctactcgggaggctgaggcaggagaatcgtttgaacccaagagatggaggttgcagtgagccgagatcgtgccattgcactccagcctgggcgacaagagcgaaactaaaaaaaaaaaaaaagatgtagctgcacacatgaagaccaagttaatatcttatttacagaattttactttcaccttacaaatgagcaaatctatagatgtggctcgacttgctgtatcagcaccaactgctcatcaaagaataatttattttatgtgaatgctcagcagcagatacaaatggtgataaatattcaaagggttgaataacttcctgaatctcatgacttatcctggaacaactttatttccatttgcacccttggtgcagaagcagtggtggagaaaactgctgacgccgtaacatggatcaaggaagtggcactaagctctactagtggtcattgtcatggtcttctttcccaccacaaacttgtggttgaaaaataaaagccatttttacttgagaatgtcttgaatgaaggattaaagactatcattttttttatttacttatttatttatttatttattttaatttttatctatttatttttttgaaacagagtctcactctgtctcctaggctgaagtgcaatggcgtgatctgtgctcactgccacctctgcctcctgggttcaagtgattctcctgcctcagcctcccaagttgctgggattacaggcacctgccaccacgcctggctaatttttgtatttttagtagagacagggtttcgccacgttggccgggctggtctggaattcctgacctcaggtgatccacctgcctcggcctcccaaagtgctgggattacaggcatgagccaccatgcctggccaagactattaattctgtgtgtgtgtgtgtgtgtgtgtgtgtgtgtgtgacaaggtctcactgtgtcacttaggctggagtgcattggtgcaacctccgcccactgcaacctctgcctcccgggttcaagtgattttctcacctcagcctccccagtagctggtactacaggtccgcaccaccacgcctggctagtttttctatttgttttttttttttttttttggtagagacagggttttactatgtttgccaggctggtctcaaactcctgacctcaagtgatccacctgcctcagcctcccacagtgctgggattacaggcataagccaccatgcccagtcttttattttatcaaccctttaataaaggtctctttaggccaggcatagtgactcacgcctgtaatcccaacactttcggaggccaaggcgagtggatcacctgaggtaaggagttcgagaccagcctgtccaacatggtgaaaccctgtctctactaaaaatacaaaaattagctgggcatggtggtgggtgcctgtaatgtcagctactcgggaggctgaggcaggagaattgcagtgagccgagatcgcaccattgcactctagcctggaccaacaacagcgagacaccatcccaaaaaaaaaaaaaaaaaaagggtattccaagtgaggaaatacaaagtattcatgaggcattgctgctgtatgccaaacttgaggaaagcacatgtgttggagctgaaccagctgcagggatcataattttttcttgaaagaacaactgatggacaaactagagttgttcatatggacattttatgaaaatgaacaaagtgagcctgtcattgttgccagtgataaaattcaagttttcaagtgaaaattagaattttggaaaacttgtgtctgctaaaacttttccgagattggtagtaaaattaatgaatgtgattttttgacattgtgtgaaacgtcagtgtttggaaattctgcacaattcagtgaagaaatattttccagattgctagtgggtaaaagagccattcaaagtgcaggacgaggccaggcatggtggctcacgcctgtaatgtcagcactttgggaagctgaggagggaggatcgcttgaggtcagaagttcaagaccagcctctgcaacatggcaagacctcatcatctctgctaaaatgtttaaaaaattagctaagcatggtgatatgcacctgcagtcctaaccactcaggaggctgaggcgagaagatctcttgagcccaaggtcaaggctgtagtaagttgtgattgtgccactgtaccccagcctgggcaacagagtgagaccttatttcaaaaacaaaaaaaaaaaaaaacagtgcaggatgactaatgtaaaagtatatgaaatgttccttgataaaatttcaggttccacattgcaactagcctttaaaaactaccacttgttgaattttggtgtagtatcaaagaagaaaatcctcagtatctgaaaggctgttgaactctatttttcaactacatgtctctgtgaagtgagattttcttcatatgtttcaaccaaaacaacttatgaaaacacattgaatgtggaagcagagagaagtcagctgtctttcattaagccagacattaaagagatgtgcaagaatgtaaagcactgctactcttgtggtgaaatttcattttgttttggaaaatacaggttttttattttaaaaagattattagcataaacatgtggatttatgatcttgaatggattaataaatattttttaaaattagtttcaatttctaataagatagctgtgtagtcctcaataattttttaagcatataaagagttcttgagaccaaaggtgagaaaaccacggtagcagacaaaacatggggcccttgtcttgatcggttggttggttacttgctttgacttcataaggagctcttgttttgctggttcccagccccagtataatccctgcctgggcctcaaagaggcattcagtactttggtttgcagtccttctggttccagaagctagttctctgtgatgtgagggactttgaccaaagataactgatttcctccttctgatacatacaccactggccctgtgggttttttttttttgttttttttttttttttaaatatatggcttgtttattctttttctccccttttttctttatttcttaaatttttttctcattttcccttttaatttctttattgttggtttatttattttgaaacagagtcttactctgttgcccaggctggagtgcagtggcgtgatctcagctcattgcagccttgacctctccaggctcagttgatcctcccacctccgcctcccaagtagctgagattacaggtgtgcgctaccacacccggctaatttttgtatatttagtagagacagtgtttcgccatgttggccaggctggtctcgaactcctggcctaagtgatccgccaacctcggcctcccaaagagctaggattacaggtatgagccactgcaacctgtcttgttttttatttttctcatttttttccatttttaaatttttcatgtttttttttttttttttttttttttttttttttttttgagacaaagtctctctcgctctctcgctctctcactctctcgcccaggctggagtgcagtggcgccatctcggctcactgcaagctctgcctcccgggttcacgccattctcctgcctcagcctcccgagtagctgggagggactacaggcgccccccaccatgcccggctaattttttgtatttttattagagatggggtttcaccgtgttagccaggatggtctcgatctcctgacctcatgatccgcccgcctcggcctcccaaagtgctgggattgcaggcatgagccaccacgcccggcctaaatttttcagtttttatactcatttcctttttgttcgttttctttctttaatttgttagtatttgttgttttttgagacagcctcactttatcacccagggtggagtgtggtggcacgatgttggctcactgcaacttccacctcccaggttcaagcagttctcctgcctctgccttcccagtagctgggattataggcacttgccaccaagtgatttttgcattttagtagagacggggtttctccatgttggtcaggctggtctccatgttggtcaggctggtctcgaactccttacctcaggtgatctgcctgccttggcctcccaaagtgctgggattacaggcatgagccaccgccccagcctgttttttggtcagctgttttgttttgattgcattataagattagttcatcaggtagacttcctttggtatatatttagttgtggtttggaaaataagttttttattaaaaataagtcatttatgtttacatgtaatgagtttactcatgttctgttaaatgaattgatacatatttaaatttttcctcacttgaatttctaatatagtaaatactgatagataaaattcatataaacaaaagcttctgggtgttcagttatttttcaaaatgcaaagagtcctgaaaccaaaaactgtaagaatcatggttgtagacaaaacttggtttggttctccatgactttggttgatacattttttttttatttttttattttttgagacaagttctcattctgtcacccgggttagagtggaatggcatgatctcggctcattgcagtctcaacctcccaggctcaagcaatcctctcatctcagcctcccagagtgctgggattatagacatgagccattgtgcctggctatattatcatcgttattattgttttgttttgttttttgagatggagttttgctttgtcacccagggtggagtgcagtggcaccatctcagctcactacaacctctgcctcctgggatcaagcgattcttgtgcctcagcctcccaactagctgggattacaggtgcacagcaccacacttggctcatttttgtatttttagtagagacagggttttgccatgttggctaggctcctggcttcaattgatctgcctgcctcggcctcccaaagtgctaggattacgggcatgagccactgtgcctggccctgtaatataattttacatgagttaatagtgtaacattttctcagttgtaatttttttttttgagacagtgtctcactctatcacccaggctggagtgcaatggcacgatctccactccctgcaacctcccaggttcaagtgattctcctgcctcagcctcttgagtagctgggattacaggcatgcgccaccacacccggctaatttttgtacttttagtagagatagggttttcaccatgttgttcaggctggtctcgaactcctgacctcgtgatccacctgcctctgcctcctaaagtgctgggattacaggcctgagccactgtgcctggccagttttaattttaatacaataaatatcagtagctatcacccacatgaagaaagccatttgacgtcatcagtaagagtaaagggattccagacagtgtgagaactcttttgtaaacagagataggactgataatccctgtcctcgattggttgattacttgctatgacctcataatgagcctctgttttgcaatttctggggccctggctgggcctcaggaaggcacttgctgtcttggttttcagttgttctagctgaggaagctggttctcagtgacctgatggaccttggccaaagttggctcatttcctcctttgaatacatagcattactttatgtttttttattccattaaaaagatcatttggcttacttggattttattatgaggtttgtgttttattatgaggtaggtttgtgtttttttgttttttttttaacttatatgttggctattggtcagttccaaatttgaaaactgcaacgcttacacagcttctatccttgaagaaccttggtgcctacaatagctgagagctggtaggctgcagtcactaaggccagacactcaatagtctattccctgggtggcttgagacctgacatactttgtttctttttgtttcttttccttttgtacttgactctttttaacctgtttatttcttttttttttttttccccgagaaggagtcctgctctgtcacgcaggctggagtgcagtggcacgatctcggcccacggcaaccctccgcctcacaggttcaagcaattctcctgcctcagcctcctgagtagctgggattgcaggtgcccgccagtatacccggttaatttttgtatttttagtagagaaagggtttcaccatgttggccaggctggtcttgaattcctgacctcgtgatccacccaccttggcctcccaaagtactaggattacaggcacaagcccatgcctgggctaacccctatttctatctttctttttttttttcgagacagagtcccactctgtcgcccaggctggagtgcggtggccggatctcagctcactgcagcctccacctcccagattcaagcaaatctcctgcctcggcctcccgagtagctggaactacgggtgcgtgccaccatgcccggcttatttttgtatttttagtagagacaggattttgccatgatggccaggctggtcttcaactcttgacctggtgatccacctgccgtggcctcctaaagtactgggatgacagtcatgagccaccacatccggcctctaacccttgtttcttaatgaaacatacctgtaaaccccactgttatgtaggtatactttatttttcctgtaagaggtaggtttatttggagtgtttgtagcagtgtgtgaactttgtatttccttgacaagtccttaagtgacagggaaaattgtagtagtatataatctgtaaactaccctgtaattctcaactttgttcttttgcatatactcattctccaatttccatagcacctctaacttttaacagcttccctaagtcctacaaataatagaccttgggcctcctctaatagtcactttgaccaactttaagcaaatcttttaaaactcatgtcggctgggtgcagtggctcactcctgtaatcccagcactttgggaggctgaggcgggtggatcacgaggtcaggagatcgagaccatcctggccaacatggtgaaaccccgtctctactaaaaatacaaaaattagccgggcgtggtggcgtgcgcctgtagtcccagctacttgggaggctaaggcaggagaattgcttgaacccaggagggggaggctacagtgagccgagatcatgccactgcactgtagcctgggtgacagagactccctctcaaaaaaaaaaaaataaatagaaataaaaaagccaggcacagtggcccacatctgtaatcccagcactttgggaggccagggcgggtggatcacgaggtcaggagttcgagaccagcctggccaatatggtgaaaccccgtctctacttaaaatacaaaaaattagctgggtatggtggcgcgtgcctatagttccagctcttcaggaggctgaggcaggagaatcacttgaacccaggaggcggtggttgcagtgagcatagatcacgccactgcactccagcctcggtgaccgagtgagactccatctcaatgaaaaaaaaaaacaaaaacaaaaactcatgtcatttgctcagaatcacatctcattggaatcatttttttaaaactgtttaatcaagtgctcaacatatcaattcgtgtctacatagaggatcatagctccatttcccatcactcagcaagtcccataatctgctttttccacaaagcgtatttcttttcagatttacatgtggcatgcatttcagttccagaattgaacttaatgtgctattttctctcttcggctactggtctgtgtggaagataaggaactttaatttcgggttgggtgcagtggctcacgcgggtaatcccagcacttagggaggctaaggcgggcggatcacgaggtcaggagttcaagaccagcctggccaagatggtgaaaccccatctctactaaaaatacaaaaaacgtagccaggcgtggtggtgggcgtctgtaatcccagctactctggaggctgaggcagagaattgcttgaccccgggaggtggaggttgcagtgagctgagatcgcaccactgcactcctgcctgggcgacagagcgagactccgtctcagaaaaaaaaaacaagaattttaatttcaaatatttgtttactgtattagttaaggcaacggcttagtaatggcacctcctggatggccctgtaagcgcattaatctggtccaagtcattgggaaactcagccttaaagggaatggactgagtggttgaagagtaggcagggtctcctcatttttgcatggtttgcctctgaggctgtgtatctttagctacagacagaatagctaacatttattgagcccttactctgtcgcaagcacttgtttagttgttttacattcattaactcatttactcttttttttttttttttttgagacagagtctcgctcttgttgtccaggctagagtgcaacggcacgaccttggctcactgcaacctccgcctcccgggttcaagcaattctcctgcctcagcctcccaagtagctgggattataagtatctgccaccatgcctggctaatttctttctttctttcttttttttttttttttgagacggtgtttcgctcttgttgctcaggctagagtgcagtggcactgtcttggctcactgcagtctccgcctcctgggttcaagcaattctcctgcctctgcctcccgagtagctgggattgcaggtatccgccaccatgcccggctaatattttgtatttctagtagagatgcggttttaccgtgttggccaggctggtctcaaactccggacatcaggtgatccacccatctcagcttcccaaagtgctgggattacaggcatgagccaccatgcctggcttcatttattctttgtaagttagtagatctcactgttttacaggtgaggaaatagaggcccagaaatgttgaataacttgtttaaggctacaaacccaggtggtccagagtatgtcattgtcagaaccagcttttcttggttgtgaagaatcctttgtccctggcttcagttgtgtccaggcagtagaagatagtttccttaggattagctcccagtcagtgtgaggcagatgtcttgcagcggaatttagagtcacaaatggcctcctctgcctccagttgtttcttttgtccttggtggccattggtaaatgtggccgaaatggtgtggatggagtgggagcagctttctgggctcacctccctactattgagggctctacgcaagagctatgggagacctttttaagaaaccctctttaaccccagcttctgattcacatctttatcttttcccatcttccggaatttcaagaacccctttagaaaaaccaaagccccgagtcctaaaattgataaccagcaattaagtaccttaaagtgtagggcatgatggatttctaggtttgactatcctgctttgtggcacccatgaaatgttgggattctagaactctttctttgtaagcaccccactccccaccaaaaaaaaccccactaaacataagaagcttttgtctgtggatcttaactgtgtatattttgtctctaggaagcaaactcagattctctcttacaaccgtctgtgtgccacttgcacacacacaggcacagagctacttgcttgtagccttgactgccagcagccctgaacaccgtagctggtggtgccaggccttgtgtgtgtttaggacttgccagttcagtcctgggagctgaactctggacatcctgctgtgtgtctctttatcccatcgctggtgtaatttatgccactacttcctgtttgcatttgctcagtctctcctttggtttgcttctctctgctgaagccggtccccatagctgtgcacatggctagctatggggactaggcatctagatattctagacatctgcagttgtttcttagtgggaatggttgctttatgtctctctacagaattttagttgaacttgagtgtatgatttaatttacttgcttgtctaacttcggcaagggtgccttttattttaagatgccagcatggggtgagagtaaaggggtgaactattgccctcccccacccccccaccccccacccccccactttttttttgagacagggtttctctctgccacccaggctggagtgcagtggcgcaatctcagctcactgcaacctctgcctcctgggttcaagtgattcttgtgtctcagcctgctgattaactgggactacaggcgcctgccaccatacctggttaattttgtatatttagtagacacagggtttcaccatgtgggccaggctggtcttgaactcctgacctcaagtgatctgcctgcctttgcctcccaaagtgctgggattacaggtgtgaaccactgtgcccccccgccccacaccaccaccactttttttttgaaacaggatcttgttctgtcacccaagctggagtgtagtggcccaaacatggctcactgcagcctcagcctcctggactcacacagtcctgcctgagccccctgagcacctggggactaataggcacgtcccactacacccagctaatttttttatttttatttatttatttatttttttgagactgagtctcgctttgtcgcccaggctggagtgcagtggcgcgatctcggtttgctgcaagctctgcctcctggattcatgacattctcctgcctcagcctcccaagtagctgggactacaggcgcccgccaccactcccggctaatttttttgtatttttagtagagacagggtttcaccatgttagccaggatggtctcgatctcctgacctcgtcatctgcctgcctcggcctcccaaagtgctgggattacaggcgtgagccgccacgcccagcctatttatttattttttgagatggagtttcactcttgttgcccaggctggagtgcaatggcttgatctcggctcaccgcaacctccgcctcccaggttcaagcgattctcctgcctcatcctcccgagtagctgggattacaggcatgcaccaccaccggctaatttttttttgtatttttagtagatacggggtttctctgtattggtcaggctagtggtggtcttgaactcccgacctcaggtgatctgcctgcctcagcctcccagagtgctgggattacaggcgtgagccaccgtgcctggctttatttttattttttgtagagaatggggtcttgctttgttggctaggctggtctcaaactcctgggctcaagtgactgtcacccgccttggcctcccaaagtgttgagattacaggcgtgagccactgtgcctgctctgttgcccttgattaaggtatcacttagggctggatgtagtcggtggctcacagctgtattctcagcactttgggaggccaaggtgagaggatcacttgagcccaggattttgagaccagcctgggcaacaaagcaagactccatctctaatattaaataaataaataagatttacttatccaaaagcacaattatgtgccttttttcttttcttttgagacgagagtctgactctgttgcccaggctgctgtagtacagtgacgcagtctcggccttgacctcccaggctcaagcaatcctcccacctcagcctcccaagtagctgggactacaggcatgtgccactatgcctggctaattttttgcactttttgtagagatggggtttcgtcatgttgcccaggctggcctggaactcctggcgtcaagcaacctacctgccttcgcctcccagagtgctgggattacaggcagtcgccattgtatccagcccagttatgtagttatgtgccatttctaaactactttagaacccatctctttggtgtttgtttgtttgagacagagtctcactctgtcacctcagctggagtgcagtggtgtgatctcagctcactgcagcctcggcccccaaggttcaagcgaccctcccacctcagcctcccaagtagctgggaccacaggtgctctttttgttaagagtggaaaagccaaggtccatgtactttttttgagaaagacagcctgttggctttcttcagagtggttctgccccttcccgtaccccatctccaacacatttttatctctcaacagaggtagctgctattcactcaggtgttctttaatgctgtggccacggcttccttggagagtgtggcagtgctttccttgctaatgaaaaggctgtcataatgggttaggtccataggggctctgcccttctgtacttgtattcccagggagaaaaatctctaccttaattaccgacatctcatgctggcagagaggtgtggttgctaattgattagatgacagtccttttcattgatgtggcactgttggggtggttttgttgtgctttttcaagtaaacagatagatttgggccaggtaagttgattttggagagatgaagttctgtgtagggatttccctttattaagctcatgtctttagtgccacttttgtgtcctgattttctaacttgatagtaagaagtactaagttggcttgtcttgctattttggtgtgggtggtgaataatgtctcttctaccctgctctctggtgcgttcctgttctgtttggtagcaccacattcctctatttcgtttggttttcattccctctttctctcttgtaatggttggaccctattctgaaatatatattttaagatagtgttactttgggtggtcgaggcgggcagatcacctgaggccaggagttcgacaccagcctggtcaacatgatgaaaccctgtctctactaaaaataccaaaattagccaggcgtggtggtgtgcatctgtaatcccagctactcgggagactgaggcacgagaattgcttgaacccagaaggcagaggttgcagtgagcagagattgtgccactttactccagcctgggcaataaagcaagactcagtctcaaaaaaaaaaaaaaaaaaagtagtgtttaaaagcaaacaccctgcctttcttgaaaccacagaaactgcttgtgaaacagccgatagggcaggctgccaaatacagactgttaaaaccaatctcttaatgacaaaatgtcaaacactgatgttaaaccttcattatgactgtggtgtgaggatttttctcaataagaaatgtttaggtgctgaactcccagtttcacattcagaatgcttctattatcaaattcctcttggtacatcatttccgagaggcttgtgtagctaatccactatctactgtacaggaaagattttaaataaacctattcccattcatcctcatctgtgtttttttgttttttgttttaatttcaagaagtaattttcttttgaggtgatttggaccaaccgtctcactagcttttcccatttaagataggagaactagattcagaattgtgtctttttcctaacagaagactggggccttaatctttaccccccaggctctgattaactgacttttctttttttagatggcatagaatcttctgtctgtctagagaattttgtttcttgccaggcactgtcaggaattagtattcattcctccctgctatcttcctgaagagctgtgaacctgctggtagcctgatggataagggtacagttgtttgtttatttattgagacagggtctcattctctcacccaggctggagtgcagtggcatgatcttggctcactgcaacctccgcctctcaggctcaagctatcccccaaccttagcctcctgagtagctgggaccacagtcatgtgccacaacacccagcaaatgttttgcgttttttgtagagacagggtttccccatgttgcctttgctggtcttgaactcctgggctcaagtgatccgcctgcctcagcctcctgaagtgctgggataccaggtgtgagctaccacagttggccaaggtatagttttatgagctgagctatagaactggttgaatgggaattagggaaaacagacaaccaataattgggaagtaaaggaaaaatatataagtgtgcctccttggtcacagctagccttgtgacattggggttttggatatagaacttcaggaatcccttccacctccttcccaagagaatttcttctgttggtgttgtaaggggctttttccaacttcatttccattaccaagagtcttgagtggctttattttcaacttgggttttttaagcgcttctcatgtcacctttgtttgtgtactgggcctgtctcaagtttccagagggagatgaaagacaagaaaagctaaatgactggttcttcagtgagtttcccagagtggcttcttctcattccagcactgcctaactctcaccatggctgacgccgtgggcaggcatccgcattcatggaaagccaggtcctagctggaagtgacacagggatcttcagatctctcttagcccactgttcctctgaaaaaaaaacaaaagccatagacagtaaattgggggaataggctgaccataacttcagttcgtggatttgggtcccacactggattgtgtgatttgtgcttatctcctactagattgttaccttctttgaaggctggactgtatcttatccttctctgtatcacttcggacacccagaaactgttggagtactttgcacatggtcacctcttaatgaattatttgtgaaacaaaaatttttttaaattgtaacatgaggctgggtgtggttgcttaggcctgtaatccccgcactttgggaggtagaagtgggcagattgcttgagtccaggagtttgagaacagcctgggcaacatagcgaaaccctgtctctataaaaaatagaaaagttagctgggtgtggtggtgcgggcctgtagtcccagctccttgggaggcagaggtgggaggattgcttgagaccttgtctcaaaaaaataaaaaaaaattacttaaaaaaatcgtaacatgggtattctccattacagttacccttagggaagtgtgtccatattgatttgtaagtctgatatcagtctatctgattctttggctgtgtaagtcacaagtcttaaccagtatcttaagtaggtgtggtaatgactacagagaagtgctttttcaggatgagaagatgagggagaaaatttacaccattgctggattgtgttaagaactcggagaggaaaccacagggaggatgcactgctgaggaaatcgtctggcttcctggagtggggaccagagccagagagccaagccctcctggctttgctgagttctgtccttgcccctgacaccaacgtgtctgcctgcgttgttgctcctggttacagtgggctcagtcttgcctcttttttgatgggtgggcagaggaacactagtgttgggaatattgtccagcgttggagagatcatgtggtctgtcagaaggctggagttatttatagtgggagaaaagcccaggagcatggcacgggaagaactgatttcacaccagctcagcgcctgatgatggtgaggacccagattttcctttgagcatctcagagcagatcagtcgcttttcctgattgacccatgaactgtgagactagggaccatgttttccgaggccactgtgagtgagggaagagtgagaaggatgaccattttcttcttccttgattctggtctttgtgatgtgtggtatgaaagtgtcatctgacttttgaatctccttttattgaactggtgaagaaggcaccagctgtgtggggtggtggaaataaggacctgttaaactggtctgcctgtatctgcctccctgctcccccctcaccccacccacccccaccctgggcagggaggctgaaactgctgcttgctaggctttgccaactcagtttctcttcatggattacctgctcgcggcaggcaggcaggcagctccccacctggaagcctgcagactcgccgagctgagagaatcatgctgcaggtgggggcaagtgctaggaactaggtgtgccacttaccttaacaggagctgtgcctagtccgggctgctcaaactaaggctgcagagccctggggcctgttggaaatagactgtgcctttccctgcgccttgtggccacatttttatggtatgtggagagtctgggaggggccgggagcttgtaaattgtgagtaaatgaagtctagggagggagatgatccttcttgagggcaccctgagttcagggttgtcatgtttctgaggtgtgctactgcttagtaccctgatttctggagttgtctacctaggttgcttttaattttttcagccttaggtggaagagattttccatcttggtgtttaggcatgttaggtgaggtttacttccggagccagacttttaggcaggttgtcttgacataagtcaaggtcaggaagcgatcttcaggacatgcagacgatgcccacttcctgctgtggtcttgaagagggctggaaggcttgtgagcacagaggcactgagggctgtcgcatccatacaggaagacactcagggctcgtctccggtgcctcattttataagcatggaaacaaaagtcccaggagggtgaatgacttgcccaaggtgacataaattgtttgcgcagagctgggtctagaatggatcttatgcccttggcagcgtgcccccattgccatcacttcagaggggctggctgcagccctcaacggcagaaggcaagctgggaaaggacaagtggaagggtagcaggccccaattctgcacactggagagcacctctgaaatcctgccggagactatgcccatagaggtgccagaggccctagggaatgatgatttattttgtattttgtatttttgtggagacagggtcttacaatattgcccaggctggtctcaaatcctaggctcaagtgatcctcccacctgggttcccagagtgttgggattgcagacatgagccgtggcgcccggctgggaatgatttaaaagtcggcaccagcattctagccctgacccaggctaaaaggggtcacatggagcagagctgtgcaaagagcttttgggtgaggagtcactccgagaaaagcgagaagactctgaccccgagacttcccgtggtgagttaggaaagcatttctggagagcctgttaggtgccaggcactgtggctgggcactgaagacacgaagtgatttagtcttggaaattcccttatgctgctctcagtctgtgtaatagtgaacaagacagccaacaagagttgtgaaggaggccgttcagcaagcaatgaagtgctagtgcaggaaggcccgagctgggaaatgtccggagagaccctgtgaagtgatgcagggatcaggaaagcttcctggtggaagcaatgtctgagctgaggctcaccacaaagaggaatgggagtgactgctagagggaaagtgttccaggcagtggaaagctgtggccaagacctgggggggtctgagaggccattgtacatttgaagacaggtggctggaacccagagtgagactctaggaagggaagagagttagtctggagctgcaggcagggaaggggagacagccagctcataatacagtgtgggcaaaaatccagaaaccatgtggatctaatttgatatcaattttacatgtatatgtgtatatacctacacacacatacataaaatcagttatgtttgtgtgtgtgtatatgcatatttgtgtgtgtgtgtacgtgcgtgcatacagaaagttgtttttttaaggcatgctttaaatacgaagccatcacttccttttcccagtcctgggtgccttttgagatgagtgttggtgctccccccaccgccatgtgccatcttctggagtaagagggagtgctttcactgtgtgcaggtgtggctaaagagtattcactgtgtgcaggtgtgggtgaagagtattcaccgtgtgcaggtgtggctgaagagtattcaccgtgtgcaggtgtggctgaagagtattcaccgtgtgcaggtgtggctgaagagtattcaccgtgtgcaggtgtgggtgaagagtattcaccgtgtgcaggtgtggctgaagagtattcactgtgtgcaggtgtggctgaagagtattcactgtgtgcaggtgtgggtgaagagtattcactgtgtgcaggtgtgggtgaagagtattcactgtgtgcacgtgtggctgaagagtattcactgtgtgcaggtgtgggtgaagagtattcactgtgtgcaggtgtgggtgaagagtattcactgtgtgcaggtgtgggtgaagagtattcacagtgtgcaggtgtgggtgaagagtattcactgtgtgcaggtgtgggtgaagagtattcactgtgtgcaggtgtgggtgaagagtattcacagtgtgcaggtgtgggtgaagagtattcactgtgtgcaggtgtgggtgaagagtattcactgtgtgcaggtgtgggtgaagagtattcactgtgtgcaggtgtgggtgaagagtaggctgtccaggatttcaatccttggcttttgctctgcagcaagggctggctgagggcactgtgaggcttcttcaggcccaggagtcaggcccactttcccttttctcttgagggaatgactcagagaacactcctgccaccggaggttctgcaggcttttgagaggcagccagtggaggctgatggtagcagttggtgagaaagaggaagtatgtagtggccattcctccggccactcctgacaaatatttctgtcactaaacagcacctctctgtggcagccttgggctgtgttctggaaagggaggagctttcctctccctgtgggagggcctgtcatctgtggcttctgctttgcccttggccacagactagattgcacaacacagccaatgagagtccctcttccctcacaagtgcttggagtgcagaccttaacttacagggttgtagaagtgaccgtgttccacactgcagggtccaggtcacagccggcaaagcacatgaaaattgacctaaggttagaatgtgattatcctactgggaaaggtttactgggacagcatttcacttctgactccataggctgtcgtctcctgccagggagtgagttttgtttccatgcttgtccagtctttactgctttcccagaggccataaacctgccttttcccagaggccataaacctgcccacctcctgctatgttctagttctgataggagtaccattcagagttcttggcaggggaccaacccgcttctaccgtggttggtttcccctccttttcccagcttgtttgatgtgcacgttctccaaaattcttatgcagctggttggctctgtagtgcccagagattggagctcctgcaacgggaaccccgccgcttccctccctggttttaggggcagggcttgaaaataaagaatcataatctcccttcctcctcctcctcctctcccccacttctccctgcccccacccccacccccacccccaccctgccaggcaaactggagtgaccagctcagagcgggactcagtccacctccctgctctgcatgtcagcagtgatctggaggagattccggggcgcatgagtatgtgaactctggagcacgttactgtcccgggctggcactctgtggcaggtgtgtgcactcattctgctgttactggagaccagtctccttaggggtgatggtgacccagctagatgtctgccaggtctgtccaaggccaccctgttctctaatagcttgggaaatggaaagcacttctaaatacccctgctcttcagaagagctggctgggtggtttggggagtttcttctttgaatctcttagagtacaatatcccttttttcccgaaagccaggttctttagttcctaagctccattctcttgttgctaacttactaccttcagttttcttaggttgggtgcatcttccctggcctcaacaagacagtggctgaaaggtcaagagagtggtagctgctcctttgagagaaaggggatgttggagtgggagcacaggctgccagcagttgtttcaccttccccctttggctggctaggaaaggggcaccactttagtcttctgccaacctccacagccagctgtgggaaaacccaaaaggaaacatcctctcgctgctaagacttgagagcctgaggcagagaccagccagtagcagcccgaccctgctgaatggggaggattgtttattttattttatttttttctgagacggagtcttgctctgttgctcatgctggagtgcagtggcgcgatctcggctcgctgcaacctccacaccccagattaaagcgattcttctgcctcagcctcccgagtagctgagactgcaggcatgcgccaccacgcccagctaatttttgtatttttaataagagacagagcttcaccatgttggccaggctggtcttgaactcccgaactcaggtgatccgcctgcctcggcctcccgagggactgggattacaggcatgagctactgtgcccagcctgaagattggttatttaggggctgtgacaaatggttttgcagaggagcactggaaagcctgtaacttcacagagccaggggtcagcttttgtgccatagccttatagcttctgtggcctgtagtgcctgaggccaggggatcaggtgctgaccacctttccctcttccttcctgtgtcttgcggccagcgactgttattgtcaggttgaccctctggttagagaggatgactttggcctggtgtccagactccctgctgccttatcccctctgccctggaactgcacctaaaaacaattactttcctcctgattccaacataagtggtcacagaaagttctgttttggcattttgatttctgattgggagtttaggcatctgagaattgaatgcttgctttatacaaatatacccttaagacatctcctcttttttcagccctacatgctttgcttgggtattaattgaacttggggctttttagggaccttatgttgcctaccttcctagtttcccctccactccacccccaaaaaacccaaagaacattggaaaaattgagcagtgcctcaaggtcacttgatcataagtggtatttggcatagttaactggtttggtgtttggtgagagatttctgctttatatttgagcaaaaaatttcttggcgggaggcctctatgctgtgttgccaatgcttgccctgtgcgcagggtttgccccctcccctcccttgacaggttgttctaatccccttgtctataaacaagtgcagcagaacttgtcggcccagctcacatgaccttggttatctctttaaccagcatcagcgttagataccacggtcacttgacatggtagagctgtcagggtagagtggagataccagcaggaatcctggtccacgaagaaaggtaaatgggagtgtgtgtgaggccttaggactgggtgggaaaagtctgttcccatggggtagggctttcagctgtgagaagaggataatttcattccttctccttttttaagagactgtctcactctgtcgcccaggctggagtgcagtggtctaatcaaggctcactgcagcctcaacttccttagctcaagcaatcctcctgcctcagcctcctgagtagctgggaccacaggtgcatgccaccatgcccagctaatttttttttttttttttttttgaggtagagtctcactctgtcacccaggcttaagtgcagtggtgcgatctcggctcactacagcctcagcctcccaggttcaagcgattctcctgcctcagcctcttgagtacctgggattacaagtgtgtgccaccatgcccagctaatttttatatttttagtagagatggggttacaccatgttgttcaggctggtctgaaactcctgacctcgtgatccgcccacctcagcctcccaaagttgttgggattacaggcgtgagccaccacgcccagctaatttttctttgttgagatggggaatctcattatgtggcctaggctggtctcgaactccttgcctcaaatgatccgcctacctcagcctcccaaagtgctgggattacaggtgtgagacactgtggccaactttcattccttctttatcaccctaaaatttctagttctggcgtcttgtttatctttctcaaatcctgtctgcaggggcccaggacatgcagctgtttcaggaaaccgcccttgagatggggcagatgtatgctagttcatgggctataaaactcaacaccaaaaatcccatcgtcctaaacagtgacctgttatgttgtgtgaaggacagtggcgatgggggcctggccgccagagaggctgctggattctatggcagacacactcaggagctggaagtgtggctaagctttcagcagcaccatcacttccctccccatacacatgcacacaggtttcctttgtctcacagctgaagaggcagcgcccagcttcagtaagcactgtgtatgagaatggacttactctggccacactgtgcacacgcatgtgtgtgtaaaacactgatcacatttcccataaagactgttgatttgcagagtttccaggcccatacatctagggcgggatgtgtgtgttttcatcaggggagagtagagtggccttttgtggaagggataaaatggttgagctgctggagacttttctagctccatttatacagcagcctttctgcctgggtgcagacttgaacccaagtccaagttcaagccatgtgtgtagatgaccagaacttagccttcaaacttagccttcaacttcaggactctcctggagaaaacatccatctccttttggagatacagagaattcgtgatgagctttgagtacagaagttcaagttatattttctggcaacctacagaataagttgggaaaggatatgtaattatagaaataaccagcatgtcgccaggcattgttgtccgtgctttagatggtgtggatattttgtaatttctgattctttacctactgttttcaagacttggtagggaccccgttatggctgtggggttctttgtccttggtagttagcatgaactatgtagagcaacagaatgggtagccgtggcctctggccacccagctaaattctactgatgagaggtatcctgggtgggtttcttctttgggtcttcgtttatgccgccattcctattgccagttagagctgccttttaggatttgttgggtaggagctgtattcctcttggagccatcttttcttccctgccatctctgagtgaattcagaggtggagagctacagacttggctgcttgcctccttcaaaacacccagcattcccttgtccacagtctgtgtagcagcacatctaacaatgcccaaaagcggcccccttcctcccagccacttgttaatgggtggttctggttcctgagggcttcgaccagtgcacgagctaatctcactgaagagtgccattcccaggttcataccacagaagttagaaagctcaaagcccaggtcttctgcaccgaagagtgccattcccaggttcataccacagaggttagaaagctcaaagcccaggtcttctgctgccttgggccattcccttctcttagaaaccagttcaatcagactctttttttttttttttttttttttttttgagacggagtcttgctctgtcaacgaggctggagtgcagtggcatgatttcggctcactgcagcctcgacctccccaggcacaggtgatcctcccacctgggcctcctgagtacctgggactacaggtgcccaccaccacgcctggctgatttttgtatttttagtagagatggggtttcatcatgttggccagtctggtctcgaacgcctgacttcaagtgatccgcccgcctcagcctcccagagtgctgggattacaggcgtgagccactgcacccagcccagactcttttcataggatgctgaaaggatgaattaagtataaaaagtgccttttggccagatgcagtggctcatgcctatcacttgagaggagcttgggcaacatggtgaaaccccatctctacaaaaaatacaaaaattagttgggcatggtggtgggcacctgtagtcccagctactcagaaggctgaggtgggaggatcacctgagcctggggaggtcgaggctgtagtgagccaagatcgcgccactgcactccagcatggtgacagagaccctgtctcaaaaaaaaagtgctttttaataaggtacacgtaatggaaaatggctgtcatctggtttgccatactctgctcctaggtagaaagtacaaacagcaagggccccttggagcaaaattgtcattgccgccagtgaataaacagcagtggttggctttgaggggcaccttcagcctaaagccataagctgacatatactcagtctcactgagaagctcgggctttccactgttcacctaactgctgacaaatgaatcctccattgatctggcaagctggccaggatacctgcccaggccatggccacttagtaacaggatccggttctcagtgcagggttgagactgcagcagcagtggcaagcccagtaaggcaggtatgaagcacagcccccgcatcggttgcctagtagggaagacagttgtaaagagcatttgcccctgttatgtcagggtactgttgcaggttgtcttttctcctctagctggaagttgttctacccagtcttccttaattagctcttcttttgtgtaaggcagcacccatttaaaattcttttcctccagcctcattcctcatctccatttgggtttatatctcctcagaacctctctcctacccagccttaagctctaccccaaatgctttgaagctctcttgttcaagtctttttttttttttttttttttttttgagacagagtctctctcgctctgtcgcctaggctggagtcagtggcacgatctcggctcactgcaagctccgcctcctgggttcacgccattctcctgcctcagcctcccgagtagctgagactacaggtgcccaccaccacgcccggctaattttttgtttttttagtagagacaggatttcaccgtgttagccaggatggtctcgatctcctgacctcgtgatccacctgcctcggtctcccaaagtgctgggattacaggagtgagccaccgcacctggctcaagtcttcttgattcaagccctcacccagagcttgaagactagggagcccccgtgtctgctgcccatggtgcttggagagcaaagatctgttcccgggtcctgagttggaactctgaattcatttcctgttctgggctatggtttaagtcttaagtacaattcacgtaccccttgaaatactatgctgggacctcatgggctggcctgagaacacagctaccatttgtaacatgtttctatggaaaaagagttccttcttagaacagaacttttggtaacttggggatttcttgactaatatgctgcaacagatttgcatttgcctgtggaagtgtctctttattttgtattcagctgggcacggtgactcacgcctgtaatcccagcactttgggaggccgaggcaggcagatcacttgaggacaggagtttgagaccagcctggccaacatggtaaaaccccatctctactaaaaatacaaaaaaataatctgggcctggtggtgagcgcctgtactcccagctactctggaggctgaggcaggagaatcacttgaacccaggaggtagaggttgcagtgagctgagatgacaccactgcactccagcctgggcgatagagtgagactctgtctcaaaaaaaaaacatttaaaaaatcacattttgtggtcatggcactatctatcacacaagtaagttgtcctcctatatgccaaatgacagaaaagaagcaccctcctcttcccacccagaaaggttgctagagagctacccttgtcttctgtgattgccttgaggggcaggtttgtctgggttctccatgtcagctgatttgatccatagtccagtagcacctgaaacaggatgccctcattccacaacttaggtgccctctcctgcttggttttttaatgatctgctacaggagaaagatagcacctctcccttcagcaggagcagcccagtaagggcttgcttctagaaagattggccagttggatttttagtggtcacttaagtggagtagccactttgcagcctggcccaacagggagacagttctgaggtgagggtggcagtgacagccttggggtggtttctgatgtgctctgacctctggccatggtgacttctggagcaacaaactttgtcccagtatttttttctgacatttcctcctccttattcaactccctctttgaaactggaggagtagggaggcagtatttgttcacttccagagaaagatgcagcaggaagaggcatatgtcttgttctgcactttccagcagcaatgctgggactagggggtctagaaggcctgtttcccagctccaggctggatcttatcctcagcatacaagcaagttttaaggaaacaacattggaaagggcagaaacaaagggttaaatctgtacccaggtagaaagactgttgcataaatgctgagttttttttttgtttttttttttaagatctcatgcttcttttttactttgtgttggcaaaaaccccaggagaagatgggagattctgggaggagatgattatgctgggtgagtcaactgagctccccagctgccgtttttagttcttttgcttttctgtaacaggaggcagtttggggaggggttgggggcagggtgggaatgctgatttttgcagcaggacaggaggcaggtgtgtatgggtgaaattattttgacaccctagagttaaccgggccttagagtcagtacattggttcaagtaacaaatatcaaagcagaactcttagtgtggcaaacaataaataattgtctcctagattcttatacaagtcactgtccgtccccaattggtagctcttagaatggctcgagttgcattcattgtcacagcaagacacaatggttttgatagcaaagcagtagagaaactaaatgtagagaggcagagagaactgtattaagtctgaggacctggtggttgtcatgggcagcaggaagtgtgaaggagagggttttccctccgatgaaaggaaggctagggcttgattcaggggagcaagtgggatgggccctgctggtccctggctgtgcctatattctgagtctgtctccagctcaccttggtgatcactcacttttcatccatcactgggataggggatctcgtggctcattaccctcatgggtattttttgcagagtacactgaagtgggctatcagttatcagttggtcccagagaccgtcatgaagacatcgcaaaatgttttcttatgtattcatttgtgcacatttattaattcagtactttactgaatactgtgctgggcattgttctgggccatgaataagacagacctggcctggtgcagtggctcacgcctgtaatcccagcactttgggaggccaaggcaggcagatcacctgaggtcaggagttcgagaccagcctggccaacatggtgaaatcccgtctactaaaaaaaaaaaacaaattagccaggcatggtggtgggcacctgtaatcccagctacttgggaggctgaggcaggagaatcgcttgaactcgggaggcagaggttgcagtcagccgagatcacgccactgcactccagcctggatggccagagagaaactctgtctcaaaaaaaaataccaaggtccctccttttgtagtgtagtctagcaggaaggacagatagtaaccaaccaacttcaagggcaacgaatgcctcgaaagaggggaaatggggctggtagcaagaaattgtgatcttccttcctctacccttatctcttggggtcgagagtggggtcgagagtgggcaactttaaagatcaaaaagttgtgcctctcttgttccctaagtattgtaacatgggtcagctaggtgtgggcactgttgggcactgagggtatatgaaggtgagggagatactggctctcatctgtcagagcatgagggggttaaggtatggggacacaaacaagaaatcaatggggctgggtgtggtggctcacgcctgtaatcccagcactttgggaggctgaggcaggaagattgcttgagcctaggagtttgaggccagcctgggcaagatggcaagatgccatctctacaaaaaaaatgaaataaataaaaaactagccaggcatagtggcacacacctgtagtcccaactattcgagaggctgaagcaggagaatcccttgaacccaggagtttgaggatgcagtgagctgtgattgtgccattgcagtccagcctgggcaagagagcaagacttcatctcacaaaagaagaagaaatgaagagtacagatagagcgctgagagtctagagaagtgagtctagagaagtgagtgaccactccccgctaagacggtgtctggatttgagataaacaacggataagaggacttacctggatcacaggaaggcgcataggatagatgaccactttccttttagtatgtgtagatctgggtagctctttgtaccacaattctgacccattcttttttcttattatttttatttatttattcaaaataataattttttttttgagacagtcttgctctgagccaccatgcccagcctgaaataataaaagttttaatcttttaaaaaatatgggccaggcttagtggctcacacctgtaatcccagcactttgggaggccgagctgggcggatcacctgagatcaggagttcgagactagcctgaccaacgtggagaaaccctgtctctactaaaaatacaaaattagccgggcatggtggcgcatacctgtaatcccagttacttgggaggctgaggcaggagaatcacttgaaacccgggaggcggaggttgcagtgagccgagatcacgccattgcattccagcctgggcaacaggagcgaaactctgtctcaaaaaaaaaaggaatgcttcacaaatttgtgtgtcatccttgcacaggggccatgctaatcttctctttattgttccatttttttgtatatgtgcatgtacagagtagtggagctgggttatcactacagtctaactccagaatgacacccttcactactataccatatatggtgccccagtatacagcagtggagctaggaagaaaagcccagtgtctagagagcccagaaaatatgccaagaacatatatactaggcaaagaaaacgaggttaggaggaagcccagccacctcagctgcactggttaggatctgctgcctccccacagtcctctgtaaagtgagccagacctctatgctgcaggcttccttctgcctacccccaccacccccatcccccagagccctgggctactggcaggctggctctcctgtgatatggaggaacttgttggtctccatggttacggtaacccactggtatgggaggaaccgcataaagtgcgaggctggcagtgtgagcttccctcagcccttggcaccatgtggtactggtatgtcggctgtttcatggaccttttctgggaggagggagttaaggaactgatgaagaagggaagaaccctggcaggaccactgtcgtcatcctctgggccacacagagggcgaaggcatgggcaccatgtcattcagctactcctcctgcaggatggttttatgttaggaaagagggtcctctttgcctgattgcccagccatggcagaatttgacttttccttgttatagagggaataccaggatgacaggaatcaacttagctatactggtacttacagtcaaatttctaggtattgtagctcttcccagagcccagagaacccttggagaggggaaacaatggttcctacccaaaaatgaagctagataataatagaatacatcatcaagacattactgaacaccacgttctatggtaaacactgacatggattttccttttttttttcctttgagacagggtcttactctgtcacccaggctggagtgcagcagtgtgatcacggctcactgcagcctcagcctacctccctgggctcaggtgatccttccacctcagcctcccaagtagctgggattgcaggcacttgtcaccacaccccggctaatttttgtgtttttttgtagagcctgtgttttgccatgttgcccaggctggcctcgagttcctaggctcaagggatctgcctgtcttggcctcccaaagtgctggaatcagaggtgtaagccaccacgcccggccagattttctcatttaatcttcactctaattctgtgaaatgggtacagctagtatctttatgtcccaaatgaggaaacagatttggagaagttatgtcactttgctcatgttcagtcagctggtaagcaacagaggtgggcagagcgactatagtaagttttctgtatagtttacctcttttaagtttctggaaggcaggagccagatcgcactgagctttgcaactggagccagggctccagagtactgctcaacaaaggtttgctagggcaacagtagctggggatttagcgaccagaccccagcaagcagattctcagggatgaaagtagtcctggaagcctctaaagccctggttgctcagtagaatctagtttcaagaggagcccagcatttcaagtggctctgaagacagaggagatttggagagtgctctttgcattgtggcttccaggcctgaaggagagtgagctggaggttgctctctgttctcacctcttatgccatgtcaggtttttcccaggcaggcttgagtcctgggggagccccgcctcatggcccaggctgcagtgctgatctccctgccttgtggtgaggattgcagctcagagagctaaagggcagtaaaccaccttggttttggctttgtgcttaagttgcaggctcttctggttatcctttgtgaaggaggctcttaccctggctggaaagagggagcagcccctgcctcccatctacaatgggacagtaaaggaatatggctgtttctcaagtggaacagtcacagttaattttgggggtgggagcatccaggctttccactggtgagtgcctgccagttttacaagctctcctacactgaatgctcctctggtttattgactcttggcagttgatagcgatagttgctcatggcagttgatagcgatagttgctcagaatcaaaggatgaaaagacagtttctggatacagtgagggaggaagggttaaaaaacaaaggactccaactcccagttacaagatgtcccatatggccatgcgcagtggctcactcctgtgatcccagcactttaggaggccgaggtgagaggattgcttgagcccagggagttcgagaccagcctgggcaacatggagaaatcctgtctgtacaaaaaatacaaaaattagccgggcttggtggcccatgcctgtagccccaggtattcaagaggaagatcacttgagcccaggaggcgaagattgcagtgagccaagatcgtaccactgcactccagcccgggcaacagagcaagaccctgtttaaaaataaataaataaatagggacttgccacaggcacatgacctttcttaagagacaaagtcttgtgctgggaatggtagctcatgtctataatcccagcactttgggaggccaaggtgggcagttcacttgaattgttgagttcagtaccagcctggacaagcttgcaaaaccctatctctacaaaaaatacaaaaattagccgggcgtattgctgtgggcctatagttgcagctattcgggaggctgaggtgggaggatggattgagcccaggaggcagaggttgtagtgagccaagatcgtgctgctgcactctagcctgggtgatagagtcataccttgtcttgaaaaaaaaagagaggctgggcgtagtggcccatgtctgtaatcccagcactttgggaggctggggcgggtggattacttgaggccaggtgttcaagactagcctggccaaggtggtgaaaccccatcttactaaaaatacaaaaatgatctggacgtggtggcacgcacctgtaatcccagctatttgggaggctcaggcaggagaatcactggaacacaggaagcggaggttgcagtgagccgagatcgcaccactgcactccagcctgggtgacagagcaagactccatctcaaaaaaaaaaagaggccgggtgcagtggctcagacctgtaatcccagcactttgggaggccaaggtgagcagatcacaaggccaggagatcgagaccatcctggccaacatggtgaaacctcgtctctactaaaaatataaaaaaattagctgagtgtggtggcgggcgcctgtaatcccagctactcgggaggctgaggcaggagagttacttgaacccgggaagcagaggttgcggtgagccgagattgcgccactgcactccaacctgggcaacagagtgagactctatctcaaaaaaaaaaaaaaagagacgagagtctaattctgtcacccaagctggagtgcagtggcacgatcatagctcactgttacctccacctcctggactgaaacgattatcctgccttagcctcccgagtagctgagactacagacccatggcaccatgcctggctaatttttgaatttggagagagagggtctcactctgttgcccaggcttgtctcgaattcccaggcgcaagtcgtcttcccaccttggcctcccaaagtgctgggattaaggcatgagcaacagtgctcagccccgtgtggctttttttttttgagacagagtctcactctgttgcccaggctggagtgcagtggtgcaatctctgctcactgcaacctccacctcccaggctcaagcagttctcatgcctcagcctccgagtagctgggattacaggtgtacgccaccacgctcagcaaatttttgtatttttagtggagatggggtttcgccatgttgcttaggctggtctcgaactcctgacctcaagtgatccaccagcctcggcctctcaaagtgctgggattacatggtgggggccaccatgcttggcccccatgtggcttttaatctaaatcctaccctatctcttcccagcttttctgtttgtagtcagtgctttgtatttcctcagtttacaaaatcccttactgtctcccacaaataggattgaggaaacagtccttctgtcacattgcaaagccctagaaaaatgaagggactagaaaaatgaagctgtttgatcctgctctggttctcagtctaccagtgagtgaagggccggagggcccgggcaagcttgagcccaggatccagtgggcccactgaagtcagggcccacttttggggggctgggaaaaggaagggttgctgtgggaccactgggataggcctttaaacagcacttcaccattggcctgaatcaaacattgtcattcccagtgtcccgagcaccttccctgagtcttcataccttctgcctcctagcttatggaggaggagccaggggcttatcttttgggggaaatgagagcacgattaggcatcaagaagggttgatgagaaactggtaagggggactgtcaagaacagcagagtgctgaaatggtgacaaaagctctgggctccggccccagctctgtactgagaagctgtgagattttgggcaagtctcataacctctgaatgccaatttctcaatggaaaacagggagactacctaccctataggtctgtgtttggagaaaacaaagtgtaagcgctggacatacagtagcatcagaaatgctgaatccgttggccagggctcatgtgtaaggcaaacatttcttggccactcctgagtagcatggtcttgcaggaatatatgcttaagtgctgtgagagcacagaggaagctttgcccttccctagagggttaatggctaccaacgtgagaaggtcacggagttccttaatgagagggagcctagcctagaataggggatgaatgagaaattgttctgagaaccagaggcaaggctgcaaccagcacatagacaggggtcgttggtctagaaggggagtcttctccagatgagagacagccagcttgccctgtgctcaccatgtgcccagatagtgggggcttagcaggaggaaggtgtgaggaatcccaggcctttggaattccttgagaaagcagtgttgttttgaaggtaaggcaggggattggtgactggaaacttggaggtgagtgagaacctagggatgaacgttcagaagcagggctggaaggaacttaaaagggacatttggattgtttctagcttttgggcaaaatctaggattaaatatgattttttcattgatagaatgctctatcagtgataaaggctcttaatctagaaaacatacacctcatagggggctttacagagtccccaaactccctgaaattatgctcaaaatattttgtgtctaagtggaatgtgcatgtttccaaggttaagcactgcttttttaggaagtaggaggtccgtccgccactgtcagcttgctggtttctgcttaccctcctccccacttcgttcttgagggggtggtttgctggtctttggcagggccgccactctgggtcagcacatctgagtcacacatgttcctccccagccctattggaggctttgttaaagtcatctgcccctacccaggtcccacctgccacaggtgagctagggttttatgacagccgtggctgcagtgagtctcctcgacctctcgccagctgttacccagcaaagcaccttggggagggtggggctgcccacttccggggagggggggagggggaggggagaaggaagttgatctaaacccgcctctttctctgtctcccttcctgccctattcccctcctgccccttccctcccaccttgcttctggtgtgctgtcctggaattgcacgcgcttcctgaccaccaggctctggcccttgagaagccagcggggctttgtccctgttgctctccttgccaaacccagtctctctgctagtggtggtttcggttgcgacaccgtccaggttcccaggcaggaaccgctcggcctggctgcttagctacttttcactgaggaggtggtggaaggtgtcgcctgctctggctgagtaagggtggctggctgagccggcagcccccgccctaggcctggctcttcccggcctctgtactttgccctcgctgcctgacaggttctgctgtgggctctgctgaatggaagtcgctggtagtccttttccctttctccagtcgggtatgttgtccccctttttactctaggattgcctcctcctctttctttcctctcatctcaaacataggatctttagagagttgctaaggggcgccctgcctgagtccagcatagtaatattcatgggaagggtgtccagatgtggaagaggcattgactaggaaaggaagagggggcacataccagaagggtctcccctgagaacaagcagcttgacaagtgggcgaggaggggctggtgggaggcagaggcctgaggcctcagagaggatgctcccgtgctacagtgagggggagcctaggatctggggccattgcccaggactggtgcccaagggacacttttctcccccaactctatagtgcctggcttactctgcttctggccagggaatatcacccctcctggtttggctccttctcagccctcgggaagccaaaggacacttgaagccagccctgaatgcagagccccaaagcatgagcttctccatgggacaactgttggtaggagcctccagcattagggcaggggccctgcctacctgagtcagcgccaggcctctcggggtggaggctgtcttccgggcaagcctgacaacacacctaggccgagtctgagatcccaggcggaaggggcctgacaggcccagtggatgcaaaactatctttttattttctcctccatgtcctgccttctctcttcctctcagtagcagaccccaaagctgtttcagccctacttctgaatcaggcctgcttagtaactacttggtttgccttttggttccaaataactgccttgcagggtgaccccttattctttctaaaggctacttgagagccatagggtctactcttgacagacctcctccatcctttagggcctgtctagagtatgatataggccagagctttgggagtgcctggtgtgccacgtcttactataagcagggaggatggtggtagaggggagagcgtggcttttgccaggtcctattgagttggcccagcagggcagctaatcctcagcctgccatcctgttggtgagacccagggccaagctgaatggtgcagccagaaccaaaaaagagaaactctctctccatattagccactgcatactcttacctctttatccttcagggaagaagctaggtgaggaagttgcctcacttggggccttggcccaagaagcatttctgttggagactctctcctctcttttccctttttcttttctctgcttccttccagtggcttgcctccttaccctggctcacatccctgctgtgggaaacatcttacagcatagaagaaggggtgcaggggtaagtaagggaaggattgagcacttggagtcctctgagttggatggttcagtcccgaaaagggggttggtgactttggagcaggggatcaaagagcaagcaccagtgcttgttgcttctctggctcctgaacaagcagaacctcctctctttccctgtcctggatacccagcgtgggaccagcccttcacagccaccctgtcttgagttcctgactctcctccttccctcttttgaaggctagaggtgctggtgtcggctagcaacaggttgagggagtgtggcatttcaccaggtctggaggagagcgggcactcaacctggccccttctgcggaaaggcccgtagcatctcttgtcagccttcagctgagctgtagctggcttagcgggctcaacttcgatttggaaggttgttttgacagtgagacttctggattggcagacagtagtatttggggacataatgattgctcttattgaacatcggataaggcattttacatgtgctctttcatctacctgtgtaaagtagggaatgtttattgccactttacagataaggaaattaaagcttgtacgtgggggagccagggcttgaacctgattctgttggactgcagagttcctcgggatcctccctggcacagatgtctggcagtattggccactggtcgttttttgggtagttctcttccccatttgtaatagtctcacctccttcttgacaatgttgatgttacacttgttttattttggggctttttgtgtttgtttgtgtgtgtgtgtgtgttttcctttttgtgaatgggggtctcactgtattgcctttttaaatatattcttttttttttttcctttttgtgaacagcaggtcttgaactcttgggctcaagctatcctcctgcctctgcctccctaagtgctgcctgtaaaggcatgagccactgtgcctggcttgatgatgttgatgataataataaagttaatatgtgctgagtaggtgacagatttaggatttgaaacctggcagcttatctccgacatctacagtcttaaccagaaaggaagagaatgaatggtacaatcttgcttgtggttgttaagctccttgaggcccacttgtgcagcagggccaggcagggaatgctgacctgctgtgccacacagaccagcccctcggttcaccaagagggatgggcagagcagagctcaggatgggcatgggatgcccagatttggtctcagttggcaaaaggcccaagtctgcaggtagatgctaaatccctggtctggattttgagaacttagagaccgtcacacttcctgctgccttgggcttatatcctcggagaaacagggagtgacaacaaacttagaaggtgaactagaggttgccaaggaaactttcccacccatcttcctctcgtaggagttggggcagaaggaaggttttttcctgttcattgcccgttaggcagatgggtagggttggaggcagtctagcagcactgaaagggaggatggggctgagaaaaaggtagcctgaggagaccaggctttcagtaccctgctggacagggctagggtacccttcaggaggctggcccaatcaggtgccagcagggcctagaaatgcccttctctccaaggggtgtgaaccctagagttcctttggaagggaaaaaagcaggtatttaaaaatccacttgtcttgcagacactgtttgaggaccaaccaggcttaggtgagctacagggtgcgtggagaacagagcaccagagagctctgtgggctggaatgagcagacaataagagctggggggcttcatggagatgcaaaggttgatgaggaagagagaaggaagttaaaagggcctcttctgggatgtgaggagcctcccccttcaaacatctaccaaatgcatgggatcttcctcctccaaggtccaaccccatgtgtttctgggatctggtcaaacagctcaccaaaagacagcctgcagctaccatgcaaaggccctacgtgggcacagtgaagaaggggaaatgtcagaatcaggatactgtacttaacttgctgctgtcgtttctgcctgaaaagcatctggttgagctagcaagcttcttgtctaggaatgctggacagttccttgggtagtagcaagtcattctttttttctctgtggtttttgagtgcttcacgtacagccagcaggggccatgaaaggaagaactttcactcacactcctctggtcaccctgctgccctccagactgtttccttgaagtttccaaggcagctctggatggttctgggatgaggctctggcctcatatgctttgttgcagtatgctggagcgatcgctccagatgttctttgtgagatgtaaaccagggcgctaatcaggagttagaccagactctgcattttttttttttttttttgagacagggtctcgctctatcacccaggctggagtacaatggcatgatcatggctcactgcagcctcgaactcctcctgggttcaagcgatcctcccgcctcatcctccagagcagctgggactataggtgcatgccaccacacccagttgatttcttaatttttttttttttttttttttgagacggagtttcactcttgttgcccaggctggagtgcagtggtgcgatctcagctcactgtaacctcctcctcctgggttcaagcaattctcctgcctcagcctccctagtagctgggattacaggcacctgtaatccaccatgcccagctaattttttgtatttttagtagagacaaggttttactatgttggccaggctggtctcgaactcctgacctcaagcaatccacctgcctcaacctcccaagatttcttaatttcttaattttttgtagagacagagtctccctatgttgcccaggctcgtctcaagctcctggcctcaagtgatcctcctgcctcagcctcctaaagtgctgggatttaggcatgagctaccttgcctggcctagactctgaacagttttagtgagataccataagtttatccaagtttcttctgtgttgtagcatatattcttttttactgccaaccaatattccccggtaaggatatgctacgtttgtctatccgttcatccagctgatgggcatttgaattgtttccactttttgactattatggattatggtgctgtgaaccttggttacaggttttttgtggatttctgttttcatttctcttttgtatatactgaggagcggaattgctggctcatatagtctgtgtttagcactttgaggaatgtacacgtcttcacatagatgtatgttttttgtctagaccataccctttttgtacaggttgaacatccgtaatccaaaagccaaaatgctccaaaatctaaactttttgagtgccagcatgatgccacaagtggaaaattctacacgtaaccccatatgacaggttataagcaaaattcaatcactttatttcatgcacaaaattattttaaaatgtcatgaaattaccttcaggccatgtatataatgtacacatgaaaaataaatgtttagacttgggtcccatccctgagatatctgattatgtatatgcaaatattccaaaatccaaaacaatttaaaatctgccacgtttctggtcctaagcattttggataaaggatattcaacccgtattatgtttatatgcctcttcagtgctggtagttgtagcttctgcttcctcatcccctcatttgagccgggtggcagagcagggcagactgctgccttgctcagacctaatcgttcagttctttcattgtacaagtattcattgagcagcaaacataagccagtctctctaagtgctgggatgtatcagtgaataaagaatatatgcctgctttcatgtgcttccatttttactgggggagatggcaaataaatgtaaagtgataaataacaaaggttcagtggggcattcgtagttcagcggcagaaatttcgtctcctacgcgggagactcgggttcgacttcggccatgcagtccttccatgcaggaagggctactacgtttctacccaacaaagttattatggctgggcgcagtggctcacgcctgtaattccagcactttgggaggccaaggcgggcggatcacctgagatcaggagtttgagaccagcctgaccaacatggagaaaccctatctctattgaaaatacaaaattagccaggcgtggtggcgcatgactgtaatcccagctactcgggaggctgaggtgggagaattgcttgaacccgggaggtggaggttgcggtgagctgagatcgcaccattgcactccagcctgggcaacaagagtaaagctctgtctcaaaaaaataaataaataaaaaataaaggttcatgtaagttttgggtggcgatgagggcgttgaagcagttatgaccatgtagctaccatgactttgagatgcagtcttctcgcagtgtgcacaggcagcatggagggaggcagggtaccggctctccctcctgaaccagacgagctgttgtgttgccaatggaggttcagggagccagtgatgggacagctctgctcctgagctttgccacccacaggacctgggcactggaccttatgatgtgcttctctggagtgaagactggctgtcacctcagccccctctcctttcttctgctgccatatcattcttcacatgcctaccagccccctggaatctgcccctgcaccctcatcccttatatattttgcagagagcgtttagaggactggaagtgtggcatgtaatggtatctctgtttccaccccgcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtgagcactgggactggggacatggcagcacctcccagccctgttgacactccagcaggtggtgatgggactactactgcagccaacctcttgtttatccggcagaaatgagatctgagatataggggtgcaaaaagctgtgggatgaaaaggagtaagaaatataaaggaggaagtagattggaatcctgggtttcgctggtcagagaagtgatttggggcctttttgtctcatcctcaggtagctgtgaagatcattgacaagactcaactgaactcctccagcctccagaaagtaagcacatggcacctcctgtcccttttttttttttttttttttttttttttgagtcagagcctcactcttgtcgcccaggctggagtgcaatggtgtgatctcggctcactgcaacctccgccttttggtttcaagcgattctcccgcctcagcctcccgagtagctgggattataggcacccgccaccacacctggctaagttttgtatttttagtagagatggggtttcaccatggtagccaggctggtctcgaactcctgacctcaagtgatccgctcgcctcggcctcccaaagtgctaggattataggcgtgaaccactgcccccagcccacctgtccctttctaaatctctcttctggggtcaatgatctactgaccccatttagaccttctcttgaattcctagtttaaattttctggccatttcgctcaccgtcccccaaccattccctcccatggctctgctaccttcggggctttggttggatcatctgtggtgactcctcctgagtgggcttcctggccataggcactggctcttgtgaagtctttctgttcattcccagccacttggcctacctgtctgacctacttcctgcatcttgttatcttctggcttgtggccagccctatgcaaaaacacatgtttgtagccactactagaaacacgtgcagctacttcaagatctggaatgatacaggggagtggctttagaaatacaagaataagaggaagcagggaacctgccggtgggttctgtgccagctaccttttagagaatgagctccagctcaaattttctgaacaaaacctagttctgttcatcttgtggcaaatcagatattttctccataagcatattgtggcagttgagttaggagaaggcatgattcgtgctaacagagtcagatagtgatactgggaaccttaggagtaagggctgaggattgttgttgagggcgatgctcatggaattagagtggatgagttgttctccggacatgcaaatagccagaaccaaggtgtttcctatttattgttacccctgggatcccttcaagggttcttcagttcagtagaaacattgttgtcatcatcagggtgtctctgcttgaagctttccaggaggaagggaaaaagggctgcttatgacatcctggctccagccccacagaagaagtcagcgtggggtaggccatttggccttgggagcagtctagcctgccatcgtaataatcgccagtccaccaagccatcttattcctgaccttgtttttctccctaattcttcttggttttctccctaattcttcctgactctctggaaggcaccaacaccagacaaatagagccattttcaaaaccttttgagactctttgttactaaagccagtctgattctggccaaaaatgtgatctcagcaatgatccctgaaaaatgaacattgaagaagctagccccctcaggggtctagacaagcccagaaaaccccaagttctcccagaagaatgtcacttccatgccaggtgagcagcctcaggggaagaagccctggcagctgcctctggccctatttcagagctgctccccattactgccccagagggtggtatccaggctttttgcctctccatccaaaatatctgttggaccagggaaaaaagtaagaaaaacctaggccctaataaagggtaaggtcagcattgggttcctgaggattggaaagcctttttcttcttttcctttctagcttaggaaagctctggggcatcattaaaggggaaacaaatgtattcactttattccataaaccatatcttgaattagggcttcccctacccccaacaaaaacaacaacaaaaactagttctgttctttgtgcaagtgatgaggcctgaaattacaaaaagccccacctccagttctctggcccccgcagaggggaaggagttcatttctgtcatctttctttatggaaatacatggtttggagcccctggttttgtttcacaaagagagcgtgagtgtgtggaggtggatttgattaaaattggcatcagctatatataggagtggcttcttctgtcaccaccctagaggcccaggaaggaaaggcctatcccctagaacagagccctctgactactgtaaatcagaaaatgatggggtccccctctggtgctctaccacccctttacacagaccaagctggggtgtgtactgtcactgaaccaaggcagcagctcggattctgaatattcacgcacacgggctcacactccctccagtagaggcacccagccaaaacctgcctgctgttttggggctggatttggtagacgcagcagagggcatggctggctcatcctgatgccatcccgggtagcacgtccccacagccagccctcctccagcttccccaacttcccagccacagggaaggccgtgcatgagctagacaaccaccctattttcttttccctgcccggttttggttttttgggaaaaacaaatcctggcagggactgtttggagagacctgatgggagcaagttgggcaggcatgacccctggtattttatcttccagctattccgcgaagtaagaataatgaaggttttgaatcatcccaacataggtgagcacaagttgttatttctttcttcttccccaacagcaaggcactgctttccagcatgtcatcttctccccgaggtgcactgccttctggagtctgcagtcttcaaggatacccctggggaagctcagctcaaaatccatctccccttctggcacactgggctgtctttagcagtttggctggcatgagaggaacttgttcttgggagtgggggatcatgaaaggaggggagactttcgttcctaggatgctcctggacatgttggagagcagtatgtggcccctgttgcttcttgacttaaggcttggccttttctcttgtagttaaattatttgaagtgattgagactgagaaaacgctctaccttgtcatggagtacgctagtggcggtaggtgtggaactgcctcttcctgttgtgcccccacttcttccacctccagccagctctgactgagatccctgcctggtctcttacaggagaggtatttgattacctagtggctcatggcaggatgaaagaaaaagaggctcgagccaaattccgccaggtaggtgtgactccctccataggagctaggcctgacctctgcttttggggtttgacatgtaaggataagctgcctgtctgtaagtggcccttggagggtactttgggctctgcttatccgtgtggcaggttagcactaagtcacagggtcactgctctgtcagcccctgtggcccaccctcaggcacccctgggttaacccttcttccttcctttcagatagtgtctgctgtgcagtactgtcaccagaagtttattgtccatagagacttaaaggtaaggcatgcacttctccttgtgcctttgagtgggagccaggttgttgcctcttggttctccatgataaaaccatcaataaccatcaggccctgagtgttccaggaaactccagcctttctttttttctttctttctttctttttttttttttgagatgaccagaaagcccctagggctgcctctgatagaggccttgtggctggacctcgggttccattctagcccttgagcaggggccctctgccatttcacctcttggcacatcaccttttagtgctgccaagcaaggcaggcacactccaggctttctcagtctttcaggcaacctggtagctgacccagggaagagtgctgaaagttccacagctgtatcccagctgctttgcaggcaggcacacacataccatctccatcaccaagatactcaagtttgaggacacctgtgggtctcttggctgctgagtcctcacagacatgatttgattaacctgggcctgatgctgaagctttgcacagctcacagggtctctgggccttcagatcccatctctcccatggctgcccacgtgaggagtggcctgcattgccttcctcctgcccagcctattcacgctgattgaagccctgccctgaaattggtggagaaagttctgagactgaagatgactttccgtttgttctcccattcccctcagctccttcctgcccagggccttagtctggtccacttggttccctgatgttttccatcttacctcccaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggtggagtgaagtgcaagctttttattgcttctcatttcctctcggcctctggtcttagccctgacctcctgcctttgccacctgtctacatttgtcccaagccaaagcttcagagaagggcttgctgaggtagcagcagtcaaaggccttctgcacctgggaatgaataacctcagttcctttctcgaaagatgggataaactgtgtgtgtgttcatcccccaaggcactccggattgcaggcctcggactggtcaagttagagggtacgagggtatttgacttcacttgcctctctggtgaggtgtcttgtccccaggctgtctgccttcttccatatttcatttatgtctgctttgccaggcttaagctctcaggatcttggatattaggtttcttcctttggccttggggtgatttcaattttctaaccctggatcctcctgcaggagctgcgggaacgggtactgaggggaaaataccgtattccattctacatgtccacggactgtgaaaacctgcttaagaaatttctcattcttaatcccagcaagagaggcactttagaggtgagcagtggagcccaactggcggaagggcctggggtccccacagaaactttccagctgagtttcttccccctgcccttttccttctctgtgctccccagcaaatcatgaaagatcgatggatgaatgtgggtcacgaagatgatgaactaaagccttacgtggagccactccctgactacaaggacccccggcggacaggtgaggctgtgccgggctgtgaggttaagcttgcctaggagttgaggccagtcttaactgtatgtccccctgtgcagagctgatggtgtccatgggttatacacgggaagagatccaggactcgctggtgggccagagatacaacgaggtgatggccacctatctgctcctgggctacaagagctccgaggtgtgtgctccccgccccattctctgacctggccagcctcactgtctgtagcacctatgcttctaacacctgttgagggcagaagctcatctctgagtaggtgtgctctctgctcaccaattttaagcctcagctttggtgtctaaggtcctctggcccattcactgatctccatgagtgaattaatagaaagctggtagggtcggtgtgggactgggtcagagtttcaatacgggtgagttgatctaggttagtctgcattgattagatgtgtctaggtcatcggctagcactactacattgatctagatatctttgtgtctctttttgtatctggaagtgtacatttctgggtgtgtgtgtgtgtctctgtgtgtgtctgatcggaagtttgagtctgttgcttttttttttttttttttttttgagacggaatttcgctcttgttgcccaggctggagtgcaatggcaggatcttggctcactgcaacctccgcctcccgggttcaagcgattctcctgcctcagcctcccaagtagctgggattacaggcatgtgccaccatacccggctattgagtctgttgcttctgtctagtgctttatgtttgggtgtgtgtatctgtgtgtgtgtgtgtgtgtgtgtgtgtgtgtatgtgtccgtcttcccgtctgtggatctggagactttgtgattgttcttctgcccatttgggttttgttcatcatctgagtatccccacatgaactcccagcctccctgccctgctctccctctggtggtgggatccttaagaggcacctggtgacacttggtataggcccatattgctctgtgttgaggggagtggacttgagtctggacatgtgttcttgcggatgtttgtgtctctgggtgtgtgggcttatgtattcctttctgagactgtgtttgtcagtgtctgtgtcagagcatgtgtgtctccagggtctcctccaggggggatgtattggtcttacaagtggatgtccggtatgatcctggggtgtttgagtgttgggagagggcggtatgtgtaaatgtgtccatccatagggatctccacatgacttctgccctcccttgaagctgttttctgtttctttcagctggaaggcgacaccatcaccctgaaaccccggccttcagctgatctgaccaatagcagcgccccatccccatcccacaaggtacagcgcagcgtgtcggccaatcccaagcagcggcgcttcagcgaccagggtaaatgcttttgggagttgtaggtggggactcacccctctccagagaggttacaggttctgtggggacttgggtaacacaactaagtttcagtcctggttcagccacttattagtagtgtggctatgggcaagccacttcccttccctcgcctctgtggaatgggggcttgctgggttgttggccagccctgtaggaaatgagcatgcgtggggctggcactcagtggaccccttggccttacccattcccatcctccctctggcccagcagctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacggtgagccgcaccccccgctctctccttccttcctgcggtggggcctgccctctccaggcagctcttctcttaattcagactctgttccctttggctactacttctgcttatagcaggaagcctcgctcccagcagtaaatgcagaatcctttccttaacctaccactgtctgcttcaggtggaagggacaggaagcctgttccatgaacctggggggagaacctggctgtagaccactttggctttctgatagaacgcttgccctttattccccacagaacagcgtcctctccaccagcacaaatcgaagcaggaattccccacttttggagcgggccagcctcggccaggcctccatccagaatggcaaagacaggtgagagacccgggccctgcctgcctcactccctaggagccatgtctcacagggtgatgtctgtcagcagcaccgtctcctgtccctgccagcgcattgctccctgctccctggagttccatcctggctgtgtccagtccagctttcccctcccctattccacgccattgcctcctccccatcttcctctgactgctacttgcagtttgccaagtgtggggctgaccgtggccatctcagctacatgctcgcttcttgaccacggccagggcatggcagctgccctcctctagacatgagcagctaaggccttgtgttgggggtcccagctcagggcagaaccaagagatgcccaccttgaggggtgtacacatagagggcgactccagccatccccatgagaccagagctccccagccttcaccggccgcatttcttggtgttgcattcctggctctatctcttctgagtttatgaaagtttcccctcagcaacaccccactctttctgtagaagaaactctcctgttcttaaaattcttaggaggccagtgcagcctggaggcagcggccccttgtctgctctccttcatttctgattcctcttcccaggcactgacccacctcgctgcttcccgacctcactcacctccacttctcagccccgcattcctcagttctgacttgcatcccgctgctgcccaggcctgacttctaccctgccagagctccccagctctggcccttcccctgcccttgcttcctaatccaggcctcccgccctcactcacccctaacacgggcctctccgctgcttttgtttcctagcctaaccatgccagggtcccgggcctccacggcttctgcttctgccgcagtctctgcggcccggccccgccagcaccagaaatccatgtcggcctccgtgcaccccaacaaggcctctgggctgccccccacggagagtaactgtgaggtgccgcggcccaggcaagtgtgctggggcagctggtgcacctgctgccctcagcccaccctacccccttgccccaacaatttcttcttcccacttgggggtcctgctgtgttcttgtcatcttagccacaagaaatgggtctgtcccctgcggccaggaagtggagggaacaaaaaagagcattaatgcccctcttttccagttctccctctcagaacaggtatgcaggaagctgtcctaaggctccaaagggaaacctttttgttctgaaccttccagggtttccttagggaccccggggatagtcggcatcacagggactcaatcctcaagggttggtccccattgccgccttgagggtccagtctgcccggctcccagggagcccgctgtctccagcctaaaccacactccacacaggggtccttccttgcctccctccctcccttcccaaaccatctccttccacttccacgagacttccttctcaccactgtcctcagtagtcacacccttccttctgtgtcctcgtgatggctgcctctgccctagcatccccctccctgtccccaccacagggtgtccaggtgcccagtgatggctgtcctgtaccctaattcgtccccctcaaccccacttctcttcccacagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggtaagcaaggagctttgggtggcagagaggctcaggccaggccttcctgctttactcggggtgggttgggggttgggggttggggtttgggacactctgtaccggtattgggtcctggggttagaagaggcttcaggaagcacaagaaattaggtctttgtcaacaccttatgtgcccaggcccacccctcttaggcctctccccaactcctcacaggcacccctcattctctggccccaagcagatggccgatgccgcctcctctctaggagagtgtgaactcagatgctaaaataaaagcccccccttctctcctgggttcccatggaaacttatatttggtgacgcagctgcaaagtcatgaggcatgagccaggctggggccagcaaggaaaattttgtcctggtctcttgcccctttgactgcctctcccactagttggttctgtttctggctgcaggcgcagccatgcccttctgcccgggggttttagggtgaaacctataaatgaaatcactggcgagggcctacagtggcctcttccctaacctaactccgatgtgccaaaggtttcctgtgttggacccagggtggggatctcttcacggggtttctcacacctgagcccccagccaccacagaggtgcagcttgaagtgcatccagccaactggctggcctcctgggatgctccgcatccccatcctgccattcctctccctgccttggagtagcagctcaggaagcagcaggggctttgagagaacaggctcgcctgcccttcctctacgtttcactccactctgctggaggagccaaagccactgccccatccgagccccagaatgcaagtgtgaggcctgcagagagtgtgggcaggtctgaaagcctgggactctagtctcgctgagcggctcttccgaaaatgggatgacccttgaacctgtaaagccacctcccccacctgcttatccacataccgtcttgttggttttttttttatttctttttttattttgtcttttttttgtttgtttttttagaaatctgtctttcaggtttgccagaaggtaggcgttgagcccgctgtgtgtgtgtgtgtgtgtgtgtgtctgtgtcctgtgtcctgcctccatcactaactccccttttctggctcttactctcctccatctgcttaaccaagtctgtgtggccctcctctctctgccatcttaaagggatgaagactgcctctgattgggcatcagcacaaggcctgccctccgtgcccccagtacaaacaggcagggctaagaggccacattggcccactcagggcaaatggctttaaaaatgagggccttccttgggcccacagttaacgcctgtcctcaagtaaggggagactgtctcagggaagcctccctttaagattgtctcctctcacccaccccaccccacccccactccctctcaccccaggttttggtcacaagtgttgggatcctttcctgccctttcccttgtcatgtgcatgcgctatgaggaagctccagggttacaagtgcatctgggatggtatcttgtttgttgtctcctgggtttcctgaacttcagagctatgtgacctcttccccgtggcctatgggatcgcaggactttggagacactacggggaccctggggccccaaggtttcagtctggctcccccagaccttaggagcttttgtctcacaaatggagcacagcaccccctcctggcagctcctgcagaactagccccacccacccgcacccctgccccagcacccctgccaccagcagcatctggataaatcaagcctcttctcctctaggctgttttctccagatatggcctgtctcttccaaagtgcggggagctgggacattctagggcaacggccattctaccccaagccgtagcaaaacaacaggagatctctgcacccttactcaggggtctcccttcacagtccccttcctggctctttcacccctggccttatgctcatcctctctgcaggcctcggggaccaaataccaagctgaagaccaagggccaggttaagagtgcttgttccccaaggctgtctgctcaggccctgcattgggactgggatgcctggcaggcacattggtgccacagctgatggaggaacgtccagacagggtcttcaggctttccctatcccctcctcctcccacccagctgttgactgcatgactggctgctgcctcaaggggccccagcagggggctgccccacagggggtctggagagagcagggagggtgccttcctcgcacagccgggctccctgctcgcagtgcgcttgtgtgcacccctgtgttggttgtgtcttcctgtttatttctatgtgctgctgctcttcctccttcctctcatatccttcctcctctgcaatccccagtttcctagctccagacacccatcttccagccaggagctggagaagccgctcagcggggccagacctcttccccacccacccaaccaaggtgtctgccctgccctgccccaccccaccctcatcctccctgcgtatgagcagatggcctggcaggccagcaggtaggggagttgggaaaggtcggaggaggccgccttttccactcagcagcaggaagccatccccaggtgcctaccatgcagacccaggccttggcactttgagtctcctgacaggcccttgcgtagccacggcccctcctcctacagagattcaaagcattgcagcccctttcctccaaaaggactgcagtcctgagaccctagcgtgtggctccaaaaacgcactcacacctgcaacccccagaacagcgcgtgagccctggctgtgggggagcagcctcgtgccgggccgtgtgctcagtgtgctcagtgaagtgcgtgcacagccactccccctcctcccccagagcagaggctccttctccccggcacagatctgggaatgtggggagggacaagccccatgtgctgggctccctgctggaaaggaatggttgagccgccagtgtgaggtgctgcagagccctgttggcttgccaggtgatgggcagagggccctgggcttgggtcctgcccacccactggtggcacctccccagacccactctcatctgggtctgtggcggcggaaggagcgagagatcccagcactaaactctccctcgctctgttttttgaggaacctgaatgaacctgaaagcaaagaccgagtggagacgctcaggtgagagggctggagccagcactggccctgcccgggccaccgggcttgccacagcctcctgctcctctcttccttctgccacttggctcttcctcccgtggttctgccctgtccctaccctctggggcctccctttcctcagagagtttccccttcccaaacccaattgcaggagttacgggcccttctcctcaggtctggtatattctggaagtcggagttctgggtcgggtggttggggctacagattcctacccctggactatcccacctccctgtgctcggaggcttctttctggagagagagtctgtgctcgtgctgttgagggcactggtgtcttccctgaccccaccccgcctaccccaaggctggcttctcctccccttcgctgtcctgagagatgggggttggaggactgccaccctccgcccccgcaggccaggggccacgcctggctgctcctgctccctcccgctctcctctctgggctcaggggctgtctgccagggtggctctcctggggtggggtgcctcagcccccccgtgacgcccgcctctgccctctccacagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagcaccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttattttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctgagctgcctcctcctgtttcttctcccagccaggcagggacccagtctcctgtgggcaagatgtggcctagcccacctgccttgcaggagagacttgattcctgtctggggccagtgctgggtgggcccagctccccacttacccacagggcacagacaggaagcaaagcccagggcccttgcaccaaaagggaaagaaaactcagtaagcttagattttattttttttaatttttaaaaaatgttgaaaaataaatccatgtctgcataagttcccaacccccatttctccaagtttctggaaggtgggcttggtgggcaccctcagctccttagcatttcccagctggcccctgaagacagagcttctcttccagcctctgctgctgtaaggcccctctgcccacctccccccctgcagcctccctccccacctcaccccagacttattgctaaaagaagggaaagaggaatgagaacagccagcacacccaactgccctctccccactccacgctaaggtcactaccccggacacacaaagggcaggacccagaggccaagccccagcagactaggacacagccattccagtaccggccaggaagcgaaagtgccctcaggccagctcaaaggcccctgagcccggccatggccccaggagacaggcccagctgccaggaacacatgcagaacccaaagggcggggctgggctgtccgaaactctggtcttacaaagaccccgccagagccctagtcccttctgtcctcagtgacaccagagatgcctggggatggccagcaaaggggtcctggagcccgtggttggtggaggacgtcagggctcagagtgagggtgctgggggctccagaggggttccaatcagggtgggtgggggctgagggccagggcgggcgctgtggcggggggcagccagagcggggcggatgagaggcggtgggggctggttgggggccagccggggctggaggaagcggccctgctgcagtgggggtggctgtcggagcagagtgggagccgtgggcaaaggtggcctcagcagcgggggtggctgggacagcgaggtgggaggtggagggggtggtggcgcagggggcactgatcggggcacggacgtggagaccgatgtaatctggacctgaggggagaggaaagagtgagaagccaggctcttcccgccctcagcccagtctaaggaccaaggcggcgcctcacctcgcctcgcctctcctctctgaggggtttctctcacccccttctcacctcatcatcttcctctagggctggggctggcaatggagcccctctcctagcctcctccatggggactggggctccaggggccccatcctgctcagcctcccattcctgcagcacctcctccagattgaagcggcgccggtagctcacaaagaaagtcttcacctgggtcagagtcttgttcccaatcacctctgcaatagccccaaagtctttgccatacctacggatggctgcaagggtcaaaagggcagcagcgtcaataccccttcgaactagttacttccctgacccttcccctctgcccccccactccttggagggtggggagatagattcctggggtcctctcttctcaccacagtttaacccaccttgaacagccaaaagctgctcatctgtggtccagcgggagttgaacttggtgttggcctggaaagcaaggaacaacatatcctttagactcaaaaccatgcaaatggaagccctgctccccaagcagtactctttctgctctgcctccagagagaaacccccctttgcaccctaacttaaagagcagccatacctccggggggcgtagtggatcaataccgccctccagggcttggcgcaggctgctgttcgtctgcttcatgctctgtacctgggaaggccaggaagtggaggaatatcagactcccatctcaggcaggccactatgcccctcacaggaccctacttctgcacagacaccagcaccactgccccggcaaagctttctgccatccaccatctggcttgttcctcctaaacaactactcagtaggggagccgctggggttctcccctttctgcagaccagtttatatttttattttttatatatatatatatatatatatttttttttttttttttttgagaaggagttttattcttgttacccaggttggagtgcaatggcgcaatctcagctcaccaaaacctctgcctcccgggttcaagcgattctcctgcctcagcctcctgagtagctgggattacaagcgcctgctaccacacctggctaattttgtatttttttttagtagagacagggtttctccatgttggtcaggctggtctcgaactcccgacctcaggtgatccacccacctcagcctcccaaagtgctgggattacaggtatgagccaccgtgctcggcctatttttttttgagacggaatctcactctgtcgcccaggctggagtgcagtggtgcaatctcagctcactgcaacctccgcctcccaagttcaagagactctcctgtctcagcctcccgagtagctgggattacaggtgtgtgccaccacgcccagctaatttttgtatttttagtagagacaggtttcactatgttggccaggatggtcttgaactgtgtacctcaggtgatccgccggcctcagtcccccggaatgcctggattacaggcgtgagccagcgcacccagcctgcagaccagtttttaagagaaggcccaaaaagaacaccacattactcagagtcccagaggatggggctcggcccctgaaccatctcgcttacacctcagctccccctagacttcagttcccaggtgccgaatgccacctttgcatagcccgttcatttcccagggccccacctggcgcttgagggagatgagctgagagtcaagacctcggagcgtgaggttggcaaggtccgggcttcctgacactgccgtgaggccttcagggctcaggtacatgcccttgggtgggcgacgccgggttcgcaagggatggtggcggtactgagacacctggacctcctttttcccagggcctgggcgtgcattcaggggccgagagggtagaggctgccagtgaaaggagaggcaggtaggtggtgcagagccagagagaggcaagaggacaggcaggcagggcccagaggctctgggagctcacctctctcttgggatctgcaggatcgggctctccctcactcacgcctcctcgaccctcttcgagctcatcactgctgacacaggggccagggagggaatgaggcagctgccaggagctctacctacccccatgcccagtgcttgctcctgcccccacctgtcttctttgtccttgcggccccccagccgccgggcctgtctgtccatcacactagttcggctgcgggtcttcttccaagagtagtagtatttcaccaggctgggaatcaacttgtcaggcagctggaggaggcaacgccagaagctggggaccactcaagactctgggccccaggtaagctcttcagaaaggaggggcagaggagcgccggggagtgggggtggaagggctttaccatctgctggatccgctggaagcatttgccatggaagccaaaggcctgttcaaacagcaccttgtcctctactgtccactcgtcagggaatggggtgaagttggccaggtcggccagcgacttctccacatcgtgcttatgccacagaagcatgcccagcgcctggcccggggcaaggggcagctgagcctgagctgccccggcaccgttccaccccattcccaagtccctgggggccaaggctcacctgctcaatgttgtagccatgcttctccttggccatcgcaatgtacttgtcaactgcaggggcagcaggggcagggtcttggtgaagggggttatagctcctaacccaggcctgtccagaaagggaccaccccacaacggccaggtccctgaacacgagccccagggcaagggttggacccacgaacacctcagcttccagcccccttctgagaagagctagcttggagctgggatgaacccaagcccccacctcccagggctgtgccccactcacgcttggcatctgacacacagtggttgggtgaccacaccagcatccccttcagctccttgttgctgtagcgtgcggggctctctgaaaggccgaggagcaggagggaagacactcagatcagcctggtggcacaagcctagacccatggccagagggcagcagaggagtggagccagggaggttgaggcccagaagggaaggaggggcagagacccagacaggaaggcagggcaggaaagcaaaccatgctggggggccacccacccctgccagcctgcccttccaggggagccaatcaagggcgccccaggtggggctgcaggccaagccccgggcctccacccccaccccacttcacagcctgtcctgcggctcaccaggcttgcactccggaattacggcctggtaattggttccaacgcggatcatgctgtctgtggagccagggggaggcagtcaggactccagggagggcgggcgggagggaggatgtggcgggcgggggaggtggccggcctggagttctccttcctgaccacccagggcccccaccttccaggaggctcacttttccctcattgtaccccagttacctgcagccacagaagggactggaagaggaaaagaccctgtccagccatggccattggggctggagggtggacaaggggacagttttagagcccaggccaagcagggtgctttgttccgggggaggggagcggggttggagggcagcccctagacctggaccacagccctgcaaggaacccaaggctccttcccaccacaggagcctcacagctctgtgtggaggtgtctctccagtccctgctccagccagacctcagtcccctgcaaggtggcaaggtatgagggacccactctatgcaagggagggatgcctcggtccctgagggggtgagggcagggcaggggccggcaggacgcctccacagcagctaggggcccaggttccagattggctgtgccggcagcctgggtttgtgggagaagcaacgcagaggctccaatccaggagaggcaggagccatcagtgtaacaggctcgtggtctgcaactcttccccctcccgccccactccgctccccccaggccggcgcgcctttaaccctaggccaccgggctcaccgtgcgagtgctcctcctcgctgctgtcatcctccgagtggggctgtccgccgttgggcaccgtcttggcccggctacgggacaggatcccagagcccgcgctcggcttctccatcactgagggcattaccccgcccagctgccccggggggcgcaggagccttcggagagcgacagtggttgccgcactcgctccgagtgccgagcccggcccggcctggagaggtcgccactgaggttaggagaggcaggaggtcagcgtggctagggtccggcggggtgggagcccacctggtagccccagcgctctccacgacccccacgagccagggcgtcagaaaagtttgtgcagaagtgggggacgcaagggatgagcgcaaggtccggtgcggctggggcgtgattactatgtacgcccctcagggttggggttcccctgaagtcggggccccctgtcctcggggcgccctggaaccccaccgcccacctgcccacgccgttcagcggctgggcgctggagcgcaatctgcgccccccgggctctgcgcctctcagctgcgccggggatgccccagtccccgggcggggacccgtgtcctaagcagacccctgcccgcgacggcagccggccggggcaccggcggcggcggcggcggcgacggcggcgggacggcgcgcacggcgcgcggcgctgggcagagttgccgggaggcgggcggagcgcagccgcgggtgccgcctcgcaccctccccggcgcgctcgctctccccgccgcgctcgggatgccgcttgctcgcccgctctccgccgccgctcgctcctcgcgcacacaatgaagctgctggcagggaagtagtgccggctgcggcctcagcacccctcccccagccgatgcctccgccagctgaacatctggccctggggtgggagggagggcccggggggcggggccagggggccggggccagacctccagggggtgggatcaggaccctggtggggcgcgcgtcccgctgcgggggctcccctcgcgtccctgggctcccagacttgcccctgggggagaccccactgccccccaggagtagccaggggtcagccccacccacgcgcacaccaacaccacacaccagtgggctcgggttactgccgcctgccccgggggccctggggccgcctgcccgcccgcccgggtggagcccagcttttccttccatttcccttcctgccaaggaactccccgcccccccttccgcaggggggaccccccttatgcgcccttgggggccagaacggatgggaggctggacaggcaaggaatgaattcctccaagagctacccagccagaggctggcttctggtggatctgtgggtccccaagggtcgccccaattccctttaactgctgcagtatgcacccctaaacagtggtagcaagggctgagggatggggagtgggaggtgtaggggaaggtctgggctgcaggggagagaggagctgggtctcctccccactgggttcactgtcaccccagctggaagcagcatccccctccccccggacaagcacgggcagagtgacagacagggaagcgggtagagcggcacagacggagatgggggagggggtgggcagagactttcaaagccagacccagccaccctgccaggcacacaaagagccagcgcacacaccggcggcggctccgagcctgcgagctgcgcccgtgcccgtccccgccgcccggggcacgtgctgcagcgcacacaagctgaagcccccgcccgccgcccctcccacccggagccccagtctcctggacacacctccacccaggcacaccccgctgtgcccagactgagccgagcccgcactcgcgccctcctctcccttcccttcctggtccactctgtaatcagattcctaaatttagaagcagcctagggcccagccagggatccctgcccccacccgctgcctgcggccgagtggccggggtgttgcggtcgggccacgacccggctggggccgcttgttcccggggactcctgcggacagccagggaaagccaggctcgaccccacccggctgctgcgccgtcgagccacatggggccacccagccagcggccacgttgcccgccacacctcgggccagggctacggggcctttatcctcctcttaaatcatggattgggcaccaagccccagggtggggaggtctggacaaaggagaatgaatggaccaggggctggtctgagctaaggaggtctgattcaagactgagagtcttcccaggccgacccctcctaagtggcagggcgccatccctgtccccagcacctccaccctttggagagactctcatttctgtcccctcctgcctggcaggcaaccattgctgcacaccagcctctcctacggtgctgtcttccatcttgcccccgccccctattaggcagggcctcagttgagtcccccatcccccttgcctccttcccagactcaaacctgcacccccaggctcagcatcctgcttatttcttgcctccctactccagggctgccccaggtacccccagtctctctagcagggatccccagccactggattccctccggcccagcatccctcttccccgcctcctaagaacctcattctcttcatttctatctagagccaggcactctgggccaaaggaagactctgctctggaggtggggacagggaggggaggtttattccttggggcgggggttgggagagtccctaggccctgatgcaatgaggcttctgcctaggaggtgggccacgacacaggaagtgtgtcctaggagtttgggggcgactgtgggggccacggggtccagagggaaggcgcattcctagtgaagaaccccctcatggaggggcaagggtgcagggttagaagggggaggggcaaggccccacccctcccacctgctacagccgccccctccccagctggccccctcttttgtgcgaagccacacaaaggacaaggggccccggccggcctggccatctgctcccagcagcatgaaggctcttaaagagacagcaccccctccctgccgccccggggctgcggggcggggctgcgccaccggatccgggctccgcggttatcccagatcccacccacctttccctggctccacttgtccccaggtcagaaatcgtcctcccccaggcctggggcacagaggtgccacgtggccaggaacatgggggtgtgggaggggagggaaggagaggcagcccggggaccagcccctcctctcctgcagcctgaggcagcggaaggggccaaggaagctgggcagcgcggccgagaacccggggccctcacctacccgagctacctccgagcttggcgcgagccggagggctcccgggaatgccctccccgccattttcgccgatgagctcgggctcacccttccactggaagcgacagcgccttcttttcgagggctgcaggccaggacgcaggccgcctggaagcaagtgtgatcagggcacatttatttcctacggtgtgccagatgaggaaactgaggtcttgcacagcccctacacaggcctccgccagaagctgcatcccttgcctgggccagaaaaggctcctcacccctccagtccccagggaagccggccctagccaggccgagtcccactcagcgcccttgccacacacacagctcagagacacaagtctatatgatgcctgtggtggtttccttgcctgtctctggctgggctgtgtccccatgagggcaggggctctgtttgctgctgtgctttcggggcctggcatacagtaggcactcagtgtttgctgaatgaataagtgtcggaagccctttgccttcaccgggcttctctgcgctctgcctgctgggtttcttgcttcctccttcctcaaggtgaggccgaggggacaaaggttgaacagggatgctgggagggaaaaggagggtgaccttgggcaagccatccggcctccccttgccgctccctcctcccgcaggcgggggcagctccagccaatcccaagcccgccagccctgccagacagactgggactgtcccgagctccggcccagcgagcctggccgctgtggtgtgttgcctgggaccctggccaggccatcagtggccacagccaaggggctaaacttggggagggagagaggcagcgggagggccccggggttggggagggagtgtggtgggatccgagccaaaacctggctgagcaattagggggctggggggaggtgcttccatcgactgggggcctggcgggaggtgaccctggggaaatggaggaggtgggctagagtggaaggaccatggcagctccctctggggcccccaccctctcagtcctgcccagacaggaattcggttcctccctcccctgccgcccactggggccctgggcaggctgtgtggcccagggtgctgccctccccttttctgggccctgtcagtgaaccccctggcctagccggcactccttcccccaccccacctcaccccccacccagggttgtgaagaagctgaaagaggtgacagaggtggcaatctggcgcttggcaccaccccggcacggtggccgtgcaaggaggcggcagagggaggcaagacaggcacatctgggagtggcccttgggggaggatgcagcagaccaggcgcggggtcagcaaggagactccaggcttcagacacccacgtgggggaaatctgattccctgagcaaatctgacatccctggggaagggtcagcaagacctcgggttgagatgagaggtgacaggagctcccagactccatgagggggagcctgcttggtttctccggaaactgggattgggggtggggggcctccccttgccctcacctggacaacagctgcgccctctggcggtgaccgcatggaccaagggggtcccacctcagtctgggaacaaatgtcctcccagagaggctgagcctggcgccatgttcctggggaagtgcctggatcatggtccccctgggccattggagtcattgagccttaaatccacccccagcaaggcctgccccagaaccacccatcaccctccagtgcagtcaggtggaccagaggtccctagagaagtggcaggagctcagacttaggttgagtcctggctccgcttcttgctagctacgtggccttaggtgaattacttggcttctctgagcctcagtccttcatctctaaaagggcaagatgatcctgacctcattgactgttaggaagatccaaggacatctcacatggaatggagtaacaacatcaatgctggctttcatctgaagccgtgctcccctcttgagcacccccagcagggccccctctgcccatggctcactgctccatgaggcagcccatgcccagtggaccagttcgggccagccccaccttgagctcctgggtctgacctctggagcaagaagctgctccatgacattggacacttcacatcttctcaactatgggttgaacatttcccacaaagtccatgtgttggaaacttaatccctactacaacagtgttgagaggtgggacctttgggcatgaggcagtgccctcaggaatggattaatgccattatctcaagagtgggttagttattgagggagtgggttctagataaaagatgagtttggccccctaatcccaccctgcatgtgagttcctgctgccatgtgaggatgcagcaagaaggtcctcaccagattccagcaccatgctcttggacttcccagcctcccaaactgtgagccaaataaacttttttgtttgtaaactacccagtctcaggtattctgttacagcaacacaaaatggactaagatactccctttagacatgtcagcagttccagataggtatctggaacttcagccttcagtctgacctctctaatcactctaattatacactatacacacataatacaaatattttttttctagaccaactcttgctctgttgcccaggctgaaatgtagtggtatgagctcggctcactgtaacctctgcctcccaggtttaagcgattcttttgcctcagcctcccgagtagtggggattacagacatgcgccaccacgcctggctcatttttgtgtttttggtagagacggggttttgccattttggccaggcgggtctggaactcctgatctcaagcaattcacctgccttggctcccaaagtgttgggattacaagtgtgagccactgcgccaggccactgaatacaaatttttaaatatagcttcgattatatcccattccttctcagccttccacggttccctattgccttccaggaaaaggtctcacagcccagtactcaaggggtttctagcccatgtatgatccagccaaacaggtggctcaccattctctgagcctcacctggtggcccaggatgctccacccaccctgcaaaccctggcctggctcacccatctgcatgccccatgcccagcccttccctcagggctgctgggtgctctgctctgccagggcacatccaggacttctggctgagcagtgagtacccttcctgctctccccacagtccccctccaccactccagccaccatatggctcttagcataggaccttgcctcccacttccagagggaagtgaggccatctgggaggaaccccttcatggcctttgtctgctccttcccctccctgtagcatagatggaccttcccccttcaaggccaacctcactcccaggctttgcatcaccctcagtgccagccccaccacacacacacaccccaatcctgagcaccttgattttcattttcctctccttactcatgtttgtcttcccccctcatcacatgaacctgcttaagtccattcatcctaaacacacacacacccctgcacctcccgtaccccactcccaaccctcccttcatcccatgttcaccttagttgcccctttcagctagcagtattgctgccttaaaaaaaaaaagtgcttcttaaagagatgttcacacccctccatccctgtcctcacctcccactcactccccaactccactactccacagaaaccgttcctccaaggtcaccagtgactttgttatctctaaacccaaaggacatttagcgggtatgttctcacttcatctctgggcaggactggacagacagggccacctctagctccaggatgtgagctcctccctggctcccttcctggctggacttcaaaccctttatgtgggtcctttgggctccatccactccctcaattcccctggctgagatatatcaaaccgtgggctgtggatagccccctccttccccagcccagacccctgaccccaggctgtgaaccctatatcctaccaattgccttctggactcagcatcacttgctgtcccccaggcctgtccaaaaccatctctgaatcttcaccaatcttcaccaccatgtgcccagcctgccccttccctatccctcttccttttattttatttattcattgaggcggagtttcactcttgttgcccaggctggagtgcaatggcacgatcttggctcaccacaacctccgcctcctgggttcaagcgattctcctgcctcagcctcccgagtagctggaattacaggcatgtgctaccacgcccggctaattttgtatttttagtagagacagggtttctccatgttagtcaggctggtctcaaactcccaacctctggtgatgtgcccacctcagcctcccaaagtcctgggataacaggcgtgagccaccatgcccggtctattttattttattttttgagaaggagtctcactctgttgcccaggctggagtctggtggcatgatcttggctcactgcaatctccacctcccaggttaaagcaattctcctgcctcagtctcctgagtagctgggattacaggcatgcaccaccatacctgacaatttttttgtatttttagtagagacggggtttcaccatgctggccaggctggtctcgtaatcctgacctgaagtgatctgcctacctaggcttcccaaatttctgggattacagaccctttatgtctctccccattgggatccaaagtagaaacctgggagtggccctccactcttccctctcctttacttcctgatctatcagtctccaactcttgtgaagtcccttctcccactgcccctcctggccttcatcctattcctgaaagagtccccccactggactctctgcctcctctcttgacttcctctaatctgttctttattcgacagccagggtgatctttcttttttattttttgagatacagtctccctataaggcccatgctggtcttggactcctggactgaagctgccctcctgtctcagcctcctgagtcaccgtgattacaggcacatgctaccatgcccagccaaggtgattttttttttttgagatggagtttcgctcttgttgcccaggctggagtgcaatggcgcgatcttggctcactgcaacctccacctcctgggttcaagcgattctcctgcctcagcctcccgagtagctgggattacaggtgcctgccaccacgcccagctaatttttttgtatttttagtacagccggggtttcaccgtgttggccaggctggtcccaaactcctgacctcaggcgatccacctgcctcagcctcccaaactgctgggattacaggtgtgagccactgcgcccagcctccagggtgatctttctaaaacccaatctgatcaagtcaatcctctgcttctcattatccttggattaagatcaagctccttagcatgacttatctccttcaaaatctggtcccctgacatccatccccattccccttttttgtttggggatccatgtggtgctatggcgttgatcccatgccaatgccagcctttcccaaggccctggataccatgaatgcttcagaaatgaactagaaaccaaagctggtccaatcagcatgttgtaaatgtaagacaaaagaccaggaagctgagcacaggagtgttggctgccatctttgatcttcggggaaagccaacactatggagaataccacgaggagatggaaaaagccacccaaggccaggtgcagtggctcacactgtaatccaagaactttgggaggcagaggtgggtgaatcgcttgaaactaggagttcgtgaccaccttgggcaacatgacaagacccctgcctctacaaaaaaaaaaaaattagccaggtgtggtggcacgtgcctgtggtcccagctactagggaggctgaggtgggaggatcgcttgaacccagaagccatgagtgtgccactgcactccagcctgggcgacagggtgagaccctgtctcaaaaaaaaaaaaaagatgggagtctgaggcatgagaatcacctgaacccggaggtggaggagaaaaagtcacccaaccaacctcacttgaagtcactgaacctctggaccttttatttttatttttgagatgcacttttgctcttgtcgcccaggctggagtgcaatggcccaatcttggctcactgcaacctccacctcccaggttcaagcaattctcctgcctcgacctcccgaataactgggattacaggcacccaccaccatgcccggctaattttttgtatttttagtagagacggggtttcaccatgttagtcaggctgatctcgaactcctgacctcaggtgatctgccctcctcagcctcccaaagtgctgggattacaggcgtgagccaccacacctggcctgaacctctggaccttttagttatgtaaggagtaggccaatacattttttccttattgtttaagcctggttgatttctgttttctgtcacttgcaatcaaagcctcagaaataatacacctctcaacactatcccacttaacgatatgccttagctacactcagcaactggaaatgcccaggatgccctgagtcccctctctttcctccaagtctttatatatacaatacctggaatgaagctcctcctttccttgctgtctaattctctctctctctctttttttttttttgtttgtttgtttgtttgagacagagtctcgctgttcagcagtgacgtgatctcggctcaccacaacctccacctcccaggttcaagcaattctccgcctcagcctcctgagtagctgggattacaggcgctcgccaccacactggctaattttttgtatttttagtggagatgggatttcatcatcttggccaggctggtcttgaactcctgacctcacgatccacccacctcggcctcccaaagtgctgcaggcatgagccactgtgcctggcctgttttttttttttgttttgttttttttgttgttgttgtttgttttcatttatttatttattttgagacagtctcactctgttgcccaggctggagtgcagtggcgcgatctcggctcactgcaacctctgcctccaaggttcaaatggttctcctatctcagtctctcgagtagctgggattgctaggcgcatgccaccatgcctgggtaatttttttgtatttttagtagagacggggtttcaccatgggtcttgtactgctgacctcatgtgatccacccaaactcctggcctcacgtgatccacccaccttggcctcccaaagtgctgggattacaggcatgaaccactgtgcctggcccccttgctgtctaattcttacttacctttcgaaatgaagctcagatatcaccttctgcaggacatctgccccctccctatctcatcacttatcacgatctaatggaaccacctactggcttttgttttttgtttttttgtgtttttttgaggcagggtctcattgagtcacccaggctggagtgcagtggcaagatcacagcttactcagcctcaatctccccggctcaagcattcctctcacctcagcctcctgggtagctgggactacaggtgtgtgccaccacacccaattaactttttattttttatagagacggggtcttgctatgctgcccagcctagtattgaactcctgggctcaagtgatctgcccgcctcagcctcccaaagttctgggattacaggtatgagccactgcacctgaccccacatacctttttatcacctactggaggctgtgagcccagagggtggggcacctgtcttaccccagcaacttacacagtttcacagtggctgatacacagtgggtgcttaactaatggttgctgggagaatcagcctcaggtgtcccaagcaccacttccccaggaaagcccttcctaactgctcccagctccctaacagcccccagctccctaactgcccccagcccccttcctaactgctcctcccctccctaactgcccccagcccctctcactacagatacccacactggtaggtccaagaagatcacttctgccaaacctatcttgattttaccaacatatcaggacctgctccttgaaggcaaagtcttgtaataatagtagaagtaagagccaatttcaagtgcttattagttagtttttcacaactacattcccaaaccctattagtgcaagtatatagtaggtgtttaaataccattgttaaataaattagtggaggaataaacaaatgaaatgaatgcatatatataccaaccaccatgtgcaaaatgccttacctgggttatcccatttttcccccatagcagccctattttccagacgaaaggctgaggcttcaggtcacctgcctaagatcacacagcttgatggtggcagagctgagagccagtcccaagctgggtgataccagagacatattttcaaaatcttgtgtcccctccctttcagttaagatgcatgtggctgcaagtagaggaacagccactcagtgatgacttgggcaaagcaggcattttacctttcctaaggagtcaggaggtcagtgtcaccactgacagaggctcagtggtcatcgaggtctcaggtgcttctcctttctcagcattgtcccttccacgtatcagatttctcctcatgatcactagatggctgcagctgctccaagcatcccatcctctgaggacaatttccagagtgggagaggaggggcagggagcacggactctctccttggcatttgtcttgttatctatcaggaagaacaacccttcccaggaatcccagaacagccccaagtcccttaaaccaatccctcaaaggagaacaggattcctaggcttggattagacccatggtgcttgtactccagcacacctgccatgacccctacccatcacccgagcaaaggcggggttctgccgttgtcttagtccattgtgctgctgtaacagaacatctgagactgggttataaagaacagaggcgccgggcgcggtggctcacacctgtaatcccagcactttgggaggccaaggtgggcggatcatgaggtcaggagttcgaagccagcctggccaacatggtgaaactccgcctctactaaaaatacaaaaaatagccgggcatggtggcgggcgcctgtagtcccagctacttgggagactgaggcagaagaattgtctgaacccaggaggtggaggttgcattgagccgagatggcaccactgcactccagcctggcgacagagcaagactctgtctcaaaaaaaaaaaaaaaaaaaaaacagaggccgggtgcggtggctcatgcttgtaatcccagtactttgggaggctgaggtgggtggatcacctcagatcaggcattcgaaatcagcctagccaacatggtgaaaccccgtctctactacaaatacaaaaaaaattagctgggcatggtggcacatgcctgtaatcccagctacttgagaggctgaggcaggagaatcacttgaatccaggaggcggaagttgcaatgagccgagatcgccccattgcactccagcctgggcaacagggcgagattctgtcttaaaaaaataacaactactacaacaaaagattactggggccatgttggtggctggctacacaggccggataagaggtctggtactagagagggttctgggggtggaggtcctgaaagaagaaacagagattttgggaaacatggagccttgggagtgtgttagttttcccgggctgccctaatgaagtatcacaaaccagatggcttaaaacaacagcaattcgttttgtcccagttctcccagaagctcaaaatcaaggtgttggcagagctggttccttttctaggctctgagggaaaacccactgcgtgcctctctccttggcagtccttgactcctagttgcctcgttccagtctccggctccggcttcacatggctgtcttcctgctgtatctcaaatctccctctgctttctcttctaaggacaccagtcattggatttagggcccaccctaaatccaggatgatctcatcccaagagctttaacttaattacatctgcaagactctatttccaattaaggtcacattcacagatacagggtagggggatggttaggacttgaacatataatctggggggattctattcaacccactgtgggagatatctccatggaggggctgttggtgtatgacctaatagttccatctgcagggctcaggtgttacctcctctagggaccttgcttcttttgtgccctacagcacctgtgcctgccgccatcactgcccatattccttcagctaacatttactgagtgtgtgctttacaccaggcaccaagctggtgccaaatttagcacataaaaatacaagacggctgggcatggtggctcatgcctgtaatcccagcactttgggaggccaaggcgagggcatcacttaagatcaggagtttgagaccagcctgaccaacatggtgaaaccttgtctctactaaaaatacaaaaattagccaggtgtggtggtgcacgcctgtaatcccagctactcgggaggctgaggcaggagaatagcttgaacttggcagggggaggttgcagtgggccaggatggtgccactgcactccagcctggagacagaacaagactctctctcaaattattttattttattattttattttttttttcctcccaggttcaagcgattctcctgcctcatcctcctgagtagctgggattatagatgcccaccaccacgcccggctaatttttgtatttttagtagagacagggtttcaccatgttggccaggctggtcttaaactcttgacctcatgtgatccacgtgcctcagcctcccaaagtgctgggattacaggcgtgagccactgtgcctggccagttaaatttaaatttcagataaatggtagtcgggcgtggtggtgcgcagctgtaatcctacctacttgggaggctgaggcaggagaatcacttaaacccaggaggcagaggttgcagtgagtcgagatcgtgccactgcactgcactccagcagagtgctacagagcgagaccctgtctaaaaaataaataaataaaacagaaaataaatttcagataaacagtgagtttcagtttgtcccacttatggaatctggcaaccctaacagcagaaaggcacagtcacccactgcagggagcacaggatgccacatggagcagcggccctggccaagcgggcaggggtggaacaaccatacagagtttagagccgcagaaggcctttaactgaccaaccagatgtgggttttagaaaaacaggggcgtgtggtgtcacaggagccaagggaagaacagtgtttcaaggaagagggagggaataacagagctacatgttgcaggaagggccggaaagatgaggctgagacagggaagcacagttggagttagcaaaactgctggaggcaccaggagggaggcgtaggttgcaggggacagcagccaagctgcaggggttgaggagtgagaggaatgagaagctaaggaaggagacacagggtaggctgttgcctctacaagctttttgtgtgtgtgtgtgtgtttgtttgttgttgttgtttttgtcacccaggctgcagtgcagtggcgagatctcggctcactgcaacctccgcctcctgggttcaagtgattctcctgcctcagcctcctgagtagctgggattacaagtgtgcgtcaccactcctggctaattttttttgtatttttggtagaggtggggttttgccgtgttggccaggtggtctcaaactcctgacctcaagtgatcacctgcctcagcctcctaaagtgctgggattataggcgtaagccaccacccctggcctccacaagcttttgagtagggaagagaggccccctagggcgggcaggagccaggaaggagcacaagcgaaggaggcctggggaaagaggttcacagccgggagggaccctgaggggccttagcgtttgacactctaggtggacctggccttgggtggcaggaggagaagtgtaaattcagattcttctggggaagtccggggactctcagctgcccactcatcacacagtgcgatgactgccctccccaaacgtgctctccttctctggcaggagctgtctcccaagctgttcctccgcacagaaggcaaagcggagcacatggcggcccccgtgccttggctgaatgaaggagtgaatgaatacttgggagcggctgcgggccatagagggagaagagggcaaagcctggagattgggagtggctgtgtctgaggcatagggaggaagaggcagcggaggagggaggagccagggagtccaggggcctcggagagatgagggagacagagtcccttgccggagaggtcggagccgagtgtggagaaggggtgcttcagccccctgcgtgggggttggagagaagggtaaatgaggcagcgtagaaagcctggtcaatgtgggtgcggcgggagggatgcgatgccagggaggggagaaggggacacatactttttttttttttttgagatagagtcttgctctattgcccaggctggagtgcggtggtgcaatatcggctcactgcaacctccgcctgtagggttcaagcgattctcctgcctcagcctcccaggtagctgggactacaggtgtgcgtcactacgtctggctaatttttttttttttttagatggagtctcgctttgttgcccaggctggagtgcggtggtgcgatctctgctcactgcaacctctgtctcccaggttcaagcaattctctgcctcagcctcctgagtagccgggattacaggcgcccgccaccaggccgggctaatttttgtatttttagtagagacggggtttcacccttttttttttttttttttgagatggagtctccctctattgcccaggctggagtgcagtggctcaatcttggcccactgcaacctctgccttttgggttcaagcgattctcctgcttcagcctcctgagtagctgggactataggcacctgccaccaggcccagctactttttgtatttttagtagagatgggatttcaccatattggccaggctagtctcgaatccacccttgtgatccaccagcctcggcgtcccaaagtgctgagattacgggcatgagccactgcgcctggcctaacttttatacttttggtagagacggggtttcaccatgttgcccaggctggtctcaaactcctggcctcaggcaatccaccttcctcagcctcccaaagtgctgggattacaggtgtgagccaccgcgtctggccactttgatatacttttgtatgggtgtatggggttccattcctgccccaggccttgccatccatcccatcttatttaattctcacaaccacccctagaagaagattttactgaagatgaagatgattgctactggtggtctcactttacaaataaggaaactgagtctcagagatagtaggcagcttgcctaaagtcacaaggccaacaagtagcagaaaggagatttaaacacaggttggtccaactccagagcaggctctgtccaccaccccacaagaacaaggaagccctgagcaggagagatggcccataatcagggcaggcctcagacagaaggatgctgccttggggcagaaatagggcactgggccttttcgggcctcttgggtggcctggatgatgtcacctcccccaaggactactgggctcacctcccaggccttgcctggtttccagcaaattccagcaggctgggggagcagggagcaaacccaagagtggggcatggcagaagggacagggcacaggggatggtggtggcagtcatctgtgcactgaaacagctgaccatgaagttccctgtaggtaaggagaccagaaaaaccaaaacacagtggggactgtgccgaggtgggggtggagtctcatccctcaccttatccactccctcacaccgccctggctctgcaaatccttttctgtcagttgaaatttccttgcctaggctgggtgcggtggctcacgcctgtaatcccaacactttgggaggctgtggtgggtggatcatgaggtcaggagttcgagaccagcctgaccaatatggtgaaaccctgtctctactaaagatacaaaaattagccagacacagtggcacatgcctatagtcccagctactcaggaggctgaggcaggataatcgctgaacccgggaggggaggttgcagtgagccgatattgcaccactgcactccagcctgggcatcagagcgagactccgtctcaaaaaagacaagacaagaaaagaaatttctaggccgggcgtggtggctcatgcctgtaatcccagcactttgggaggctgaggcgggtggatcacgagatcaggagttcaataccagcctggccaagatggtgaaaccctgtctctactaaaaatacaaaaacattagccaggcatggtggcgggtgcctgtaatcccagctactgggaaggctgaggcagagaattgcttgaacccaggagacggaggttgcagtgagccaagattgtgccactgcactgcactccagcctggcgacagagcgagactctgtctcaaaaaaaaaaaaaaaaaaagaaatttccttgcctcctcttccttcttcaaagataagcttggatatcccttcttcccagctggctaccctcctcccactctcagctccctctcctggtccctagagggctggcaaccacaacaaatttcctgaccacacaatagggctgtcaggccaaagattcactcattccagtctaactgcattccctccacggcctcatccagtctcacagcttttttttttctttttgtggtagagacagggtctcgctatgttgcacaagctggtcttgagctcctgagctcaagggacccgtctacctcagcctcccaaagtgctgggattacaggcgtgagccaccacactcggcctcagtctcacagttttattaatttatttattttaaaaaatcaaatttgattttgtcttttctatttattttattattattattattattgagagggagtctcgttctgttacccaggctgaagtgcagtggcgcagtctcagctcactgcaacctccgcctcctgggttcaagcgattcttctgcctcagtctcccgagtagctgagattacaggtgcctgccaccatggccagctaaggtttttttgtactttagtagagacggggttttaccatgttggtcagactggtttcaaactcctgacctcaaacgatctgtctgcctcagcctccctaagtgttgggattacaggcgtgagccaccatgcccggccagtctcacagctttaaatattatctattcaccgactgtgctgaaattgttatctccagcgtggacccctctcctgagttcaactctgactaccccacgtctccaccagaacgtctaaaaagcactcagacctgatgtggccaaaacagaatcctgatcttccctatactcaagccagctcctttcaaagtcatccacatctcaattgaagccactccatttttctagcagctcaggctaagtagcttggctctgatccttccctcacaccccacaccaaatctgcaagtcctgtaggctctaccttcaatgcccttctcccacctctgccgctgctcaaccgtggaggcttcatctgttgccttgattatagcagtggcctctggacactgtccttctttttttttttttttttttttttgagacagagtcttgctctgtcgcccagactggagtgcagtggcctgatctcggctcactgcaaacttcgcctcccatgttcaagcaattctcctgcctcagcctctcgagtagctgggattataggcacctgccatcacgcctggctagtttttgtatttttagtggagatggggtttcactatgttggccaggctggtctcaaactcctgacctcaagtgatctgcctgtctcagcctcccaaagtgcagggattacaggcatgagccaccaccttgcccagcctggactgtccttcctttgaccttgtccctacattctcatctcaacccagaagccagggtggttctaggacctcctctgcctgcaatgccctttccccagacgtcctcattacttgctccctcaccttcagatcttgactcaagtatcacctcatgtttgcctttcctgagcatcctagttaaaactataaatctctctcttttttttttttttgagatggagtttcattcttgttgcccaggctggagtacgacggtacaatcttggctcactgcaacctttgactccccacttcaagtgattctcctgcttcagcctcccgagtagctgggattacaggcatgtgccaccacacccagctaattttgtatttttagtagagacagggtttctccatgttggtcaggctagtcttgaactcctgacctcaggtaatcctcccgccttggcctcccaaagtgctgggattacagtcgtgagccaccgtgcccggccttttttatttattttattttattttattttattttattttattttatttttcgagacagagtctcgctctgttgcccaggctggagtgcagtggcacgatcctggctcactgcaagctccgccttccggttcatgccattctcctgcctcagtctcccgagtagctgggactacaggcgcctgccaccatgcccggctaatttttttgtatttttagtagagatggggtttcatggtgttagccaggatggtctcgatctcctgacctcgtgatctgcctgcctcggcctcccaaagtgctgggattacaggtgtgagccactgcgccaagcttttatttattttatttttttttgagaccgagtctggctctgttacccaggctggagttcagtggcgctatcggctcactgcaaccttcacctcccgggctcaagcaatcctctaacctcagcctccagagtagctgggaccacaagtacacgccaccacgcctggctaatttttttttatttttaaatttttttgcagagacaggatcttactctgttgcccaggctggtctcaaagtcgtgagctcaagcagtccgcccatctcagcctcctaaagtgttgggattacaggtgtgaggcactgcgccaggccacaactataaatcttgaccttccctgtgctctctccctgctttttcttccttctagagcctgtatcatttttttttttttttgagactctctctgtcgcccaggctggagtgcagtggcacaatctcggctcactgcaagctccgcctcccgggttcacgccattctcctgcctcagcctcccgagtagctgggactacaggtgcccgccaccctgcccggctaattttttgtatttttttagtagagacggggtttcgctgtgttagccaggatggtctcgatctcctgacctcgtgatccgcccgcctctacctcccaaagtgctgggattacaggcgtgagccaccgcgcccggccgagcctgtatcatttaactaactatgtatattacctatttatttcatctattatcggtctcctccttctaggatacaagggtggtgcctattctgtttcttattgttgttttccttgctgcttggaacagtgcctagcatacagtaggcactggataaatgttgttgaggccaccactgtactgagcactaaagttggaataatgaggctaagcacagtggctgacgcctgtaatcctagcactttgggaggccaaagtgggaggatcgcttgggcccaggagtttgggaccagtctgtgtaacacagtgagaccccatctcaacaaaaaataaataaaaattgagctgcgtatggtagtgcacacctgtagtcccagctactcaggaggctgaggcgggaggatcgcttgagcccaggaggtcgaggctgcagtgagctgtgattgcaccactgcactccagcctgggcgaccgcgagaccctgtctcttaaaaaaacaaaaagatggaataatgagcaaaacctgaaaaagtccatgaagcttaagtgttgggcagcatttcactaattttcgtcttgaagcatttcactaattttcgctccctacctggggagcactaggaagtgaagactctggctccacccctggagattctgggggaggttggcagaggtgtgcacactgcggaagcgcccccggcggtttggattcgggtcacgtgcgggtcactccggtgtgctggggatgggttgaaattaaaactttccgggatgcctggtgttcacgctaacagcactgtccactctctcctaaacagtgcttacgtgcccgtctcccctctaaaccctgaggtgtggcgctgagatggcacctcgctcctctctgtgccccctgggctcagcaccgcgtagatgcgagttaatttttattgagaacgtgaatgaatgagggggaatgaatggttagaagacgaatgaatgagtaacaggactctggttagaaaaggaatttcaagagtcaagatctggaaggtgggaaagtttccaaagacttccgctacgcgcgctagggctctggaggggcaggtactttagaggtcgagacgcgattggccgcctgggaaggtggctgtgccgccggctgctacgcgcggggccaaggagtcgctggccgcaggggaggtgctgccaaccacccggcccccagcggcgcgcgactcacggcctgggtgagcagccaggcctggcgccgccgttgccatagttacagacgcagccctgcgagggggcgggctctggccgcacgtcattcccggcgcgacgctcctccgcgctcccgcctcctcctggtcggagaccctcggccagcctagcgggcgctccacctgcgcgccggctcaccgctgccctgcgccggttctgcgccggcgcggtacgagggcgcgcggttgggcggggggggggggggaagctgcgaggcgcatgcgcgttgcagggccgtccgctctgctgccgccgctgttgcagccaccgccgttgccgcctccctgccggcaagtgtgtgaagaagaagctgagcgttgtcgccgccgctatgggggtgagtgaggcagagagaggagatgggaggtccaggggcgctcctcgctaccctcgccccctttgttcttaaacccccctctcacgtgaccccgaccccctccagcctcacgtgacccctgacccccacatgacccgactcccccattctaagggtccctacgctaggcctagcccgggaatcctctggagagcccctggtccggggccccaccccctcggcgcccccagcgtcacgcccgccccttcctgcttcgcggacccgttactggcctccccaccaccgtcccccgcggggaccctggggttagcttcccgctcccccagggtcactcatcacctggctgtcaccagcttcgtcgcttttcacatccgaggtcaaccctggcttggagggaattgaggcccagaggaaagaaggcgcctagccaaggtcatattgtcgggggcgtcagaccccaccttgggcctcccgaatcccagtccactgcccttcccgttactcgagtctcagcgaagccggttcccctacactctttcgaaacctctccaccaggttcctgctgctcctgataaacacagccttcctttcccatagactcctgccttcgacgcctcctggttgcaatgaaatggttcttacgaccgcttgggttgttaggggttttggtagtgcaggtgttttttgcaaggggagggctgtgcaggtgtgcggggaagatgcggggaggcgggggcggcggcccagccgcggatggatattgaccacttgttccgtgccggcagcctggaggtgcattttagtttactttcccgggatatagggtagggcagaagttatttgcaagtttctgtgcgttcaccttactaagtctcaattacagcagtatcagtcaccctcctaaaaagataacgcttttcctagtattggctgtattctttttttttttttttttttttttttttgatatggagttttgctcttgtcgccgaagctggagtgcaatggcgcgatctcggctcactgcatcctccttcttctgggttcaagcggttctcctgcctcagcctccccagcagctgggattacaggcgcccgctactatgcccggctcatttttgtatttttagtagagacagggtttcaccacgttggccaggctggtctcgaactcctgacctcgtgattcacccgcctaggcctcccaaagtgctgggattacaggcgtgagccaccacacaggcctatattagtatttacatggaatttccatcaccttaagggaaccctgactttggagcccgaggtacctcacttccagccccgtcttcgctgctggtggtataatagtgtgccagtgagttggcctttatgtgtttgaatttcctcacctctgtaattgggatgctaatacctcccccttagggtagtagtgaagattaagtgagataatggatgtagattgctaaggaggtgtctcctaagtagtggctgttatttttgtctgtatcctcagccttaactttactgatctaaaatggatttgtgctatttttaacccattgggtttgtccctactgttgttaacctagtttttttttttcccgtcactccactatttatcgactgaacaaatcaacttattagacaaaaatagttgtctaatccgtgtcaaaacagtcatcgtgttttaacaaatagttttgggtattacgtacttcatatgtagaaaaccaagtctagagaccttaggcatatttaacctaaattttggtgaaaggtcctagacacagccattgttgaaactaaatgaaacctgtgtcccttagtaactgtctaaccagaagcagccactgcggattaagcagaaaacaagaagtgtaacatgccgttctagttcaacacttcctcgttggttggactgaaatagcaggccctcaacaccataagacagggtgaaggaaaaaagaaatatgccccagagattctgcgatccttgcttcctttagggcctcaatcttatactttacagatgtgtttctcacatgagaccctacaaagtctcttctggcctaaaattgacagtaagagagacttgaattctcctccctgaaacagctggaaccgtctcatcaccctcattccacaactgtgggtgctggggaagtcatcattccttgtagttaccctgtggcagagcctggcctcaggctgagtgaggcttcagatggagcgctttctcttcagttgccacacacgtgtcctagttgccacatttgtgtcatctttcaggagttagaatttatatttctcttgcttcaccaaaaacagattctttttggatattggatagtatatggggtagagacattgatactgaaaatctaagagatgccaaattctttttctgaaaagtggctcctcctcccatctggatgtttcttttcttttcttttccttttttttttagacagagttgtgctctttttgcccaggctggagtgcagtggcacaatctcagctcactgcaatctctgcctcccaggctcaagtgattctcctgcctcagcctcccgagtagctggaattacaggtattaaccatcatgcctggctacttttttctgtttttagtagagacggggtttcaccatgttggctaggctggtcttgaactcctgacctcaggtaatccacccacctccgcctcccaaagtgctggggttataggcatgagccaccgcgcccagcctgggtgtgttttttttaatttgtctttatgaccccttccagtcgtagaactgtgtgtggagttactttttcaatgggaatagtaaggggaagagttttacactgcacatggaaacatttatgtaacactttataacaaaaaatgccatatacatgtgattgtgacatggtggaaggagcatgactttagggttcaaacgtggatttggatcttggatgattcattcagcagatgtgaactgagtatctgctgtttggtgagcactgggtgaacatagccagataaagcggatctaccctcacctcatggggagagttggagggagtgggaggaagagaccgctttgagaactctcctcaccgcctctgtgaccctgcaagttccttaactctctgtgcctcaggtttctcatcaaagaagtagtcacacctaccatgctgggttgtgaaaagtaaaatagatcacctttattaaagcaccggcagaagatctgagggaggtctttgtaaacagaagtcccctcctgcgactgttggtgtagacattgcgagccccattttatggagaagaaaactgagagagaaattttgagcaacttgctgaaaagagcttaagtaacttgcctgaagtcacgcagctagtaagtgaaagagctgagaatcaaatccaggtcttttgattcaaaatcccgcactctctttttttgtacaaagctcccttggaaaagacacttaaccacagtgagctttactgttcactgtgcttattatccattttaattaggagcattttcctgtgtccctgtaggacagccttacttccacaaggcaggggcaaagctaattggaacagtaggagaccacttttcctagtgcggcccctccctgcctgtctggcccagctggctgcaccctgccttctgccccatgggcaggcagcggagctcgtaaggggttcttgagttattgcggtctcaggccatggcagctccaggccttgctctgaggattgccaggtctacatgaatgagcccacaaatctactagaggcccggctggccctcctgctgcttgttcttgggaattactgctcatgcttagaagtgagatggagggaacccaggcttcagtgctttctgggttctgggcgttacccttgccctccagcacctttgatccctgagccctgtataagagaacaagcatgtagggtggagtaagggagcttgtacctgcactgaaggtgtgctggcttctaacctgcccttacagctccaagaggccaacatttgtacccccatcttcatggagatggagttgctttcataagtcattctgggggtgtcaggaagagcataggcccaatctgattgacgccaaagctcatgctcttctgccccatggtgcagccctggacaccttccatccgacgcttctctgtccctcacctctgcctcagtgcagagggtagggtgtatagcggcactgtgttggcacgctgttaccaaaccagccaggcaatgagaaaggagttgccgagtggttgctgagggcttctgaagcccaggccttatcgtggcagggtgcaagaatctttgttgatgaccaagtggaagtccactatgcaggacataggcgcctcagtaggggacagtgtggccagtggaacaaacatgatctgcagcccatccctgggattgagtctcccctctgccctttattcactgcagaactgagtggtcacattgtctcttcaaggctcagtttcctattgtgtaaagggaagtgatagtttctgccctgataattgaaaccataacctaggccgggtgtggtggctcacacctgtaatcccagcactttgggaggccaagacaggaggatcgcttgagctcaggagtttgagactagcctgggcaacatagtgagactcccccatctctaaaaaaaataaagaaaaaaaaagaaacataatgtttgtaaaggtactttgcaagctttatctctgtgttgtcttgaaatctaaatttccagagaaaaagatgaatgctctaaacctgtccatggtagagggaggctagttctgttccaggagtccagccttatgaagacagtctattctctattttgttccttcctctagggaggtaagatatgagatcttgcctgtgttccacagcgctcagccatgagataattaatagctggtgttggtagagtttgtggctataagaacaatccctgtgagttcctggtatctgaactcctttcttcttggttgattaaagtaggaggtaagcagtgtcattccttggaaaatagtgggtagaactgattctgagaacttccccagcatctggtttttcaactcatgcagaaggttaatcgctctgagtgtcctttcctggggccagtccgtgtcagggctagatgtaattgggagttgtcaaacctctccagagagctcagggaaaggaggggtgttgggggggaggtgtcaaaagaggctgctctattggtaaaaagcagagccaacttaccagtgcctttgggatgccttctggggaccagctgggtggtgcatgcagtctgcatgcctgtgctctcttgttgtcctggggagagagaatgagaatagccttttattgaacacataccatattaaccctcataaggaccctcagtcatcaagccaggggaggctcagagaagtgctgtgcctcgtcctagcactgcagagggtggagagcaggaagaggctttggacagccctggcgcagtggctcacgcctgtaatcccagcactttgtgaggctgaggcaggcggattacttgaggtcaggagttagtgaccagcctggccaacttggtgaaaccccgtcactactaaaaatacaaaaatcagctggacatggtggtgcgctcctgtaatcccagctacttgggaggctgaggcaggagaatcgcttgaacccaggaggcagaggctgccgtgaaccgagatctcaccactgcattccagcttgggtgaaagagtgagactccatctcaaaaaaaaaaaaaaaagaagagaaaaaaggaggttttggatgaggcctgccaggtgtcagagcctggctcttgccgtgtgttacctggcttttcacaatagggtgagtgggtcttaggcctgagagaatctcacgtcggcctcaaaacaggacctgatctagaagcagctgtgggcaatttgccattcgctgctctatgccaggagaatccccacttgctgctcctctgctgccctgctgctgactgtgtgcctgcagcttcgtcttgctggccatgtgtcatctgtgtcctgaggtgaaccctttgggcccctgccctctgccctgtcactgggtgtgccctgtcactcgttggccttaactgagcagggcttctgggaatggctctgtgtccttgagtccgaacacggtggcccccacttgaaatgagacccggctcccacaggagctgtggccaaccagatctttgtctcccaaagctggaagacaccgaaaaggctttgaataaacttaggaacagccatcaacggctaccttagatgctgtctcctccctgaagcggtcttcagtgtgtctaaagttgggtgttccctccttaggagggagcgggtgagtgaatatttactaagtgcctgctgggggctggcctgctgtaggcgttgtcagctgtttcgctgggtccccacagtgtctgtgtcaggacggccagtgctctttctgaagggaagctgagaagtctggtgacctctgaggactccccactacaaaatgacctgcttgggtctttccgcccctccaaatgtgtggcagcagaggtgggaaatttctcactgctgggccaggcctgtggatgcagggcccttcgattccttaaagggaaagtcagtgcttgattggccacagccattccagctaacgttgcttttccctgttgcagagaaagtcaagcaaagccaaggagaagaagcagaagcggttggaggagcgagcagccatggatgccgtttgtgccaaagtggacgctgccaacagggtgattctccctttcttcccagtccctgcctcctgggacttcagcttggtttataatttgacttattttgtctccaccctgtggcagaattgtgacactacccacccacaccgcctctgcctccttgctgtgcagggaactgagctcatacctgtgtgttggaagttggcgccagcagttggcccaggtgtttgggaaaacgtggattccagtgaagtggctgcctccctgtggatcttcttccttatgaatagaggaggatctagataatttttttttcttttgtgtgagacagggtctcactctgtcatccaggctggaatgcagtggcactatctcggctcacttcaaccttgcagcctctgccgcctgggcccaagtgatcctcccacctcagcctctcaattagctgggactataggtgcccaccaccacacccgggtaatttttgtagagacggggtttggccttgttgcccaggatggtcttgaactcctgagcccaagcatttcacctgccttggcctcccaaagtgctgggattacaggcgtgagccacagtgcccagcccctgcctccatttagtatcccattttttggtcattcttttaacccactcatagtaaacactcatttataaggatgtggctcaggggcttgattttccatttggagttgtaaccaggtaaagtcagtgtgcagcagatcaggtagcctcttctttgggttagctgtgctgtgagcaggttgtatgcccacaggctaatgaggtctcctcttgccctgtcaggtgatgccaaacttaactctcctgggcctttccaccaaagccttcctcgcacatgtgacttcagagctaggcaaatggtgggttttgggaggctgctcctggttctgaagttagtctcccgttgtgggtccccacagcatcccactccaagacaacagctcttgggataggatctgcacctccgccccacttgtctgtgctgttcctcttttctttccctccacagcttggagaccctctggaggctttcccagtgttcaagaaatatgatagaaacgggtgagtcacattgagcattaccaactgctgtctcctcgagtgtcttcaggaattccctttccagagtaggcttcctcagacacaaattttctcattgttcttcgtatttacgaaaaaacagggctgggtgcggtggctcacgcctgtaatccaagcactttgggagaccgaggtgggtggatcacatgaggtcaggagttcgagaccagcctggctaacatagtgaaaccccatttctactaaaaatacaaaaaattagctggcacggtggcgatcgcctgtaatcccagctactcgggaggctgaggcaggagaatcacttgaacccggggggcagaggttgcagtgagccgagatagcaccattgcactccagcttgggtaacaagagtgaaactccatctcaaaacaaaacaaaacaaaacaaaacaaaagcagaaactgactcgtgccctatattgatataaaatcccccaggtagggtggcagaagaatccataaatgagcaaagattgcacttaatctcagactgatgtctctttagataaatttttcttttattttttgagatggagtcttgcttagtcacccaggctggagtgcagtgacgcaatctcggctcactgcaacctccgccttctgggttcagccgattctcctgcctcagcctcccaagtacctgggattataggtgcgtgccaccacacctcactaatttttgtgggtttttttttttttttttgagacggagtctcactctgtcgttcaggctggagtgcagtggtgcgatctcggctcactgcaacctctgccaggttcaagtaattctctgtctcagcctctcaaatagctaggattaaaggcacccgccaccacgtccagctaatttttgtatttttagtagagtcagggtttcaccatcttggccaggctggtcttgaactcctgacctcatgatccacctgtctcagcctcccaaagtgttgggattacaggtgtgagccactgcgcccagctaatttttgtatttttagtagagatggggtttcaccatgttggccaggctggtctcgaactcctgacctcaactgacccacctgcctcagccacccaaagtgctgggattacaggtgtgagccaccgcgcctggcctgatgtctcttcaggactgattattctctctgcaaagaatcattgagctgaaacaaacttggaaaattatctaggctgacactcacatttaatgcatgggaaactgaggcccagagagtcaaatgagctttctgagtttatggagtttcccctgacagctgaggggcttttaatttccaatctagtgctctttccctgagtatacagtataattgttaaaagccaattcctggctatttggccctgaacaaattacttttcttctttaaaaagaaaaatatttgctgggcgtggtggctcacgcctgtaatctcagcactttgggaggccgaggtgggcggatcacgaggtcaggagatcgagaccatcctggctaacacggtaaaaccccgtctctactaaaaatataaaaaattagccaggcatggtggcgggcacctgtagtctcagctactcgggaggctgaggcaggagaatggcgtgaacccgggaggcggagcttgcagtgagccaagattgcgccattgcactccagcctgggcaacagagcaagactccatctcaaaaaaatgtatatattttttggtagagaaggggtcttgcctatgttgcccgggctggtctcaaactgctgtcctcaagtgatcctcccacctcggcctcctaaagtgctgtgcccagctgaccctgaacaaattacttaacctttctgttcctcaattttctatttaaaaatgggcctgggccaggtgtggtggctcatacctgtaatcccagcactttgggaggctgaggttggaaggatcgtttgtgcccaggagtccaagaccagtcctggcgacataggaagaccctgtctctacaaaaaaaaaatttttttaattagctgggcatggtggcacatgcctgtattcccagctactgagaaggctgatgtgggagaattgcttgagcctgggagatgcaggctgcagtgagccatggtagcagcattgcactctagcctgggtgacagcaagatcctgtctcaaaacaaaacaaaaacccaaaaaccaaaaatggttctaataatagtacctttctcatggacttgtcaggaggataagatgtaaagtgttagttcctgcagcataataaaagctagataagtgtttgctgttattttattttaaaattttattttagattcgcggggtacatgtgcagctgtgtagtggtggggttgggcatctagtgtacccatcacccaaatagtaatcatcgtacccaataggtaaattttcaaccctcaccctgtttgctgttactattactgatccagttaactataggctctggagtgaaggccccctcacgtttttttctcgttttggtttctaaaataggaagtataatctgccttacctgagatgctgttgatgagttgtgcttccagaatgtaacatcttggcttggggataaactggggctctgggggattgaattgtagctgggcttcttaataactctacttggagaagtcactcatattcctcaagcctcattttcttacctgtcaaataggatgatgatgccaaacttgcaagctgtttttttttttttttttttgagatggtgtcttgctctgtcacccaggctggagtgcagtggcgccatctcggctcactgcaagctcagcctcccggattcacgccattatcctgcctcagcctcccgagtagctgggactacaggcacccgccaccacgcccggctaattttttgtatttttagtagagatggggtttcaccgtgttagccaggatggtctcgatctcctgaccttgtgatccgcccgcctcggcctcccaaagtgctgggattacaggtgtgagccaccgtgcccagccaaacttggaaggttttttttaaggaagaaagagaatatatgcagctcagtaagtagcagctggtatgaggttttttttgtttttttttttttttgagacagagtctcgctctgtgcctaggctggagtgcagtggcacgatctcggctcactgcagcctctgcctcctgggttcaagtgattctcctgcctctacctcctgagtagctgggactgcaagtacatgacatcacgccctgctaatttttgtatttttagtaaagacggagtttcgccatgttggccaggctggtcccgaactcctgacctcaggtgatccacctgcctcaacctcccgaagtgctgagattgtaggcgtgagccactgcgcccggcctggaaagtcttttgacatactttagatatcccatattgtgatatctcatagtgttttcgtttttgtttttgagacagagtctcgcccaggctggagtacaatggcatgatcttggctcactgcaacctctgcctccctggtacaagcaattctcctgcctcagccgccggagtagctgggattacaggcaccccccaccacgcccggctaattttttgtatttttattaaagatggggtttcactatgttggccaggctagtctcgaactcctgacctcatgatccgcccgcctcggcctcccaaagtgctgggattacaggcgtgagccactgtgcccggcctcatagtgttttcatattccgtattcccattgacttccagaaatgtggaatagctccaaaacaggcattgccagccaagtctgggctcctctggtgccttgaattttgtgtggttcctgtggttgtgatcttactttcatgtactttaatggagaattcgtacctgcaggtgggctttggacattttatagttaagataggtgcagtgctgtgtttgggcagctgtgatggctaagtgggtgataaagaaaggaagatgcttcaggggcagggagttctgaattcataaggctgagtgtggtgtgccagtcagtagaggtgatgggattccagtgcgtacatcctctgggggttgtgtcaaaggtcactgaaaggtattgatacgggagctctttaaaggcttagagtttgctgactctagtcctttcagaatgtagtgctctctagggaatgtgatttcacagatcagtcaaggagtttaactgttttttacttaaatttcatttagaaacagataccttaacacttaggcatttgtgggtttagaaaaacagtgttgggctgaagcctgcttcacccggtttttttttgtttgtttggagacagagtttcgctctcactgcccaggctgtagtgcaatggcacgatcttggctcactgcaacctccgcctcccaggttcaagcgattctcctgcctcagcctcccgagtagctgggattacaggcacccaccaccatgcccagctaatttttttgtagttttagtacagacgggatttcaccatgttggtcaggctagtctcgaactcctgacctcaggtgatccatatgccttggcatcccaaagtgctgggattacaggtgtgagccaccattcctgcctcaatctgtttgatcagctgagagtatcccccctgctcagatgaggcaggcaggactcctggggcggggtggggcgtgttgagccgtagtcttctcgaaggacctagggtcacccagtggttttgaaggcgcaattggtagataagaggaatggggtcccatgggagcctagtgaggagtcagctcagaaattacagcaacaggaaaaatgcctaagggcaggaactaaataacagaagacatgagtgtttataacaaagtacagaagagacagaaaaggtagaaaaagaataaagagagagcagagagggacaagaagtttacaaagtgccgaggcggattaggacagcttggggaggcaggaaacgggccttgtggttggggggtgggccgtgtggccacagttgttaatctcagcctgaaagactttgttcctgcaccttctctagtcatgctggggcagatacagggttggcttttctctgtgcagtaactgagactgggccttcctccctgtgattctgagggaggaacagcagtgccctggcaggagtgctgtaaccaattccgtacacgtcctgtcctcttctcaggttgaatgtctccattgaatgtaagcgagtgtctggactggagccagccaccgtggattgggccttcgacctgaccaaaacgaatatgcaaaccatgtaagcttgtcccaaccaggggagcctagttcctctcgcagctttcccgtctgactgctcccaaattccccaggtatgagcagagcgagtggggctggaaggaccgagagaaacgggaggaaatgacagatgaccgagcctggtacctcatcgcgtgggaaaacagctccgtccctgttgccttttctcacttccggtttgacgtggagtgtggggatgaagtcctgtactggtaggagccatggcttgggggaggtaggggagagagaccctggcgatgttccaggcactccagccaggtgacaaagcccctggacctacctaggtctatgagctgccaaggactgcaagctcctctgccagaccttacagcctcttcatgtcccatcctgcacgctcacctctctgctttcttcacctagctatgaagtgcagttggaaagcaaggtgcggcggaaaggcctggggaagttcctcatacagatcctgcagctcatggccaacaggtaaggcctcccttcttaggaggcccatatagcactcagttggaaggagctgtcactgaggcacttgccattctttgagccttgttggaggaggaggctcataggcatgttttgggagaaaggtgtcttagaaccctctcagtaagatgctccctgccttattatgactccagattttgtttgtttagctcagtgcagtgaacatcttttttttttttttttttttgagacagagtttcactcttgttgcccgggctggagtgcaatggtgccatcttggctcactgcagcctccacgtaccgggtttaagcaattcttctgctcagcctcccaagtggctgggattacaggcgcgcactgccatgcctggctaatttttgtatttttagtagagacggggtttctccatgttaaggctggtctcgaactcctgacctcaggtgatctacctacctcagcctcccaaagtgctgggattacaggcatgagccaccacacctggccagtgagcatcttttgagtttctaatctctgccaccttctgtaccgaagtaatggtgctacagagaggaagtgggaaacatccttgctctggaagaagccagtctggtcagggccgatgcctgtgcagtctgatcagcctgtgatgggggaagcagtgagtgctgtgtgggggtccaagacctccagaggctagaggccaaattcaggaacactcgtgtgggtgaaagggaggtaacagacaaaggcagaaaggaaaggaagcatgaccttagtctctgtgtcttttcttttttgagacagggtctcaccctgtcacccaggctggagtgcagtggtgtgatcgtatctcactgcagcctctacctcccaggctcaagtgatcctctagcctcagcctctggagtagctgggactaaaggcacatgccactatactgggctgatttttttaaatttttaaatgttttgtagaaatggggtcccactatgttttccaggctggtctctaactcctgggctcaaatgatcctcccacctttgcccctcaaagtgctgggattacaggtgcatgccaccatgcctggccatgtttctctttctaaaaggcgtttgctctgctttcttccagcacacagatgaagaaggttatgttaacagtatttaaacacaatcatggtgcctaccagttcttcagagaagcgttgcagtaaggagctgggtgtgggcccttctgggtggtaggtgggcctgcccagggccatttttctggtcctggccctcactcattctgatgcctgagctcatggtccagtggtccatgggggttcaggttcagggagatggtatggcagtgctctctgatttggtccactgtccacctcctgcaccctcatcctaagggtctcatcagtgtggctggtagaagagttctcgggccagggaggaaggcactcagctgcctgccaccaacccttttctcctgcctgccttgcagatttgaaattgatgactcttcccccagcatgtccggttgctgtggggaggattgctcctatgagatcctgagccggaggaccaagtttggggacagccatcactcccacgcgggtgggcactgtggtggctgctgccactgaactctcagagccactttcaagtcacaatgctctctcctaaggcctttcctctttcctggtctcactgttcaccgggtgtcctcagagctgtggcctccccagccctgcacgtgccaggctgcgccctgagagcacagaaccctggggagaagtggtatcagctgctcctcctctcctaggagaccagagtgctagaagggaatgaaagggagagggaagagtaggtggggccgggcagtgaagctcatcctccacagtggctgcctcctcatttggctcctggggcctgcagtggaggttctcgcacctctgcagcccctagattcctggcaacctcccctcccctgacacatacacacttggacaaatggaatgtttatgtccacctttatgaaagttctggagtcctgggtctggggtttgctggtccccaaagaggaacacactgggtgtaagatctgggtgtagagggcggcttcagagagactcacgcttgcgcagttggaattgctgttaacggagactgggaagatcttttgtgccaagatgcagggaaatgaagaaagctctttccagctgtttttatggattcatggagtgggctcatgttgggaccagctgactctgggaggaagactgcctctccatcgctgtcagagagcctgaaaggaccaacaatgaggtgttcttgggacccgccatggggatgattgcttctctaggctcctggatgttgctgcattctaagcttaacctcctggtctcatggcagtgacttgagcttttgattcatagaagaaagccagaggttctgcttgttcttgtctgccagccctcgtcgttctttctcctctgcctctcacctctaccccaaatacctctgttcttagtctcaaggggagaataacatcagggagcccctcatcttccccagaaggacttctcgttcctcatgtagttaactccattgattttcctatcttggtgctgatagctctctaagggtagggcacacctccccacagccaccctccctcttcagagagcccccagccagcagcaggcccctctgcctgcactcctcaggcttgcccctcgctgcctcagtgaggcactagtgccactgccgtggcccagccgggccatagctcaggctgcagcagaaatgcctctcagtggccaacagttgcttttctctctggtgtcaccctgtggcaacaggctggagcaggggaaggagaaagccttcctcttctctcataggatagaaaggcaggctcagaactaatgctcatcctgatctctaggccttgttcctcttccagggaagaaaagccaaatccttatcaaggaaaaagcacctaacagctccctttggatatccctgagctctgctgtggggagtatcataaaggttctagccttcgtgaagttgttctcgtggaggtctgttggtccctctgacctcagcatctgctcacatcccaccctctgcccaactctggcagtctctcctggcagatctccccagagtggtccttgcttctcacctggattcctgcttgtgcaggagcctgtgtacacagggcctccctcacccagcctggcccctctgctgagcactttgcgctgctcttgatgggcagcagtgggactgggaactccttagagagggccttgcagctttacactggaataagtctgcctctgcctctgcctcaccctgctggctcctggtgggtttcatcccaggcagagttgacattgctggaggggtttggtggactcctaagaatcatgaaaccacaggagcatgtttaggaagagatttgtctctggtccctgtctctgaaaggacacagatgctaaatatttattgtcttagatcatggattcctgatacctctcactcaaggggaccaaaagggacccccccgtgttcatcccttgtaaggtgagttcagtctacgttgtctctttccagtcactggatacgtggcaccaactggtcaatgggtgcttggtgccataccctgctcaccctagtctctgcaggccatgtcctgaagggttcctcaggaggtcgggactagggtgggagaggcactatctgagacctgcaatcactcttgttggtcttgagcccattcatttccaaaacatccatctttctccacttcccccaggtcttggttttgagaaacagcaggcatggctgagtgcggtggcttacacctgtaatcccagcactttgggaggctgaggcaggcgggtcacctgaggtcaggagttcaagaccagcctggtcaacatggcaaaagcccatctctactaaaaaatacaaaaatcagccaggcgtggttgtggcctgtaatcccagctactcgggaggctgaggcaggagactcgcttgaacccaggaggtggaggttgtggtgagctgagatcacgccattgcactccagcctaggcgacagagtgagactccatctcaaaaaaaaaaaaaagagaaacatagcaggccttttttaccaggctttttgtgttttgtttgtttgtttggagcatgttaagatttttttaagatttttaaaattttagttatatccaccctatttcaggttatttttgttggtgtcaagtatgtataggacatgtgaatggttctttttaatttttttttaagaggaaatttggaagataaactccttgatatatatatatatatatatatttttttttttctttagcagcttgttatcactggaatcaaagggaaaaagtgatctcttcttgcattggttgtatttgtatgtcacaaataaaagacactttggtcagctgctgagatggcttcctgatgctggggcaccatgggcagcgtggatctgggaagctctggaccctgagcctgtcccaacattgggcccgaacatcaggaggtgcatagctatgatagccccatgctggagaaaaaactcaggctgtccggggcaagcagccagagctgggaacagagaccaaatgtatgtgtttgtgccacttcccaggagttctgagtagaggccaaaggtgttctgaagggcgcctgctttgcatcttggagagaaagtcccaagccaggccttgtgacatttgaaatctgtgtccaaacgtaaattccagtgcccatgtgtgggaggtgaatagacgagagtgcttctttcctctttgacttcattgggttactcaaaatattctttgtctcttaagattcctgccctcttccatccattcacagaagacaaggctccaaggaaggggagctcatgtcagggctgctggggcaggagagttatgagctggtggaggctgtgaccccctagtgtgacagatggagctgtgcaggttgttccccaagcagggctcctgccagccctggcccgggggagctggagctcagtactttctgtggacagtggaggggctgccccattgtactctgcttggtggtctgcatctgctggaacggggagcaggagaccctgatccacatggagtgttcgtgccctggcagagcaagcatctggggaaagaggagccagggttatacctgttccgtgggtcccagctgtggcatgttgtggcctctcccctgtgggcaggggcacacccgcaggtggtttgtgcagctgtcttatctttgaggcccaaagaaaggcagcacagcccttgggaagggagagcaatttgcctggcgaatcacatggccagtttcccatgtgacagaattctgcccctcaagttatttgttccttgaaggctgtgttttcatcccaggcagaaacttcctggaatggccatccccttgctgaagggtgaatggccacagttggagagcttggggccattccttcatccctgccggctgagtgcagggagagttgaggtctgcacccattcctcctccttctccaccttcacaatggcctgggccctccacagtggctgcttcagtgaggtgtggtgtgacttctgggtctgccccatgctgctgccacagcttcagtgggcaggcggagcaagaggcaccaccgctgagcagtagacagtccagagcctgggctggactgaaagggactatgtccccagcgggagggacgccactcaccagatggtttctgccgccagctttgaaggtagttcaaactagggggcaggcttttctagttttggctagaatactccctccccaagtgcagcagaggttgttctatacccctgaggacagacggggtctggggagaggggatgtgttgctgtggagcctggtgaactaatgtggtggtgttactcccaatctaaggataaattgccagcgccatggctcacgcctagagccccagcactttgggaagctgaggtgggaggattgctttaggccaggagtttgagaccaggctgggcaacatagtgagaccctgtctctaaaaaaatatattttttgattagttgggcctggtggcaggcacctataatcccagctacttgagagtctgaggcgggaggattgcctgagcctaggagtctgaggctgcagtgagctatgattgtgccactgcactccagcctgagtgacagagcaaacaagaccctgttcttaaaaaaaaaaaaaaaaattgcagtcattgtgtcttacgcctgtaatctcagcactttgggaggcctaggcaggcagatcacttgaggccagaagttcgagaccaacctgggcaacatggtgaagccctgtctctactaaaaataaaaaaattaggctgggcgcggtggctcactcctgtaatcccagcactttgggaggccgaggcgggtggatcacgaggtcaggagatcgagaccatcctggccaacagggtgaaatcccgtctttactaaaaacataaaaattagctgggcttggtggcgcatgcctgtgttcccagctacttgggaggctgagacaggagaatcgcttgaacctgggaggcggaggttgcagtgagccgagatcacgccattgtgctccagcctggtgacagtgagactccgtctcaaaaaattaggttggacacagtggctcacacctgttatcccagccctttgggaggctgaggcaggcagatcacgaggtgaagcgatcgagaccatcctggccaacatggtgaacccgtctctactaaaaatacaaaaattagccaggcgtggtggcacgtggtggagaatcgcttgaacccgggaggcggaggttgcagtgagccaagattgtgccagatactccagcctgggcgaagaagcgagactccatctcaaaaaaagaaaaaaaaattagcttagtatggtgatgtgtgcttgtaatcgcagctacttggaaagcagaggctgcagtgagccgagattgccccaccgcactccagcctgggcgacaaagcaagactctctcaaaaagataaatggagagtgaaaagtaacttgctcatgggcccagtagtaaatggcagagccaagatttgaacacagcgtaggaggtgttatccccgtttcacagttaggtaacctgcagcttgggaaagaaaagacaggagcaagccaaggacacccacagctgtgtacctgactaggtcccttccctccctatgctgccttgccccacggcgactgtgagaggcccagcttcttcctgagcaggagctatgggccccagaggcctctcctgccccaccttgctactcctggtgctggggacaagggtggtgtctcctgcttctggcctgcaatgccagggtattatgcagtgctgccctggacaggatgtcggtttctgtgattccatctacgttcctggattcctactatgctgaagtgagcaaagagaaccttagaacctgtattggggctttaggagtctgctgtgggttgttttctttgtttgtttgtttttttgagacaagatctctgtcaccaggctggagtgcagtggcacaatcagctcactgcagcctcaacctcctgggctcaggtgatcctcccacttcagcctcctgagtagctgagactgcaggcatacgccatcacacccagctaatttttgtatttttagtagagagaaggtttcaccatgttagccaggctggtctcaaactcctgagctcaggtgatccacccacctcggcctcccaaagtgctgggattacaggcgtgagctcccaagcctggccctgctgtggagtgttaattctattaaggtgaacatttaatagtccctacggactggcagggctggggctgaggtcacatcatgtggcgctggtgcttagtgcaggccaccccagtgctggagggaggaggccctgagaaatgggaccaggctgggagccccctaaggggtggaggctgtttgactcagagcagggcttggtaggccacagctgggagatcgggagcagggtgagagccagctgtggctgatttggctgttgaaagccaggccctgcacctctctggggtcatgctctgatacaggatggctctgttgcagcaggtgaggctgacgggtggcctggacactagtggctcctgtccggctccctggccctgagcccctcagtggtgacaaaggactaggcagccacgtccactgaggatcgtagtgaggtctcaagccgccaagtgcaggcactgtggatggcgtggggcagcacatgcccttgaagttggtcatgatgtggaactgcccccgtgcctagctcgatgcctggcaggtgggccacacgggtgtcacatgtgggagctgtggggggaccgctcctgtggcggcccctctcctgaatgttggatatatgggatggggaaaggtggggtatgtggctggaggggtccagggatggggcactcaggctagagccctctgagggtcctggcagtgagattggtgtccaggaacatgaaaaggagtggggacctgccctaagctgatcaggggtccagaaacaagagaggcccatgggtattggagctatgagcgcaggctaggggctcagaaggcagaggggcctggatgtggttccagcctggtaggggtgagtctgggggccagcccatgatggagggaaacgtggcctgagaagccagtcttcaccaagctggagccaccgtcccacatgggtgcaaatgcggtgatctcgcccttaccacacagggctgctggctgtggactgcgttccggaaggggttaaccaccacaggctctcggcaggcccgcccagccctcagcttgcacccttccctcccgctgctggaaccctggggtgccccagccagtacagctgtgcctgcctagagagcaacccctccacccccaaccccgcccccgacagctgtgtctgggcctgtcccctggatgcctggcaacagctgtatcccaggaagagcaaacactcctctaagatccttgtctctgtcccgccccctcccttgaccgttgcctggttaggtttcccaaactagctcttccagtgatgccgtctctccctccatcttctcctggagtttgcattagcgcccccattttgcagatggggaagctaaggcccacggagggaaaggtgcattctcgaggtacccagcaccccagtgttaggcctgtatctccttccccgaggcccttgttcaccctccacctctgggcactgggcccttcctgcagcttcactagagtctcctgctgctgccgtcaccccaagagtcattccccacccacaggcagatgaagaggccccagctgccctctgaaagcacagggctggcttctttgcatcctcaccatgcagccctcctggccagccccagggctcagtgcctggcacccacctgatgtgccaggaggagagaccaggccaggtagggaaactggatacccaaagctcaggttcttaccagctccagatcagatgctttgggaggtggcaagctctagaaagtgtgcagaggaggggcagctgagggttcttacctgctggcccctcaggactggggtgcagctccctccccaggcctcgcagttccatatttggacaagagcagctgctggtccagagcctttcatggggagagggccaggcctggggtggggagacccagtgtttgtccaggccatgtgtaagcagtgggtctgggggccgcctctggggtggggcacctggtatgacaatcagtgacaggaagcctggaccagctcccctacccatcgccaaggcttgggatctattcctagtgccccactcaggagggaacaggttgagcccggggatcagagagaccaagggctcaagagatttaggtctcaccccttagtagggagggactccctagcaagcaatcggagcgtgggggcagtcccaggcgggggaactgagctccccgtctttgcaggcagcacagcagctgtccagggtgatagagggggtccctgtcctgtggaaggttcctgtcacagagagcctgtcaccacatggggcacacctccctcattggaccaacaaacccccctctccttgctcgtttattattttgagatggagtcttgctctgtcacccagcttggagggcagtactgcgacctcggctcactgcaacctctgcctcctgggttcaagggattctcctgcctcagtctcccgagtaactgggactacaggtgtgtgctaccatgcccggctagtttttgtatttgtagtagagatggggtttcactatgttggccaggctggtctcgaactcctgacctcaggtgatctgcccacctcggcctcccacagtgctgagatcacagacgtgagctactgcacccaggcttgcttacttttaagcagtaagaattgccctaggctgggcatggtggctcttgcctgtaatcccagcactttgagaggccaaagcgggtggaatgtctgagctcaggagttcaagaccaggctgggcaacatggtaaaaccctgtctcttctaagatacaaacattgttttgtaatatattacaaaatatatacaaaaaagtatattattgtaatatacaaaaatgtttttgtaatacaaaaatatatactctgcccaggtgggaggatcatttgagattaggagttcgagaccagcctgggcaacatagcgagacctcatctctactaaaaataaaaaattagccaggtatggtggcaggcgcctatattcccagctgctcaggaggctgaggcaggagaattgcttgaacccagggggcagaggttgcagtgagctgagatcttgctactgcactgcagcctgggcgacagagcgagaccccatctccaaaaaaagaaaacgagaattgccatatatggaatcttggaaatacagtagagacagaccaaaaatgacctactttcccgccactatctagagaacactagtggtcacaatttgtatgtgtccttctagatttttacatgcatatctatttctctatttgtctattttagcaaaacaagatcatatggcatgttattttcccctgctttttcttgtctatttttattgttattttatttatttatttatttatttatttatttatttatttattttgagacagggtcttgctgtgtcgcccaggctggagtgcagtgatgcgatctagtctcactgcaacctccaccttctgggttcaaatgattctcctgcctcagcctcctgggtagctgggactacaggcacatgccaccacacctggctaatttttttatttctagtagagacggggtttcaccatgttggccaggttggtctcaaactcctgacttcaggtgatcttcccgccttggcctcccgaagtgctgggattacagggatgagccactgcgcctggccttatttttaaaatttatttgttttgagacagagtctctctctgtcacccaggctggagtgcagtggcatgatctgggctcactgcagcctctgtcccccaggttcaagcaattctcctgcctcagcctcctgagtagctgggattacaggcacctgccactgtgcctggctactttttgtatttttagtagagacaggtttcaccatcttggccaggctggtcttgaactcttgacctcgtgattcacctgccttggcctcccaaagtgctgggattacaggcatcagccaccacacccagcctggccttatttttttgagacagggtctcgctctgtcatccaggctggagtgcagtggcgcaatcatagctcactgtagcctcaccctcctgggctcaagcgatgctcctgcctcagcctcccaagtagctaggattacaggtttgcaccaccatgcccggctgattttttgtttttagtaaagacaggagtctcgctatgttgcccaggctggtctcgaactcctgatctcaaatgatcctcccacctgggcctcccaaagcattgggattacaggtatgagccactgcatctggcctgtcttgtcaaaaatttttaaagtttttaattgaagtgtaacatacatacagaaaagtgcacaaaccgtgaaagtcccaccactcacaatggactcatcactaagtgaacagggtgaccagcatccagaagccaatcatgcctctttttggccccctgtcttccctcttcccctggggtccccaccacctgactcacacctcgtggctcagacctgcttgctgttgggctttgtataaatagaagcatgcagcctgtgctctttcatgcctggcctctcccctcaacattgtgggatccatccgtgctgcagctggagtttgttcattttcgctattctgtcacatttcattgtataaatgcaccatacagtctcactgctcttttgttgaaggactgtgcctggattctgggaagggttggttgctgggagggatggggaaagagcagagaccttggtattaatccaacagacagacctaggtacaagccctgcctggcactagcagactcagctgcgttatggaacctgtctgccagcctctctttcctccactgtgataggtgttctgagagaaatgcatcacagaggcctgaggaaagccctggaacacagcacaaacaaaaagttcagtttcccagcgccagaaagtccccatcacctcctagagtatccccaggccccttgcctgtgttggggctcaggacacaccacttcaaaatgtgactgtaggagaccagaatatcccaccctgaaatatgctactttggcatattttgagctggttactcagagaaactgcagacctaagagaagctctgaaaagctaacctttttaatgtcttaatttttttgtgtgtgagagagacagttttttgctcattgtccaggctagagtgcaatggcctgatctcagcttactgcaccctccgcctcccaggttcaagcaattctcctgcttcagcctcctgagtagctgggattataggtgctcgccaccatgcccagctaatttttgtatttttagtagagatggggtttcaccacgttggccaggctggtctcaaactcctgacctcaggtgagctgcccagcttggcctcccaaagtgctatgattacaggtgtgagccactgtgcctggtcctttttgagaaaaaagcatttttatctgaagaaagtaaatcaattcattctatctatctaatctatctatctatctatctatctatctatctatctatctatctatcaatcatctatgtatctgagacagagtctcgctctgttgcccaggctggagtgcaatggagcaatctgagctcactgcaacctctgcctcccaggttcaaacgattcccctgcttcagcctcctgggtagctgggactacagatgtgtgccaccacacctggctaatttttgtatttttagtggagatggggtttcaccatgttggctaggctggtcttgaactcctgacttgaagtgctgggattacaggcatgagccaccactcccagcctaaggaatgtaaatctttttaattactaggcccagagagatattaacatgagacagtaattaatcttttgagctatgtgttcatctcttgaaacttcttactattgccacaagtagctacacattaacctaacagtgccacaccagacactataacccataccctataatgtaacactaaccagcctcatttctataaaccaatattccttacaaacaacattgtgttacaggaaaggagtcccaatccagaccccaagagagggttcttggacctcctgcaagaagtaatttggggtgagtccatagcataaagcgaaagcaagttgtttaagaatggaaaggaggctgggcgcggtgcctcatgcctgtaatcccagcactttgggaggccaaggcaggcagatcacgagatcagaagttcgagaccaacctgatcaacatggtgaaaccccatctctactaaaaataccaaaattagccatgcgtgatgccatgcgcctgtaatcccagctactcgggaggctgaggcaggagaatcgcttgaacctgggaggcagaggttgcagtgagccaagattgtgccactgcactccagcctgggtgacagagtgagactccataatcagtcaatttaggctgggcgtggtagctcacgcctggaataccagcactttggaggccaaggcaggtggattgcttgaggccaggagtttgagaccagcctgaccaacatggtgaaatcccgtctctactaaaaatacaaaaattagccgggcgtggtggcgcatgcctgtcatcccagctactcaggagactgaggcaggagaattgcttgaacctgggaggcagaggttgcagtgagctgagatggcgccactgtactccagcctgggtgaagagcgagactgtctcaaaaataataataataaaacaaatttgggctgggcacagtggctcacgcttgtaatcccagcacttcgggagggcgaggtgggtggattgcctgaggtcaggagttcgagaccagtctggccaacatggtgaaaccttgtgtctattaaaaatacgaaaaaaactagccagccatgatggcatgtgcctgtaatcccagctactcaggaggctgagggaggggaatcgcttgaacccgggaggcagaggttgcaatgagccaagatcgtggcactgctctccagcctgggctatagagcaagactctgtctcaaaaaaaaaaaaaaaaaaaaaaaagcctaacctattgagagtgcagcctggcaggtctcagctttattttacccagcccctactcgagatggagtctctctggttcaaacacctctgacaattgtattggctcactccctgtccccccttttaagttgttactttattattattatttgagacagggtctcactctgtcactcttgcggtggcatgatcatggctcacagcagcctctatctcccaggctcaagcaatcctcccacctcagcctcccaagtagctgggactacagacactcacatgtcacaccattatttttttgtagagacaagggttttactttattgcttagtctggtcttgaactcctggtttcaagcgatcctcctggctccctatcctacttttttgcctttaaaaatccacttataggtcaggcacggtggctcacccctgtaatcccagcactttgggaggccgaggtgggcggatcacgaggtcaggagatcgagaccatcctggctaacacggtgaaactccgtctccattaaaaaatacaaaaaaattagccgggcggggcgcctgtagtcccagctactcgggaggctatggcaggagaatggcgtgaacctgggaggcagagcttgcagtgagctgagatcgcccccactgcactccagcctgggtgacagagtgagactctgtctcaaaaataaattaaaaaataaaaatacaaaaattagccgggcgtggtggagggggcctgtaatccaaactactcgggaggctgaagcaggagaatcgcttaaacccaggaggtggaggttgcaatgagtcgagatggtgccactgcactccagcctgggcgacggagccagagtccgtcttaaaaaaaaaaaaatccagttacaactgctgctaaccagagtgtatattcaggataactggattctatgctcccaggttataatcatcaaacttggcccaaataagctctctgcttatgttaattttgtttcagcttcttccttttaggttgctattttgtaatttacatgcataatggaaattatattacgcttacattggtaagagtatcttatatcaggaagagggctgctccagacaaccttttttttttttctttttttttttgagacagagtcatgctctgttgccaggctggagtgcagtggtgcgatctcagctcactgcaacctccacctcccagtttcacgtgattctcctgccttggcctcccgagtagggactataggcacgtgccaccacacccagctaattttttgtatttttagtagagacggggtttcaccatgttggccaggatggtctcaatctctggacttcgtgatttgcccatctcggcctcccaaagtgctggggttacaggcgtaagccaagcctggcccagacaactttgatcaccggagacttcatctgtgtaacaagacggcctttattcaccatacacatcctcccctcaccctcataacccctgagaactcccatcccctgtttctttctgtagctcaggatgctatataagcttcagtcatctgacccttcgagctacatgttttttggtactcccttgtgtatgtgtattagggttctctagagggacagaactaataggatatatgtatataaaggggagtttattaagtattgacttacatgatcacaaggtcccacaataggctgcctgcaagctgaggagcaaggagagccagtccgagtcccacaactgaagaacttggaatttgatgtttgagggcaggaagcatctagcatgggagaaagttgtaggctgggaggtgaggccagtcttgtcttttcatatttttctgcctgctttatcttctagccccactagcagctgattagatggcacccacccaggttaagggtgggtctccctttcccagcccagactcaaatgttaatctcctttggcagcaccctcacagactcacccaggatcaatacttcgtatccttcaatccaatcaaattgacactcagtattaaccatcatagtatgcatctaattagaaatggtttctcacctgttgatctgtcttgtcaatttagttcatagtccagccaaagaacctagaggtgtggagggaagccgttttcctcttgcctacacctgactgtgctctaattggggagttattcctttgtttcccagtgccagacaagcccaggagggcagcagggaggtccttgccccttccttctcccagtggcagccagctggggcctgggcctcttaaccctgtgcccctagggatcgggaagggagtttagaagcatctgtcctgggctgtttgctagggctcagtgcagggcaagaacagggacctggtggttgtgggtggggttgggctgagattgctaagaatggggccgggcacggtggctcacgcccgtaatcacagcactttgggaggccgaggcaggtggatcacttgaggtcaggagttttgagaccagcctggccaacatggcgaaaccctgtctctactaaaaatacaaaaattatccaggcgtggtggcgtgcgcctgtaatcccagctactggggaggctgaggcaggagaatcacttgaacccaggaggcagagtttgcagtgagctgagatggtaccacggctcaccagcctgggctacagagcgagactctgtctaaaaaaaaaagtgctcgctttggcagcacatgtactaaaattggaacgatacagagaagattagcatggcccttgtgcaaggatgacacgcaaattcgtgaagcgttccatatttttgaagggattacaaaccaagagatacaagtggcttctagaaattagaaaataaaaggtaatggattctgccctggagccgtgacaagaaatactggccttctgacatcttgattttatatttctgatctttagaactgtaagaaaatgaatttgtgttgttgtaagccaaaagcaaacaaacaaaaaactagaatggggtggggaaggtgagggagcgatgaagagggatgagcttggggcctgggaacacatccctccagaggaagctcagacacagctccccttctagggcaccgcgagttcattgcaaccttgctgtgacaccacccccccgccccaccaccatggaagagaaaccatgggctgaggtttctcttccaaagctcctgtttctcaatctcttgccatcccatcgccaccccctgccacagcctttgatgttattaacctcaatgtcaaaactggaacttctgggaagtccacctctgcagcagcatgtgtggtggctaaaagcatggcttttggaggcaacagaactgccctgtaatcctggcaaggcagccttgtagcttcatgatcttgatcaagtcacctgactcttcaggcctatttcctcatttgtaaaaaattcgaaatagggcaggcgcagtggctcccgcctgtaatcccagcattttgagaggccacagtgggaggattgcttgagcccaggagttcaagactagcctgggcaacatagtgggaccctgcctctacaaaaaataaaaagccaggtatggtggtgtgtgcctgtagtccccaactactcgggaaactgaagcaagaggatcacttgagcctgggaggtcgaggctgcagtgaggtgtggtcgtgacacttcactccagcctaggcgacagagcaagacactgtctcaaaataaaataattgaaataataatagcatctatttcatgacattattgtaaacctggaatgagattgtaccattaagacctggcccaggggctggtcccacaccccctttctcatgtgccttctacctagttcaatactgttcagcctcctgcagtttataaacattctgagtgtctggttggaaacagtggtgaaccaacacaggctctgccctcaggtggcccctagtcttgatggagacccaccatgtggggcagggctgacacaggtgttgctgggcacagaggagacacaggcttggggtgaccagcgaaggcatcctgagtagtgccaccccacatatcttcctagcacatcatggttttattttcaccgtgacacttacacaatagtttctaattaagtgcctgtttattgtctgttttttccctccagaagtcagctttgtgacaagaaactctatccacctcgttcatactggtgtctacaatagttcctaacacacagtagaggctaataaatattcactgaataaagtaagtggtatcattaactggaagccaggaagcaggagttagcatggtgaaaaaggcagcctgcataggagctgaaaaaatgaacataaaatgcagaagcaacgccgggcacagtggctcatgcctgtaatcccagcactttgggaggctgaggcgggcagatgacatgaggccaggagttcaagaccagcctggccaacatggcgaaaccctgtcgctattaaaaatgcaaaaattagccgggtgtggtggcatacacctgtaatcccagctgcttgggaggctgaggcaggagaatcgcttgagccagggaggtggaggttgcagtgagctgatattgcaccactgcactccagcctgggtgatgcatgtctcaaaaacaaaacccaaagtgcagaggcaaggccaggtgccctgacaaatgcctgtaatcccagcactttgggaggctgatctgggtggatcgcttcagctcacgagtttgagactagcctgactaacatagcaagacccccctccagctctacaaacactacaaaaattaggctgggcgctgtggctcatgcctgtaatcccagcaccttgggaggccaaggtgggtggatcgcctgaagtcaggagttcgagaccagcctggccaacatggtgaaaccttgtctctactaaaaatacaaaaaatagccgggcatggtggcagatgcctgtaatcccagctactcaggaggctgaggcaggagaattgcttgaacccgggaggcggaggttgcagagagccaagatagtgccactgcactccagcctgggcaacagcgcaagactctatttcaaaaaaaaaaaaaaaaaaaaaaagccaggcatggtggtgggcacctgtaatcccagctacttgggaggctgaggtgggaggttggcttgagtctgggaggtggaggttgcaaggctgcagtgagccgagatcacaccacactccactccagcctgggcttagagctagaccttgtctcaacatcaataacaaaatgcagagtgcattttgaatgcaacaaaaggcttgttggtggaaatcagagagcagggtcgaaggtgtggaatattgaagagttttgagagttgaggctggacagtgacatccgggaattgggattttgactaggaagcaatggggagccactgaaagtatatgacttggtcagatttaggtttaaaaaaccaagaaggaagggatgggggagggagagagagtgatagggtaggaaggaagggaagttggctgctccagcatggtaactggaattgaagagtgtaatagtaattgagggaggtttggttactaggtcagtgtcaggaattctcaacaaaaacgacggaggcctggtggagaggaggggactctcaatagagagatttttttttttttttttttttgagacggagtcttgctgtgtcgcccaggctggagtgcagtggcgtgatctcagctcactgcaacctctgcctaccgggttcaagcagttctcctgcctcagcctccctagtagctgagattacaggcatctaccaccatgcctggctattttttgtattcttagtcgagatggagtctcaccatgttggccaggctgctttcgaactttttttattgttgttttttatttttgagatggagtttcgctcttgtggcccagtctggactgcaatggctcaatctcggctcactgcaacttccgtctcctgggttcagcaattctcctgactcagcctcccgagtagctggaattacaggcgcccaccaccatgcccagctaatttttgtatttttagtagagacggggtttcaccatgttggccagtctggtctcgaactgttgacctcaggtgatccacccgcctcggcctcccaaaatgttgggattacaagcgtgagccactgcgcccggccaatttttgtatttttcgtagagatggggtttcaccatgctggcaagactggtctcaaactcctgacctcagatgatctaccggccccggcctcccaaagtgttgggattacatgcgtgagccactgcgcccggccaatttttgtatttttcgtagagatggggtttcaccatgctggcaagactggtgtcaaactcctgacctcagatgatctacccgccccggcctcccaaagtgctgggattagaggcgtgagccaacgcgcccagcccgtacttttttttttttagtacagacggcctcccaaaagttctgagattacgggcgtgagccaccacgcccagcctgaatagagagagatttaacagtatgaatgaagggaggagtcaagaacagtttaggcttctcgcgtacatgattgggtggccccagatgtcattcacaagtataagccttggaggcggaacataactcgaagaagagcccttttgtgctccgcccatagcgtaggaaggtgtcaattggctgtttcgaggaacgcgccaaaaactgccaagggctgtgggaggtgtgttcttgcgtcatttccgagagacttccgcgccgcagtttccctgcttccccagctccagaacttccggccagcgcagccattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggtgaggaacgggcctggaagagcgcgggaggcgccgtgggctgaccccttctgcctagctgacctcaggtggtcctgagaatgcctcgcgccccgcagcgtagcggggagcagcagtgccggtttgggcatgtctggagggcgcgaacgacggggacagtgcccgggcgacagtcggggctgtcggcgttaggtctttccccacagccccaggatctcgggtctggtcctgtcaggccctccctctcctgtcgcctcctcgctgcgccgcctcctgccgacttctttagccgctctgagcccattttctcgttggttcactgggggatgcctgacgctgtcagcgacgaaaatggttgttactgctatttattttattttattttattttacttatttattttgagacgggttctcgctctgtcgccaggctggagtgcagtggcgcgatctcggctcactgcagcctccgactcccgggttcaagcgattctcctgcctcagcctcccgaatagctgggactacaggcgcgtgccaccatgcccaactaaattttgtatttttagtagagacggggtttcaccatgttggccaggatggtctcgatctcttgacctcgtgatccgcctgcctcaacctcccaaagtgctgggattacaggcgtgagccactgcgcccggcctgggagggggttttcaggcaaggaaggataggtatcgttttggagttactggcccatgcaaggatcctgggtcttaacatacaggctttgctttttttgtttgttgtttgtttttttgagacggagtcttgctctgtcacccaggctggagtgcagtggtgcgatctcggcttactgcaacctccgcctcccaggtttaagccaagccattctcctgcctcagtctcccgagtagctgggatcacaggcgcccgccaccactcccggctaattttttgtatttttagtagagacggggtttcaccatgttggtcaggctggtctctaactcctgaccttgtgatccgcccgccttggcctcccaaattgctgggattacaggtgtgagccaccatgcccggcccagaccagctttaaaacaggtttcaataaatcctgcttcctgtcccttcctttaccatctggtggtgcatttctccctgaaccctaaccccagctgtctctccttcctctcactcttccccctccttataactgaccctttacctcaagggttagcgtagctttggacctgctctgtctgctccgtggagcgtggattcctttaacgtgaggatgcggggcctcccacttgcctctgagtcctggctccctgagcggggctttctgctgcctgggaactgcaaggacttagagagcctaggggaatactgactccgaggtgccttctttcttgtgctctgtgtaggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttacttcagaaattcattgtgccttccctcctgcctgggctcatgcctccactggcactgggtggaggtgtggagaagagcgcccggctggctgccctgtggtaggttttgtgtgcctcagctggactcctcgtgtgcttctgtacctttaaatggtgcctggcttcctgggaagacaaagcctgttgtcattgtgcagcttttctggctcatcccctccagctcccttgtttgtgcaaagcccaatgggcgtgtatgtgtctgtgtgtgtgtgtgtgtgtgtgtgtgtgtgtgtgtgtgtgtgtcccactggggctggatcttcagctagaagcctttcctctaaggggccagccttctctggtcttcctttttggtggacttcatttcttaggtgctggtgcccttcctaattgggggtagggactttgcagaatcttggcttttttttttttttttttttttttttgagactgactcctgctctgttgcccaggctggagtgcagtgatgcgatctcggctcactgcaacctccgcctctcaggttcaagggattctgctgtttcagcctcctgaggcattacaggcacccactaccacgcccggctaatttttttttgtatttttagtagagacgaggtttcaccatgttggccaggctggtctcgaactcctcctgacctcaagtgatccacccaccttggcctcccagagtgctgagattacagccactgcgcctggcaatcttgcctttttaatttttttttcaagacagagtcttgctctgtcacccaggctggagtgcagtggtgtgatttcggttcactgcaacctctgcctctggtgttcaagcaattctcctgcctcagcctcctgagtagctgggattacaggcacatgccaccacacctggctaatttctgtattcttagtagagatggtatttcaccatgttggccaggtctcaaactcttgaccttgtgatccaccctcctcgtcctcccaaaatgctgggattaacaggcgtgagagaccgctccgtgcccccgctttttttttttttttttttgaggctagactgcagtggcgcaatcacagctctgtagccttgactttgactgcagccttgacctcccaggctcaagcgatcctcccaccacaggttgtaccccagtagctgggactataggcatgtgctaccaccatgcctggctagtttcatctttttttttttttttttgagactgagtctcactctgttgcccaggctggagtgtagtggaacaatctcgactcactgcaacctccgcctcccgggttcaagtgattctcagcctcctgagtagctgggattacaggcgctcgccaccatgcccggctaatggtttttttttttttttttaagtagagatggggtttcaccctgttggtcaggctggtctcgaacttctgacctcgtgatccgcccacctcggcctcccaaagtgctgggattacaggcatgagccactgcgcccagccatacctggctagtttcttaaaacattttcttgtagagatggggtcttactatgttggacaggctgatcttgaactcgtgggctcaagtgatcctcctacctcagcctttcaaagtgctgggactacaggtgtcagccactgcgcctggctgcttgcttttttttttttttttgagacagagtctcgctctgtcgccaggctggagtgcagtggtgtgatctcggctcactgcaacctccgcctcctgggttcaagtgattctcctgcctcagcctcccgagtagctaggactacaggcgtgtgctaccacgcccagctaatttttgtatttttagtagagatggggtttcatcatgttggccaggatggtctcgatctcttgaacctcaatatctgcccgcctcggcctcccaaaatgctgggattacaggcgtgagccaccgccgccggcccctgcttgctttttaaatgtcaactccagggcccctttccttctaacactttccatacatggttatggactaattgtctttcttcattctatctgccagcttccctttctcctcctctgtttgacttggggaatctgccattcctctgtccccaggagtccttcctcagtgattctttctcctggtgtgtgaggggcaggaagtacctcagcaggggcaatgttcccaaacactgcacgctgagctggagtcctgattgccagcatctggaaggaatactcggacctgccgggtcccaccctcgaggaagacatggctttacctctcctttgcatcctctttgctggggtgacttggttgatttctgaaaagacacaggttcagtctcccctgtggagctgaggctgccaggacgcctgtgcctggaacattgggcaaagatgtcaggtgagaggggagggctgtggttggcctcaggccctgagtgtctgaacacacgtcttcctagctcctgttctgcaggttgtttcctgatttatgttgacagagctgagggtggacctgactctcctgccgtagcctggtcttgcttggcttttctgcgtgatgcccagggaagcctgtggggcccagtgcctgataccgtactgggtttagctcctgccatagctgtttccctgagcgttaggaaattgtcctctgcctcctaggtggctcctttccttccacacaagccagactttgtatatgaggctgaagggtcagggcctagttggagggccggggagaagctgcctgggcctgttgcccctagtggggttcagaatgctgcaggtgtgcccggtgggagcatcggccagggaggggagagcctatgttggatctggagccaggatggggtactgacctaggagaatccacctgccacatacaggtatcacaacaggtcccttgtttctggatggagggtcctcatggccatcttccacacaacaggaccaccccttgttctgtgcatggttctgggaggcttttctgcttacattagtccctgtggaggtgggacctgagcgccccctgactgtcctctcaggcccatctcctggcctggctggcagctccctggccctggggaccagccactgcggtgtgggaggccggggcattcccaccaagcctgcacttcttgagtagagggccctgagtgtcctggcccttggttgactcagggctgctttcctctggctgtgggcacagatgaggtgctggtctcataaccacggggctgcacacagcaaggacgtggcactggaaaaagtgtgatcttgagtttttctttttttttttttttgagacggagttttgctcttgttgcccaggctggagtgcaatggcacgaccttgggtcattggcaacctctgcctcccgagttcaagcgattctcctgcttcagcctcccgagtagctgggactacagacatgcaccaccacacccagctaattttgtatttttagtagagatggggtttctctatgttggtcaggctggtctcaaactcccgatctcaggtgatccacccgccttggcctcccaaagtgttaggataggcatgagccactgtgcccagccttcttttctttctttcttttttttttttttgaagacagagtcttgctctgttgtccaggctggagtgcagtggcacgatcttggctcactgcagcctccgcctcccaggttcaagcaattctgctgcctcagcctcccaagtagctgggactataggcgcaggccaccacacctgcctaatttttgtatttttagtagagatggggtttcaccatgttggccaggctggtctccagctcctaacctcaggtgatcctcctacatggacctcctaaagtgctgggatcacaggcgtgagccactgcacccagcctgttgtcttgagtttcttttctttctctttttcttttttttttttttgagatggagtcttgctttgtcacccaggctggagtgcagtggcgccatctcggctcactgcaagctctgcctcccgggttcatgccattctcctgcctccgcctcctgagtaactgggactacaggcacccgccaccacgcctggctaattttttgtgtttttagtagagatggggtttcactgtgttagccaggatggtctcaatcccctgacctcgtgatctacccgcctcagcctcccaaagtgctgggatcacaggcgtgagccaccgcacccagcctgtcttgagtttctatggtaactccactgccctgctaagggtttgattgggtgtcctccatttttgtgcccctggaattgaatgatgggtgctggtccccctccgaggaggactgctccagcccaaagtttgattgattgagccactgccccaacctgtgcaacaccaatggctccaggcaagtccttcaggaccctggtctgaagaagccctcagcaagcccagcagttcctccagcccctcttcctcccacaacctgccatgtcctgcatttgtggggatgggtggggtgatgtatgtaggggtgggcaggacagtgtagagtttgagtgacctatcacgtttgaaccccaaactccttggtcccctgtgtggccattaggtctgaaatccggtcttccactggcctacccttgtccccaaccaattcagggccctggagcaattctctatagagaaagcaaggatccttataccccaaacattttctgtgtccacatgtgtgggtttctgtgcctggtgtgcatgctgactggagaggctaaagtcccggcaggtgctgtaatgtcaggaacagtggtctgggagtggggaggcttgggcttgaggcctggcatggccactgaactgtacgaccttgggcaagtcatctggtctctgaatctcagttttgtaaaatgaagatattgtggcagacagaataatggccccccgaaaatgcccatggtctactccctggaaccagtgaatatgttatcttacatggcatgggggctttgtagatgtgaataaggtcatgaccttgaaatgaaaggctatccttggagatccaggcgggcgcaatgtcgtcataagtcctgaagtgagaagcacttagcctaccgttgctggctttaaggacagaggaagcgggccatgagccaaggactgcaggggcctctagaagctgggaacagccctcctttacagccagcaagaacatggggaccttggtcctaccttctgccaacccgaacgagtaggaagtggatctcctttagagcctctggaaagaaatgcagcctgcagacaccttgattttagtctggtgaaacccagacttctgacctcctaaagtgtaagagaggctgagcatggtggttcacacctgtaatcccagcactttgggaggctgaggcaggtggatcacgaggtcaagagatcgagaccatcctggccaacatggtgaaaccctgtctctacaaaaaatacaaaaaattagctgggcgtggtggtgggtgcctataatcccagctactcaggaagctgaggcaggagaatcgcttgaacccgggaggcggagcttgcagtgagccgagatcgcaccactgcactccagcctggggaaccgagcaagactccgtctcaaaaaaaaaaaaattgtaagagaataaatttgtgttgttttaagccactaggtttgtggtgactcgttacggaagcaataaggaaagtaatgcatcatgtggtgctgtgaggccctggggagggtctgggcccagctgctgggaccgtctgcaggcataaagtgaagtgaatgtacagcacttacagtgggtgccccagcgaggactggggtggtgggagttgcttgggaggggctctgcctgcattgcctctgcccctctgcttgctttcggccttaggaggtctgaatcctgcaggtgactcacagcccaacttatggccctgaggcatagaccctgctctgccgcatcagcctttgctgctgtcaaagcctccctagaccacgatttcagggctgctgcctggagactctcgtgggtacaatgcaaggtttatgtgggggccaagcatgcccctactcccgctgtctgggcagctgcccgactcccaagcctgcaccgagaatggtcgcctaatccccatgtgtggcccacccttccaggctttgggctggccacaccttcctgtgaggactgtggctgttccagggcccatgccatgcccctgttgtcttggtccattcagcctgactcccttccctgagaggcagaggcagaagagattgggtgggtctggagccatgtggccccttggggcctctgggctgttgtgtaaacttcctctaaggctgaagtttcacagtccctgagtcccactatggggtctcctcccctccctccacctgatggaatcccatggacatggatgtggggtctgggcaggcaccagtctggcaggttggtgtgaggaggcatctgtgctatgttggcactctggctgctacctgtcacctctgtgactgtctccgacatgcagcctcaaccaagtgcctgtgctgcctgtgtcattacaggcccttgacaggaaggaccagcagcatgggaccatttccagggtggcaaactggggagcagagacaaatgtctggggctgtgccaggggctcctggcgaatctgcagatgggttttattttaattttatttatttatttatttttcttgagacagtttcacctgttgcccaggctggagtgcagtggtgcagtcacggctcactgcaacctctgcctcccgggttcaagtgattctcctgcctcagcctcccgagtagctgggattacaagcgcccgccaccgtgcctgactaatttttgtgtttttagtagagacggggtttcaccatcttgaccaggctgatctcaaactcctgacctcatgatccacctgtctcggcctcccaaagtgctgggattacaggcctgagccaccatgcccggccaagggttttattttttttattttttgagacggagtctccctctttcgcccaggctggagtgaagtggcatgatctcggcccactgcaacctccagcccctgggttcaagcgattctcctgcctcagcctcccgagcagctaggattacaggtgcctgccaccacacccagctactttttttgtatttttagtagagacggggtttcaccacgttggccaggctggtctcgaactcctgacctcaggtgatccatccgcctcagcctcccaaagtgctgggattacaggcgtgagccagcgagcccggcctgcaggtgggatttagatgattcaggatagagaaccaaaatcctcacacagtaaaattaacaggacagatggaatgaggataagagaacagttatttacttatttattattattattatttttagatggagtctcgttctgtcgcacagactagaggagtgcagtggcttgatctcggctcactgcaacctccgcctcccaggttcaagctattcttgtgcctcagcctcctgagtagctgggattacaggcgtgcgccaccacagccagctaatttttgaatttttggtagagacagggtttcaccatgttaggctggtcttgaactcctgacctcaggtgatccacctgccttggcctcctaaagtgctgggattacaggagtgagccactgtgcctggccaagagaacagttattaaccaccaaataaaccatcattgaaaagagctaggcaaggccaggtgcggtggctcatacctgtaatcttatcactttgggaggccgaggcaggcggatacctgaggttgggagttcgagaccagcttgaccaacatggagaaacctcgtctctactgaaaatacaaaattagccaggcatggtgctacatgccttaatcccagctacttgggagtctgaagcaggagaatcgcttgaacccgggaggcagaggttgcggtgagccgagatcgctattgcactcctgttgctgggactacaggtgcatgccaccacacctggctaattttttttttaatgttttttatagagatgcgggggtgggtctccctgtgttgcccaggctggtctccaatgaaattctcccagcttggcctcccaaaatgctgggattacaggcataagccaccacacccagccatctttgctatttaaaaaattaaacgtggctgggcgcgatggctcacgcctgtaatcccagcactttcagaggccgacgtggccgggtcatgaggtcaggagatcgagaccatcctggctaacacagtgaaaccccgtctctactaaaaacacaaaaaattagccgggcgtggtggcgggcgcctgtagtcccagctactcgggaggctgaggcaggagaatggcttgaacctgggaggcagaggttgcagtgagccaagatcgtgccactgcactccagcctggatggtcagagagaaactctgtctcaaaaaaaaaaaaaatgttaaacgtaatttttagataattcacagggaacttaaagaagttataaagaggccgggcgcggtggctcacgcctgtaatcccagcactttgggaggccgaggcgggcggatcacgaggtcaggagattgagaccatcctggctaacacggtgaaaccccgtctctactaaaaatacaaaaaattagccgggcgtggtggcgggcgcctatagtcccagctactcgggaggctgaggcaggagaatggcgtgaacccaggaggcggaggttgcagtgagccgagatcgtgccactgcactccagcctgggcgacagagcgagactccgtctcaaaaaaaaaaaaaaaaaaaaaagaaattataaagattccatgtatcctttactcagtctcccctgcccccactaacatcttgcaaaaatgttgtgaagcatacaccaggatactgacagagtcagggtattgcgcatttccaccttcacaagaatccagactttccctttcacagccacatccacttccctccagcacctccgcttgactcttggcaaccattattttccttttttgtgaagtctttgcttttataaagaccctgctttagtggtggctcgcggctggagtctcagctactcttcaggcagggcccgaagatcgctcgtgcccaggagttcgagactaccctatgcaacatagcgagaccctttcttttctttcttcttctttttttaaaggtcctgctttaaaaaccagaaggacacagagcccaaagttaggtcatgaggctttggccttgacaccaagggatgctgtctccttgccggaagcagctcaccaaagccggcagagaacccaggttccgtggggccacgatgtggggctccgcgggcgccccggcgctggccgacttcctgtctcctgggtcagatgctgctccgcactgcagctatggtcgcatgcagtgcctgccgaagcccgcagcaggaatgctgccttcggtgattttaatttcacttttctacttctctcaataacaaaatccgcgtttcaaactccagggaaaagaaaacggaattggctccaggaggatctgcaatcaccaccgggaactttgggaggctgggaagatggagccaaaccaatgtgtggggtggaggtgcggatctggggcggccggcctctcctacaggtctcaggtccgcaggcctggcgtgccagcacctgccacgggactggaagcccattccttgacaacgcctaaggggatcccgttgctagggctgttgccaaggcggggcaacgaggaggggctcgcttccgggaggacggcaattggcaacccggaagcggtcggtagtgcggcgctgtttaaagatggcggcggaggaacctcagcagcagaagcaggagccgctgggcagcgactccgaaggtacagatccaaggagggatgtccggcccgggctagtgggggcgatgccgggccagctgctcccgaggagggaggggaggcagggccgctggctctggggtcgaggtgcgcgaggggtcccttcctccacctccgctgcctcccctccccctcacaatggaaggagccaccgccgcgacccccggccgggagggagcacgggcgaggcgggccaaggcccgcggcccttctccatcgtgtgcgcccggggcggggcctgggtcgctccgccctctgcccaacccctcggctcctggctccaggggccccgagccctctcgcccctgtccttgcagtcaggcagagaggcctacgccagggccgagccccccggcctgctccagcggcggcccgcgccgtgagggcctcgagtttcgctgggctacggagcacaaaggtccgggcgggccattcgggatgtcgtaggcggccctgggatgtgaggggcctgcgggatctgtccctgaggcctgcgactttttctggtagagccgcctcttctggccttgcagcccctttccgcctgcctagacattgttagtctccttaggagatgggcctttcaaaaatggtcccactctgtcttttcccgcctatgagttgggccctggggaccgcgtaggtcattgggtggcagggacagttcttttgcagagtagtgcgaaaagggtaggtaggtcgacgcccagccaagaatttgggatggcgagccccaaaagggttgacctttaaagtcattcagcccacgcacctcattctcaccgaacacttgagggaacgagaagtgggaaaacggccccggaagggacttgttcaagatgacattaagagagagccaggactaaaattcaggtgtcctagctcctcaccgatagctgctcacagtggggtccatagggtggacctgcccagctggctgataatcctagagcacgtactggtatgcctctaagaaaggcgagggtactcgccccattttacagttgaggaaaggtctctgccatgtggtagccaaggagaggtattgtgctgaagagctcagcctggaattagacaaacctgggtttgaccgcaggtcttttgctagttgtgaccttgagcagattgcttcacctgtctgcagttgttttgttaattgtaaaatgggcaccattaacaatatccacgaccgcaagaggatgaaggcggtgatggagtaaagtgcaggctcataggaagctctcctccaggccaggactctgcttcctcgtcctactttctgcaagagaccacgcctggccccagaacattcccaggctgctgggaagtgatgttaacgggaggaagggggtgtcagagctgaaagagcgcaccttagggataccacggtgcacctctgccccttcattttaaagatgaggaaatgaaagcccagaaggggaagggactttgccaagatgacacacttgaggtggagcactcctgtaatcccagcactttgggaggttgaggtgggcggatcacctgaggtcaggagttcgagaccagcctggtcaacatggcgaaaccccatctgtactaaaaatacaaaaattagctgggagtggtggtgcacgcatgtagttccagctattgggaaggctgaggcaggagaattgcttgcatctgggacatctgtaacatacctgcttccagattctaagcctgtcttcctgaccctgggctgctcttgtccctggcccagctgcctgcagtggagatggccaggaccccctgtaatctttggcttttttccttttcccaggtgttaactgtctggcctatgatgaagccatcatggctcagcaggaccgaattcagcaagaggtgaggggctgcagtgggcgagggaggcagtggccagcagccccattgtggaaatgcataggctgggcatgaggcctattgtctgtctctactttggaagctccctcctccctaggctatgctaggtactggtgcttttctgggggtcgctgtgccaccgggtgaccagcccagctcttttgtagttattctgtctgttaggcatgggtcactccatctccctgctaggacatgacagatccctgcctcctccagattgctgtgcagaaccctctggtgtcagagcggctggagctctcggtcctatacaaggagtatgctgaagatgacaacatctatcaacagaagatcaaggtgggagcctggccagagcgggtgggaagcaccctgggggtggggcaggagggtgcctgcttcagacttgcttcctgctgggtctgtcacctgagggagtagggtgttggaggacacttttcgttgctggttcttgaagtgcgtaggctgaggcctcaaaaacacattgattcaatgcttgaacctgggaggtggaggttgtagggagccaagatcacaccattgcactccagcctgggtgataagagcaaaacttcatctcagaaaaaaaaaaaaaaaggtggggggcaggcacggtggctcacgcctgtaatcccagcgctttgggaggccgaggtgggtggatcccctgaggtcaggagttcgagaccagtctggctgatatggtgaaaccccatctctactaaaaatacaaaaattagccgggtgtggtggcaggcacctgtaatcgcagctactcgcagggctgaggcaggagaattgcttgaatccgggaggcggaggttgcagtgagccaagattgcagcactgcactccagccagggcaacagaagactgtctcacaaaaaaaaaaaaaagacattgattcaaatctagactctgctactcagcagctgtatccttggcaagtcctttagtgtctctaaaatgggtgttctcatctataaatagggacaataaaagcatcttctggccgggcacggtggctcacgcctgtaatcccagcactttgggaggttgaggcgggcagatcacctgaggtcaggagttcgagaccagcctggtcaacatggcgaaaccccatctgtactaaaaatacaaaaattagctgggagtggtggtgcgcgcgtgtagttccagctattgggaaggctgaggcaggagaattgcttgcatctgggaggcggaggttgcagtgaggcaagatcccgcactgtactctagcctgagcgacggagtaagactccgtctcaaaaaaaaaaaaaaaaaaggcctggcgcggtggcttacacttgtaatcccagcactttggcaggctgaggcgggcggatcacgaggtcaggagatcgagaccacggtgaaaccccgtctctactaaaaatacaaaaaaattagccaggcgtggtggtgggcacctgtagtcccagctactcggagaggctgaggcaggagaatggtgtgaacccgggaggcggaggttgcagtgagccgagatcgcgctactgcactccagcctgggcgacagagtgagactccgtctcaaaaaaaaaaaaaaagcatcttcccatagggcgattgtgagattgagggaggtgcaggctgggcaggagctgatgatctcggtgcccatacgggggctgaccaggctggtgctcagtggggtaggagggttgccagagggctgtttcccacagcttgcctcctggatctttgtggagaggcaggcagcagtggggtcaaggggccacagatttcctcaaagggccctgctgcatcactcaaacggaggcaaacttcaccacccactttctaggtctgtgagctgggaggatgacatgtgaaatggggccaggcatggtggctcaagcctggaatcctagcactttgggaggctgaggccagaggatcgcttgagcccaggagttcaagaccaacccaggcaacatagtgagaccttgtctctccaaatcaaaaaattactgggtgtggtagcacatgtctatagtcccagctactcaagaggctgcggttggaggatcacttgagcccaagaagttgagccatgattgtaccactgcactccagcctgggtgacagtgagacctgtctcttaaaaaaataaaaaaataaataaataaataaataaataaatgtgacaatgggtgtgtggaaacagtatctggtaggctcagtgtaggtgtttagtaaatgtttctcttcccctggaagatgacagatgcttagagtcctctactggtaggggaggcctctgtggccaggtaggtaacccaggtgattgaaggtggccaggaagtcagatggtgaacaaggagggcagcacagctcagtatcagccagacactaatagggagcagaggcccctgggggaaatgggagtgtccataccattgtctccagatctgtttttccaagagaagccagaggtaaccacagctcctgacttctaacagttggcagctaattcaaattttaaatgtgtgggccaaacacacctgcaggccagatccagctgtgtgagatctgtgcactgtgatctactgaggccccctcctcagggagctagatttcctcagggtgcctgtggagagatgaaggcactggctgtggagcctgatgggcctgggttccagtcctggcctcaccactttgagctgtgtgatctcgggcaacaccctgaagctcttggatcccctgttctctctgggcggggacattgtctgcctcacagggcaattgtgagggttgaaggagatgttacgggcggttgtaagcagcgggttacaaagctgctcctctccccatacagggggtgagcttcattcattcattcctcttatgtcagtgtcctccagtgggaccccccatgccaaggcctgccgctcatgctagaccaccctggtaaagtggacaggacaggctgggccccaggttcttcccacggagtcatcaaacatttggatgtccagagcatgctgtctaaaaggcctctctgtgcccccagcacccgcattctgtatgctgtgcctgagcccaccttttctccctgggcagagacagctgtggcagcagagcccaagcagagagagctcctctctctctaaatgggctcttgtgaggatcaattaggatgacgtttattcgccctgtgccaaatccctggcacagagagtgtgctcacaatggccatggtggctgctacagtagcagtggtgatttgggttctttgtggtcctggtgtgctactcatttaacgtttattgagaacggactgtggtccaggcgctgttctaggtactgaagatagagccatgcagacaaagtcctgccctcacaaaacttacagttcagggtggaaagacatgataagccaaagagggctctgggacatgtggggtatcagaaggcggtgagtgctgtggagaaaaatgaaaaggggatcggggccgggcgtggtggctcacgcctgtaatcccagcacactgggaggctgaggcaggtggatcacctgaggtcaggagttcgagaccagcatgactaacatggtgaaacctcgtctctactaaaaatacaaaattagccgggtgtggtggcgcatccctgtaatcccagctacttaggctgaggcagcagaatctcttgaacctgggaagtggaggttgcggtgagccgagattgtgccactgcactccagcctgagtgaccagagcaaaactccacctcaaaaaaaaaaaagaggggattgggagtgggagcatttgccattttaaacagggcttggtgaaggccttgctgatgaggtggtatttgagtaatgaacagaaaaagaccggggagcgagtcacaggcgtccgagagcagtgcccacccaggcccgaggcgagagggcacctggatggtttgaggccagcatggaggccagtgtggctggtggagaatgaggggttggggctggggaactgagcggggcggggcggggtggggtgttgtggcgagagaaaggactctgagggagatggagatagggtgcatctggcaggtgactctggtcacttttctttttttttgagagagagtgttgccctgtcacccaggctggagtgcactggagtgcaatggcaccatctcagctcactgcaacctccacctcccgggttcaagcaattctcctgcctcagcctcctgagtagctgggattacagatgctcgccaccatgcctggctaatttttgtatttttagtagaggtggggtttcaccatattggctaggctggtcttgaactcctgacctcaaatgatccacccactttggcctcccaaagtgctgggattacagatgcccaccaccatgcctggctaatttttgtatttttagtagaggcggggtttcaccatattggctaggctggtcttgaactcctgacctcaaatgatccacccactttggcctcccaaagtgctgggattacaggcctgggccatcacgccaagccgaccctggccattctcttgctggggtgagaataaactccagagggtgaaggggaggcagggacactgccaggagacttgtgcagtaaaatctgctggaggcgggcagcgggtggtagaggtgaggagtaagaagcagttggataccagacatattgaagggatggatatggtgatggagtcggcagcgactggaaggctttgggtgctgtgggtgactgaggtggggcagcctcggggaggagcagttgttcggaggttgatctcagctgcactcagtggaaatgcctgttggacagttcagaggaggtgtggtgaggctggtagataggaggatcgtaattggagttgagagttgagattcacacttggggctatttaaatccttgagactttggctaggggcaatggctcatgcctgtaatcctagcactttgggaggccaaggtgggtggatcacttgagggcaggagttcaaaaccagcctggccaacatggtgaaaccccatctctactaaaaatacaaaaaaattagccgggcatagtggcgcgcgcctgtagtcccagctactcaggaggctgagacaggagaattgcttgaacccggaaggcggaggttgcagtgaaccgagatcgcgctactgcactccagcctggacgacagagcgagactgtctcaaaaaaaaaaaaaaaaaattgcttgagactgatgtcgtcaagagagcaagtataatttacatttttgtagagatgaggtcttgttgtgttgcccaggctagccttcaacttgatcctccccccttggcctcccaaaacactgggattacaggtgtgagccactgtacctggccatgagagtgagtgtagtttcaaagaggaagctggccgggtgcggcactttgggaggccgtggcaggcagatcacatgagcccaggagttcgagaccagcctgggcaatatggtgaaatcccgtctctacaaaaaatacaacaattaaatgggtgtggcggtgtgcacctgtagttccagctactctgaaatctgaggtgggagaattgcttgagcctggtaggttgatgctgcagtgagccgtgatcttgccactgcactccagcccaggtgacatagaaagccctgtctcagaaaagaaaaaaaaaagaaaagtggaagctgtcccaggcctgagcagggcggggtaggcacatgggagacagccctcatgcccgtggtcacatggcaggcacagtggctaagtgtgcagtgactgttttcctttttccttttttgaaacggagtctccctttgttgcccaggctggagtgcagtggagcgatctcggctcactgcaatctccacctcctgggttcaagtgattctcttgcctcagcctccagagtagctggaactacaggtgtgtgccaccacgcccagttaatttttgtatttttagtagagacggggtttcaccatgttggccaggatggtcttgatctcttgacctcgatatctgcctgcctcagcctcccaaagtgctgggattataggcgtgagccaccacacccagcctcagtgactgttttcttgcaggtgacacaccatgtctcgaagggtgctgtatggtttggtggcatccctgaccctcagagcttagagagatgaggagtggccttggaggcaggaggaagacaaggagagggtgggggcgccagcccagggaaggaggcatctaggcagggccacagccagtggcctcagttctgctaaggggccagtgggggtggggcgctgggtttgccccctctgattgagggcgttcagctgaccttggctagagcaaaagcctcccgagggagaaaagaggtggaggcagcacggacagcttcatgaggagttttgctgtaaagaaagcagagaaattgaagggtagccagacagaaacgtaaagtccaggattcccttccttttaaagaagtagctgaatgtgtatatgctgttgggtctaaaccagtagggtgggaaaaattgatgatgggggtacttcctaggatgatgtcttttttttttgagatagggtctcacgcactctgtcacccacgctagagtgtagtggtgccatcacagctcactgtagcctcgacctcctgggcccacacagtcctccgacctcagcctctcgagtggctgggaccacaggatgcaccaccatgtgcagctcacttgcttatttttcaagatggagttttgctctgttgcccaggctggagtgcgatggcgcaatctcggctcactgcaacctctgcttcccgggttcaagcgattctcctgcttcagcctcccgagtagctgggattacaggcatgcaccaccatgccgagctaattttatattttcagtagagatggagtttcgccatgttggtcatgctggtctcgaactcccgacctcaggtgatccaaccacctcagcctcccaaagtgctgcgattacaagcgtgagccatcgcgcccagccacttattttttttagagagacgggggtctcactgtgttgcccaggctggtctcgaactcctaggcttaagcgtcctcccaccttggcctcccaaaatgttgggattataggtgtgagccatggcgcccagcttggaatgatgtgcttgagcctgagggtgggggtgggctagtgtggagtggagaggcagcttaggtggcagctggaacagatcctctgaggattgtgggaggaggccaaaggcagatgtgctggtgggggctgaggaaaaaagacaaggtcatcagctgggggtaggagcaagatgggtaggggagaggggagggtgcccaggccaggggagtgaagtgtgcttgccaggtgaagtgtgcgtggtgggtgggcacctgtaatcccagctacttgggaggctgaggcaggggaatcgtttgaacccgggaggtgtaggttgcagtgagccgagatcgcgccactgcactccagcctgggcaacaagagcaaaactctgtctcaaaaaaacaagtagaggagggaggctgtttctagccccaggagggctgcgggcaaggcttagaggtgggggaactcttctcagtgtggcgggagcggggctgagctgggctgtgcagagggccccagccacctggttgaggcgtggaggccagcactccaccctggccctgacttgcttgccctgaagttctcttgggctgaaagactggaggaaacgcattgctcaaggacattcactcacctgttgttgtacagtcctgtaggccccgcagaactttagtgacccatgcaactagtttgtccttaagtgcccagcttcctgccgtcttttgggaggactctgggcagtgggccgctcccattgccacattcagcagcctgtttcagggacccagggtggcaggtggctgctgggagctcagttgccacctttggagtgtgacctttgctgggggacatttccttggccagcccccgttctggcctgatgttaacctgtcggggtggggctgtctccgcaggacctccacaaaaagtactcgtacatccgcaagaccaggcctgacggcaactgtttctatcgggctttcggattctcccacttggaggcactgctggatgacagcaaggagttgcagcggtgagaagggtgggcactgggcaccgaggcaggtgggtgtctacctcctccccgggcgagtaggatgtgtctcgagtagggtgtctccctccttcccgggcgatgggctggactctggccttgccaggcggggcagtgctgtctcggccctggcgtctgggctggtcgaggagcccatgctgggcccgcctttccatcccacccccaggttcaaggctgtgtctgccaagagcaaggaagacctggtgtcccagggcttcactgaattcacaattgaggatttccacaacacggtgagccctggtgcctgtcttgggctgggccatgggggaggggttcacctggtgaggaccacccatctcctccccgtcatcttgccctttctccctccgtggctgcagttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggtgccgtccccctcccctttactctcggccgggggagtgcagtgggcccacagggcctggggcggggtgcggagaccagggcctgaccggcacctgtgccacaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccgcctctgccgtccgcctgtgcctctgcccgcctggctcaccgagagctcttgccagcccctttcagtgaaagcatctggccaggggctccatccaacacctgggccgccttccttccccccagtcagagctcagacagtaggagctgccacaacgagatctttattaggctcctcgggggcggggcgcggagggaaagaaggggtggccaggcccaggccaggctgcaggctttggcgacctctcagagctgggagcggggtcccgaaggcgggtctgagggcagagcagagtcagaggtgtctatgggcgtccccgacctcccaggctgccccgtggtttcccgccctgcttgggggtgagcgggggttagtgggcgggttagtctagggccggggccgccgcacggggcgaggccctgcttaccagtcccggtcagggtgggctgcgggagcctcaggctggaaggcagaggacagtgagagcccgcccccagggtggaccggggcaggggcgggccgtggggcggcgcggggcacgtacccacggggaagtagtgggggagccggctccggtagatgtcctcgtccttctcgaggaacacgcagatgatcagccggtccacctgcgccaggggctgctcagcctgggccgagctgccacgcctggccccaggatcctgtgactgcctgccctggtgcaggctttcacctgcctggccctgcgcccttcacggaggctcacggctgtgtgccatcacccccatctcgccaccgccaggcgcccttgcgcaggagaaacagggaaggaaggggcgggcctggccctgcgctctgcaccctgactccctgggcgatgatgggggctggtcactctggccgggatgcggaccccaccctcgcccgggcccaggactcaccttgtccttgtgctgctccagccactctcgcagcgtggccagcacgatctcggcggccgcctcacaggggtagcctgaggcgggtggggcgggagtgagtcctaggctctggccccgcccactcccctgtccgccccggcccctcccggcgtctgggtccaccgcccactcctggtccttgcctttcttccagactcaccaaacacgccggtggagatgcaggggaacgcctgggcggggaggggtgagagggggttggaacattgtcactgcgccccgcctcccgccctcccccgcgggccgtccctcaccaccgagcggagccggtgctccagcagcaggtccagactgctcaggtagcagctgcggagctcggcagcctgactggcgctgggctccccgtaggcgatgggccccactgtgtggatgacgtctacggggggcgacggggtcagaccggcgggggtctacgcggtcctcagctccctcgcttccccctgccggcctgggcagaagggggcaggaaacacctttccccccaagcgctgagcctcctccgcgaaggcccccacccctgtgggccccctcgagcccgaatccgcacgcgcacagagccccgcgccccctccccacatctgtatgggcccggctgagacccgagcgcgagtgtgggcgcgaaggcgttgccccccagctccatcctcagcctccacgcacggtctcccccatgtgcttcctggggtgtgcggggtgggggccgggtcttggcccttaaggttaagaagggccccctgaggagttccccagcactcctgtgggggccgcacccctgatgtcccagtgacacacgggcgccctgtctgcgccccacagctgggggcgcgtcggggactcacacttggccgggagccgatagccgccggtgatcttggccttgccagtcttacagctctgcagggtccggcactcgtcggtaagcagggggccggcggcccgatgaatgcagccgtccactgcgggaagggcgggcgcgactgagctggcctggcaaggctgcggccccggggtgagcaccctcagtcccgagaagcccctcggcgatgcgaggacccatgcggagccgcgccccaaccccgtggcctccggccgcggccgctgcccccacccccgcccggaatgtttcacatctggggaaaccgaggcgcagagcgggacggccctgggcctggcgggaagtcgcgcaaggaggccggcagggggcgcacccggcccaccctgtcccttccaggccgcgccgccagggcccaggcagggcggctccgggaggcgggggccgccgggacaggaaccgccgcccgagccggggtgacggggaagcttcctccccgacgcccctccctagccctgtcccgggcgcgctgcagggcccgcgaccagtcgctgcctccgcccgggcctcagcgtcggtgcgatcccaaggcccacctccccaggcggcgccccatcacggggcggcggcaaaccctaggacccattttgcggatgaggaaaccgaggccaccttgttacagggtgatcagatctgtagctggagtctgggtcttccagccgcgcggggaggtgagcccgacgcccgggcccgagtctcctggcgcgcaaaccccagctggttaatgaaccgcctcgttagcgcatccagcttaattacggccccgcatgggcttgtttatccgagggcggctgcagggcctcgcgagcgaccctggggacccgggcgcagataaacaaccggggcgcagcgggaggcatggaggaaacgctccagcagcccaacctcgccagggcaccgcgcaggagaggcgcggcctcaggcaggcctgggtccagcccgggctcacccctcatcggctgtgagatcctgccccttcccctctctggcgtccaccctcttatctggaataccgggacagcgaccctcccacagaggaaaacgccgcgtgctggccgggaggacagggcccatctttggcagctctgatcgcccacgccaggagctcctcaggcaccagctgcctggtgctcacaggcgggcatcaagagaggaccatcattccccattttacagatggacaaaccaaggccaccttctccttcatcacctcagtctcggcacagttccagggatgccaggtagctcacacccctttcttttgctgtttgatctcgtgccctgggggcacaattaaacctcattctgcaactttactcagagctggcaccaggcaatttcccagagcgtcccagggatgggtgggcagagaggttaggggaacgctgagaacggctcaggcctggatcccttccacctgctcctctcctctgcagggagaaaggcagctgtagcccagggcgaggctgagatggagcaagaaggcagggcccagagcgggcgtccaggctggagctcccagtgctgggaagtgagtgttccgaatggggtgccgtggctgggctgtggagctgggcaacgtgagttcacatcctggctctgccagccacagatgtgtgacccctcacatatcatttaacctctctgggtctcagttgctccatctggaaaatgggataatagcacccacctcagagctcattgggctgttggaaggattgagttaaactaactttgtaatgtgcttaaggcagtgcttggcaagaatggaggtcatgagtgtatcctgttattaacaacagtgtgacagtgtgggcatgttcgggtatgtgtacatcagtgtgatgggaggtgggtgcacacagggtgttcacagtgtgtgggggtgagcccagggatctgtctgagctggctctcctaggagcctcccgggtcgagcacctggcaccggctgctcgaagtctctgggggctcaccgccctgcaggcgacctcggccagctgtgggggcccgtgcggggaagtggagctcagtgtttcaggaatttaatgtttcctgcggaagtggactggcctgcagccaggcctttggggctgacctgggggcgcaagggaggtggagggagctggaatcaatgctggcagagggctcaggccagatgccccctcctcacccccagcagttccagaacagggcctgggccaggtgatggctctgcaggggccccagggaggggctcccctaaagcagagatgagggacaggtcactgtcagcccactgctaccccaacaagctagagtgcagcctggcccctcttgcctgcgtgtccctccctgtccacacaccagccttctcgctctctcccctgagagtgcagaggggaacccccccaccctgctctccttagccataggcccaaaggacccctcccacacacactcccagagtccccttagctctgccctccaggccctgtcctggctcttacctggggctaagctaggtcctagagactcaagcttcctggggtcccattcaggggagatgcccttccttccctcttccctcttcccaccccaccccaaggcagctggaaaagaccagcagccctgatccctggggctacctggtggaggtggggtattcccagttcacaggagctgaccaacccttagtctcctctccagggccctcagccaccaaaacaaacctccaggctccagctcaaccctcaccccaagtcagcagaaaacctggggtctttcctggggaggcagagcccacttgggtggcgggacccccctgagatgtttctccatcaggtcaaagatgaagccttcctccacctgtggccagaagatggcccctaaggcccctctgcctcctccctgcagccccttcttccctccaccctcctctaccgttaaactccccctgatatggctccttcatatcagccctctgtctcactatatcatccaggctggagtgcagtggtgcaatcttggctcactgcaacctctgcctcctgggttcaagtgattcttatgcctcagcctcccgagtagctgagcttacaggggcgcaccactatgcccagctgattttttgtatttttagtagagatggggtttcaccatgttgcccaggctggtcttgaactcctgacctcaagtgatccacccgtctcagcctcccaaagtgctgggattacagatgtgagcctgtgtttttttgagacagggtcttgctatgttgccctgcctaagcctcctaagtagctggtatgactcaccccccatggcctttgtcagccttcttgttgggtaagcacctgcgtggtgatttacagccgctgtcttattatttttcctgtttatagaagaagaaactgaggcacagagagcaaaacttgcccacacggctggaaggttgggctcccaacctcagtggctctgcttcctctgggaccactaaagggcctcgccctgaaccactctggctgactggtttgaatggccccctgtccacgctcttggggaggcagtgtctccccacatcagcacgtccccttccagcaggggggctgccctggtggcctcttgttgcacagtgttctgaggccactgtctttctggacggtttggctgcccccagcgctgacggctccctccatccagcgggacttcccgtctccttcgtgggctctcgttcctcaggccgctcctcaaatgccactggggctctgcctgccctcgcctgagcccggaggaacctctttctgccccaagccctggcctctgagcggcccttgaccctccgccccatcttaggcatctccctgctttgctgtggtaaagccctgccttccagcctccacggccagcattcagcccagcatctgtgcgcctcccatggaaggatgttgtggaaggaaggagggctgggctgagtgattgcccatggccctgggcattcctggggcagtggagggcaccaggagtgggcagtcctcagagccagcagaggcggaaggcaggcaggctccggtggggccatccgccaaggcgcttaggatgagttggccgctatttagggtgctgtaatatgcatgaagggaagattagatatttaaatttattcagcaataaatgcatctcagtgggggagcattcctcatgctaaacaaacaagcaggcaggggctaattaattatttacaggaacataaggaggcctgtggcccacaggaccaggagggcagctgtgcccctaccgagggcagggcaccccaacccgcaggcctggacctgctcctggtctctctctgctcccccattccccctaccatcccgtggggctggcccacgctgtgccctctttgggatttctcttcccagaattcctggccacgagattgctggtggtttggggcaagtcacttaacctctctgagtctcagagctctggcctccagagactggtgggggctgggaggggtgactcatgcctgtaatctcagcactttgggaggctgaggtgggagggtcacttgagctcaggagttcgagaccagcctggacaacatagtaagaccccatctcaaagaaaagaaaaaagagtggtggggagcactgagatatgctggaaggtgtcaagggggatgggagactgagggccaggggggttaagcaacctgtccaaggccccacagtgagaggaggagcagaaactaagatccactttatttatttatttatttatttattgagacagttttttgctcgttgcccaggctggagtgcaatggcatgatctcagctcactgcaacctccgcctcccgggttcaagcaattctcctgcctcagcctcctgagtagctgggattacaggcgtgtgccatgatgcctggctagtttttgtatttttagtagaggtggggttttgccatgttggccaggctggtcttgaactcctgaccttgtgatccgcccgcctcggcctcccaaagtgctgggattataggcgtgagccaccgcgcccggccaagacccacattattaaccctcatcgtacagaagtagtgataggctcagagaggcaaagccactttcccagagccacacagcaaagtgtaaggccttgcctgggcagctcttgcccctggcccccaccttcctagactcctgtgggccccaagagcagggaggtgaacaggaaggggggcctgggcaaggttgtgggggtgagtggggcctgggctggctgggtgtccagcctgctgccctgtgactgcagcgtctggccctgcctctcaggtgccgagtctcatacctctctggctcaacctcacgcctctgaaatgagcttttgggggctgtatgggaggatcccctttttacagatgggaggctgaggctcagccatggacttcacaggcaggggattcctttgccctgtcatgcttttgggggccttgtaccccagggactggctgcactgccagggtggagatgcccctgagaaggcaggcaggagggctggagacagagggccttggggaggcagaggtgtgagctggggtttgagggaggggtgtgtctcccctccagcccaggaaggaccaggggtctgggctccagggaccactcccgcctggacgggctgggcacagcctggagggcattggcagccaagcctcggtgcagcccatgctggtttccctctctggaggagggctacagaaataccagatgccaaggcagaaagggacaaggctcccggggaaatgggggaaactgagtctctgagagggtaccaactgcgtcaagggcagacatctgacttgctgccccaggcttctaaccctgcagagggaaggtttagccacaaagaccggataagtgacctacccaagggtcttgcgctctcttctctcccagcccactcctcattctccacctctggcttctattcaactaggccaagacctgagcgatatcccattgccggaaccatctttgcttctgctcacaccctcctggtcggccattcaatcaacaaactctagccagccccggctctgtgctaggcttgagctcagcccagcagggtgcagagcccatcctcaccaggccccaccctctcggtgccaaggcgggtgggtgcccgggggagaagatggatggacgacagttctgtgatgagatctgaaattcattacggggtgagatcagctccttaaatggggatttgaaaacattagggcttcattatgtacacaacggcagtgcctcattcatcatgcaaaaatcactcccgttattaaaaatccctgtggcagctgcatgccggggcttggtggcatcgtgcctgctggggacagagcaggagctccacagccctgcctggtcaaagttgtggccacgggacaggggccccaagtcccagcctccctcttacacaggggccagctgcggggtggggcgggaagtgaggttcagctccagggacttagtgcctcagtttctccacctgcaaaatggagacgctaatgatgcctcccatagggcggggtgagggtgtatgagattcttcagggagaggttcaaagggtgctggtggccatgtcgtaagtactgagaatgcctggctgccgttggcaccatcatcaactggggtcaggcaggggtggcaggaaggcctgggggcctttccttggggaagggcacgcatcccctgtcataaaacctcccatggctcccaagagtacatggaataaaatcctcaactccaacaaagctttcctggactctctggggctccctgcagcctccctctcagatgaattcactgcctcccgcgcccctcctactggttccaaactctaccattcaaaaaatgcgtacgagggctcgggggcgacgtgccacgtgccagccctatgcaagggccaggagtcctgtggccgcagcagttctagggacgggacacgcggctctaagttgtgggcgtggtgaaaaaggagaaggggaaaatggagctggccccgaggaaggagggagggatgggcgccgttcagaggatgaggtggcccctccgaggaggtggcattggagcagagccctgagtaatgagaaagaactggctttggaaggagatggggaggagagtccgggatgagagtccgggcggagagctcaggaagggcagagccctgtggcaggaacaggccggcgggtgaggctgggagggagcgctgcctctacaggacctcccgggaggtgcgaggagtcgagcaattgggaattgattcgagcgcggtgggaagtttccatcagtgaagggacgtgttctggttcggcctctggaccctcttctgttccctcttctggacacgcccttcccttctatgctgaagcacagccccctcccccctcgccctttgccagacagccccacgccagagggtcccggcacgcccaccctgcacacacaacacccaccagactggcacagggacaggtgcggggactgcccagcccttccggctgcctgctgcttctgagctcagccctgctggggaggggagggccgcacacagccccgcctccagagggccgaggctggccacaggccacggaggtcacgtttatctgctcgcagagcaaggccacggctaatcggagcggccggagctgagccttttcctagcggccgcgggaagcaatcacggattagcagcggccgggcgatgggagatagcgccagagcagggcgcggagcgcttgtgagccgggcaggagtcgagcgctgaatacttagaggcctgggcgaatcctcccgggcctgcgggtctacgaacagagaaccagccagagccagagagaaagaacgacaggagaagggagagggagccagggagaggcaaagcgtggagggagaaatggagaaaacgagggagagagggaggtggcaagagaaagaggtgagggagagaggcagggttgtgggggagagcgctcggctggcccccagggtcccagcatgtgtgtgaggagggaccggccctgggtggcggcttctgagcaggtgagggagtctgcggtggggcctggggagaggcgcccagggttagggtgcgggcgcgggacagggagtgttgtccacctggcagaccttcactaaatgcagcagtggagggggtgtcggaggggctgccctgacatgggaaggtgaaactaggcgggagggttgcgacaggagggcagaggagcgctcgggcccgggagcagcatgtgcaaaggcccggtgctaggggaagacagtgagggaagcccagccaccctagcttctcttgggcggtgtaggagacacacacacgggcttgccctgccagcacagggtgcagaggtgctcagggccgacggcatgggggcaggggcagctgcacccacacaggcaggctcggctcctgcagtttgagcggggtcgctaacctcaggaaggccccagacagaatgtggggaggttggggatggggttccatcctctcctgcccgcctgccagggacctgcctgactccctcccacccatgccaggagctgaccctttggggcgctggccaggccggagtagagatggcggccacgcagccagaggaaggcggccctgaattaatctgtcactaaagcttggccgtggcaggcgcagtcatgatttagatgaataattgaaacgctcggatacatttattatccctttagtgcaaaagtggcagagaaagacgaggggtaattgaaaaagagcgcacaaatctccccgagaaagccggctccttatctccgagtaaacatttcagtcctaataaacaggagagacacgggcgtcagggctctgtcgattcccatcctgatttaggacctgcctcccttcttaccatacaataggagagtgttttaaaaaatgtttttattgagccagtaaaagctttccaggagggaggtgggagagaggagggggcctggcagacaccaggccaaagggtctgtcgggaaggctggcagctgccccaagcccatcaagccttcctgaagcagacacaggccttccccctggggggcccgtccatcctgctctacctgcagaactcctatttagccttcgggacccaagtcaaatgctccctctgctgggaagcctcctaccaaactgggtctccctgaaggcagagccaagccctgagtcccagcatttggcatagctccctcaactcagagagagctccagggaagaatgggtagtaagggagtagggggacttccccaggactcactgcattgccagcaccatctagttcggccccagggtgtggtgggtgggggtccaggcccagagtgaggcaggcacaggagtcctgtgccctccaggttaagtccctttagccccagcagcccctgggggctctcactgcattgggggtgcccgggagactcccttctctgctcccctgagactgcagccctcttctgctctaaatcaccgcacatttgccgtaaaaacagtgggctcgggccccaaagccctgcaggccagtcccagccccatcttctgagccccagttgcgccggcccctcctggcaggaactccacgccactacccacaccagggtgttggccggggtgttggctgggatgttggttgggttgttgcctggggtattggttggggtgttggttggggtgttggctgggttgttggttggggtgttggctggggtgttggctggggtgttgcccagggtgttggttggggtgttggttggggggttggctggggtgttggttggggggttggttggggtgttggttgaagtgttgcctggggtgttggttggtgtgttggctggggtgttggttggcatattggttggggtgttgcccagagtgttagctggggtgttggttggggtgctggctggcatgttggttggggtgttggctggcatgttggggtgttggagtgttggctggtatgttgtttggggtgttggttggggtgttggttggagtgttggttggagtgttggctgggatgttggctggggtgttgaccggggtgttggctggagtgttggttgagatgttggctgacatgttggggtgttggttggggtgctggctggcatgttggttggggtgttggctggggtgttggttggggtgttggttggtgtgttggttggggcgttggctggcatgttggttggcatgtgttggttgggatgttggctggcatgttgattggggtgttggctgccatgttgcttgaggtgttggctggggtgttggttggagtgttgtttggggtgttagttggggtgctggctggtgtgttggttggggtgttggctggcatgttggctggcatgttggttggggtgttggttggcatgttggttggggtgttggctggcatattggttggcacgagttggttggggtgtttgggatgttggctggcatgttggttggggtattggttggggtgttggcttgcatgttggctggagtgttggttggggtgtttgctggtgtattgtttggggtgttggctggcatgttggttggggtgttggccagggtgttggctggcatgttggttggggtgttggctggcatgttggttggcatgtgttggttggggtgttggttgggatgttggctggtgtgttggttgaggtgttggttgggatgttggctggcgtgttggctggcatgttggttggggtgttgaagtgttggctggggtgttggttggcatgttggttggggtgttggctggcatattggttggcacgagttggttggggtgttaggatgctggttggcatgttggttggggtatttgttggggtgttggctggcgtgttggctggggtgttggttggggtgttggttggggtgtttgctggtgtattgtttggggtgttggctggcatgctggttggggtgttggctggcatgttgttggggtgttggctggcatgttggttgggctgttggctaggatgctgattggggtgttggccagggtgttgcctgctgcccctctccattgagggactggcagactggcagtccccagggtgaggggatgggatgtgggtgccagactgagagctgtgtccctggctcccagggcacacagagggtgccactcactgcaccacagatgttaattatttacttcaaagcaggaagctcttctaggagctcagaatctcccataaccctgccctcgggggagtccattccggtggggaggcaggcaatgaagaacaaacacaaaacgcaagcagggaatcagggctgcgggacgaagacatggagcagggcagtgcatcagggttctgggcagagtggccagggcaggcaggatggcccttgtgcgtgttcgaacaatgggtggctggtcatgggaggggcgcgggtagaggcctgaactcctgtaggagggatgtccagggaccccacgggaagatgggtgtgtctgggcagagtcagatggggtctaacttgggcaggtaggcgattaggactggatgaactcaaaggatggtgggaggagcaggggtataggggagggcagagcacctccggggaccaggctgggctccattccagccccagcatcgtccctaccacagccccctccccaccacctccactgtgttccaatcacattagcagagtgacagtcccagcaagtgctggcggcggctccataaatctcagcccatgttaaaaggttggactccgggcccacttcctccaggggcacccgccccgtccatctctccatcagtcaggttgtgtgagaggcctgtgccagccgctccgcacccctaaatgctggaaggagaaccagagagacctctgccatgcctctgagtggccagggcagggcccctccacttcctagagtgaggtcacaggccatctgtgagccactcctggatttgccaaaacatctttggtttccaccagctgcccttgggtaagtccgttgcttaatgtgtagggtcatctccacctttacctgtagttcattcattcaataaactttttttttttttgagacagggtctcgctgtgttacccaagctggagtgcagtggtgtgatcttggctcactgcagcccctgcctatggggttcaagcaattctcctgcctcagccttctgagtagctgggattacaggtgtgtaccaccatgcccagctaatttttgtatttttagtagagacggggcttcaccatgttggctaggcttgtcttgaactcctgacctcgtgatctgcccacttcagcctcccaaagaactggaattacaggtgtgagccaccgctcctggccttaatttttatatttttagtagagacagggtttcaccatgttggccaggctggtctcgaactcttgacctgaggtgatccacctgccttggcctcccaaagtgctgggattacaggcatgagccaccatgcccggccccttgttccttgttttttgagacagggtctaactctgtcaccctggctggagggcagtggcgcaatcatggctcactgcagccttaaccgcccgggctcaagtgatcctcctacctcagcctcccaagctatgactacaggcacacatgctagcatggttagttgatttttttttgtagagatggggtcttactatgttccccaggctggtctcaaattcctgggctcaagcaatcctcctgcctcggcctcccaaagtgctaggattataggctgggattacaaacatttactgagcacttattataagtgccagccccagatacagtctttcattttcagggggtagaagacaaggaacacaatatgtaagtaaattatacagcacattagaaggagacaggtgctcagaaaagttaaaaccacagcagggtgggggccgggggagtgccagcatggggcaggggaggcagctgcaatttcagctaggggccagggtggacccccctgagagatggtattcaagtcaaggcctgtcggagtgaacggagcagccgcgtggacaactggagcaagggcattgcaggcagaaggaactgccagggcaaaggcccggaggcaggagtgggcggggcctgtccagggaggccagggtggccggagcaaagtggagagggtggcagtgcggaggtgactgtgagaggtgactggggacctaacgggccatgctaaggaacttggcctaggccctgagtgagacaagaaccctggcagggtggtgggcagaagagactcgatgagctgatgtgggacagaaaggcccaccccctttgtgatcctttatcttcctgaactgaatggctaaagatctcgctcctcacaggctgtctgggatcctgggccatctcccatctccccacctcttggctgggctccagtcattcctgtgtcagagcctccctctcctccacttccaggcctttgcctgcgctgttccctctgcccgggacacccttcccagcactcttcgctgggctcatgcctacgcatccctcagattgcagaggaggcaccacctccttctagaagccttcctgatgcccaagcagggacaggcactcctcatcaagctcctatggtgccactcccacccccacccccacaccacagatcaccctgtgtcttggtggtgctctcatctgcactgggagctcaggggacagggaccaggcccatctgtgcccggcagtacctgtcctggcacccagctcggggcccggcacacaggggtgatcaatgaacggaggaagggcagggtgctgtgggtgggacatgcaggtgtcaggtctgcaaagtgtcctccaaaaggacaggcttcggaagagggtcctaggtggtctgttttcaggaccacagtccccggcaaagcccctcattctgtgaggcctctggggagctgtgacctccatggggacagctagaggagaatggggaggagggaaaacatctcagccacaaacagacccccattctgcatcctggctggtcaccgacagctcttaatgctgctcttatttattcctgacctttatgccccttttatttttcccccttttaaaacctggcctgggccctgccaccgctgccgtaaacacggcccccgggatttatccgacggcacattaacccctggcccctagctcaccaatcatcctgctgcctgtgcagacagcgggcagcctggccagctggggggctgcaggactgggctgaggggctggtgtggtctgccctaggtgggctggccatggaggcaggtgctgggggtacagggacacgcccgcttggtatctgtgacctggcctgtatcccttgcggccaggcccaccctgacctctgacctcctgcctgcctggcccttccagaacccctgctccgtggtggtcgttaacaatggcagacacagagacatcccagggctgagagctggcagctctctccctgactttgtgagacctgtcctggctgcggagcccgaggtccaagggcagggtagagatgataattttgccctcacaggtggggaaactgaggccaaaagggacagagctgcccaaggtcacagggagatcaaggtcagggctgggttttttccaccacacttgtggcccctgcccagttacagagcaggaggcctgcattcagaggggtggggagctggcccaggttgcctggtggtgagggtgccaggcctgccatccaggtctccagctctggggaagggaggcaccctgtgaggacagtggggaaggtggattgcagtgagatgggcaccgagggcgaggggcaggggaggagcagacccagcaggggagatgccacaccccacccccaccaagacagaaggtccactcaccgccaccgcctccgagcagggagctgttggctgcaagagagagagacaaaggcagatcagtggggaaggggctgcggcgggagtatcagccttgaggggagggtgatgtcaagatgggagtgggctgccagctaggtcttcagacttgggcacagggtcttcccagtcctccggggcggtagtagacgatggtgaagagggaggaggttcttcatggtcctggggtttgtagggtggtagggctggggacacaggagagctatcagggcctgcctgctcacccggacgcagacgcatgggggggtccagagaggcagatggcccccgccacggccctttcattccttcactgtttcgcccacagtatctcctgaggctggtcggcgccaggcctggtgcagagatgtggggaggaaaggacaggtccccttccccagggctcacagcttccggcagggcatagccttgaagccactaggaagcaaactgcacctttgcaaccgggctaagcgctgcccagggccagagctggaggactgagaacgcggagcagtgctgagggggcgcagaagggggcaggggcgggggcgtccaactgcgagagggacaaggcgagccgggtaaggggcctggagcgctgccactggagccaaaaccagatcaacagcggggtgactggggccatgtggcttcgtgcctcattttccccatgtgggagaatagccccacctcaccagctggtgtgaaggtcaatggagaggggtcctcaactctgagccccgctgcaggaagacctgggtccccgccccctccttggactaggggtagtgctgccaggcagagctggactgacggctttgtggctgccaccttcctgcgcacagccctgtctgtctcagtctgtccgatcggctgcccctcgccaccatgcagctgacacgggggcaaagtgaggctggcagcccctctctgtaggaatgccagagctgtgcatgccagcactgcccccagcctgggctccagccccgatccgcagcctgcgtccgtggtaactgccagagctcatcagggaaagcagcgggtgaggccaggcaggtgccgcccaggcccagatgctgcccaggtgggaggccagctgcgcccgcccctctgccgaggagtcctggctcccagacagggccttcagctctgcacacagctttgctacccaccccatctgcccagaccattgcagccctttctgtagaaaggatgaggggacacagagctgagctgggtggccaggctgcaggcccaagatgccgtgaggacggcatggacgctgctaagtggtgtcgggcggctccgagtggctggtctcccagagctgacagctcttcgcttggggaataattaattccaccgcccaaaaacccagggctgcaagttgccatgttacttgcgagattaatacaagcagctaattaagatggagaggcgaggagcggctgggcgctcccaaagcaggggtgggggccgcgggaagtgagggggaggtgagctgagtggtgccagcgaggcagtgggagcatgagccgaagccggagctggagctggagggagagcaggacacggaccacaatggggtgcccaggctggcccaggacaggctgcagaggggcgggccccccagtgactctgggtggggcctgtgcccacaaatgcacatttctttctttctttctttctttctttttgagatggagtctggctctgtggcccaggctggagtgcagtggcaccatctcggctcgctgcaacctccacctcccaggttcaagtgattctcctgcctcagcctcctgagtagctgggactacaggcatgcgccaccacacccggctaattttttgtatttttggtagagactggttttcaccatgttggtcaagctggtatcgtactcctgacctcaagtgatccacccgccacggcctcccaaagtgctgggattacaggtgtgagccaccgcgcctgggcatgaatgtacatttctgctgaccaagactatttgctgggtgtagacggggtgctgggcacagatgggcccatttattatcataacaaagccacaagggaggtgcgatggttcccattttacagagaaggagactgaggcttagggagcttcagtcatggggtggcagcagcagaattggaagagtctgtctgactccaaagccaagccacgaagccagctgaccccagggacactgtctgagggtcggtcagagggactgcctttccctggccaggggtggggcttgccttctcgaaaccaggcagagtaccccgcaagccccagatgcagcctccacccactccccaccccagcaggtccagctgcagaggcgagggctgggcatctgggcagtgccaccccagagccagcgagggaggagggggcatctcaggtctcggtccagctccaggccccttggcctgggcagtcctggcagcggtcggcagctgccctcctcgggacccccccacctccccccatcacctctctctcttaattaacaccggccacaaatgagctggctcctgctcaaagagggcactgtgccaaataggttggcagcgagcctcgaaggggtggtaggggagggttgctgacctgctgttctgcagtcccctgtgggaaggtgatgccattcccctgcccacctggcgcccccaaactccactgtgtgtggcctgcactgcacccggcaaggtgagtggggtgaactgacctgacgccaacccggccagagcctgaggagggggtgagctgggggcagagggaagactttgctgggtggagctgggggaggccaggccaggagatgggatttgccacaggcaggagagtggctgcggcccagtgctgggggctcagacttggatgcacggaggacctggtcccaggccacccacgcacagtgggtgccccgggaggccagtctactgtgcccccttctctagccccctgtgcctgacgtcccacgggtgggggggctctgggggtcaggtggccaacctggtggctgggacccagttcctcagctcctcctttccctgggcccccgttctggcccctgggcctcgacaccaagccacatggttcccccataaagctgcctccaaggccggagagctgggccaggctgtgcaggggaatggcccggaggcttgcagagaagagcctagggaggctgtgccagccaatgccaacagacaggcttctgggtgtggccacccagcccgcccagcccagggcagggcctctcaggtctccctgctcctcaggcctccgtgcaccccaacatcttggcctgtggccggcccttttcacctcagctagttcctggccaccggcttgagcctctaagtcccctctctactgcaccacccccctcagtttgctgggaggctctggtccttacacaacaagtcatcaacccagtttccagaggaggaaactgaggctcacagagtacccggggactgggggagatgcaggtgggcccaggagcactggttgtcacagctccttttcttgacccccaacatgcccacctcaaagggctcttcttgctgaaggcgtggtggcttcaggcgggcagtggctgtgtgaggtgggggatgggcactggactgcgagtccaagctggggctcatgatccagccccacccaagggacccagacctgctcccagcaaacaggggcctttgaacgccatgtggggctgagtgggggacccgagcctggacctgggagcttggagcggcacagttcgctttggctctgggtgggggcggggcctcccggcagcaagcacaccctggaggctgtggagtgccctagtctgtggtctgctcttggagtcacctgtaggcccccactgcaggccgaggtggcccggccccatcgggttccccccgcccgaggacatgcctgcgccatgctccctgggacttgattaactggctctgagcccggtgctgcgcctgtgaccttggggtggcacccctcaatgccagtcactgccaagtcctctgtccgctgctggcggtccctggggactgggggcctggaaacctcagtctccgactcccacacacccctcctcccggccctcctctgccccagcacttgctgtccctgagggcaggtgcagtagctccccagtttgtgcccctgctcccagcctagttagaggctagcaggtggccgctgtccagcgaaagggagagggccagacctgagtgctcagaaacgacaggtcacaggaggcccgaggcacaggtggcacccggcccctcctccatgctccacacaaaacatttgaattcagtgccagttgggtgccagggttgtgctgggcagcaggcacagagaaaagaacagtatggagtccctgggccttggaagcttccagtcctgaccggaggggtagctgggagcaggcttgagagctgccccgggcgtgctaaatgctgtggcgaggggaatgggggcgtgtgggatctactgaagtctgcagactgggaaggcttctcggaggaggtggcatttgagctgaggcttgaaggataagaaggaaaggcatggagggaggggcacggggacgtgcatgatgagggcaccctaccagccaacacctcactgagagggcagcgccagcctcctagggcccaggcagggccagcctccctgctgggcacagtagacacgtgcttagggcccatgacacttttaggggcccacaaagatgttgcagttcttttaaaatcagaagaaaacaatgaacttttaggtcaaagacaatgttatcagatataatattaatacatttgtcttgatgctaaccaagtcataaaatataatttaagatatgttttatggaggaaagggaccaacaaggtggaatgcctgggcccaggctgggtaagcttggtgcatgcacagctcatttaatcctttccctgtctggaagacgtgtttacagacctgttttacagatgaggacgctgagacacggaaagtgatcctctcacaatgtacatttggagaggaggtaaaatctcctattttgccccagctgccctatgaaaaccctcccagtagggaaccctgggggacttgggagccttagtgagaaatgagaaatccctttgctcttaggataaagactggctccttgcagacccccaggccccatcgaccatctcctccccttctcctctccctctgccgtacatatggtcctcaaacttgccccatgctctccagccccagacccttttcatagactctgccatggcccctctgcctggaggagaccctcatcatctgccacctcctcaggtctcctggcccccggtgatgctctcctgggggggccatgaatcactatcactgcctccagaatcccctcccaggtgcctatcttttttttggaaatgaagtctcactgtcgctcaggctggagtgctgtggttcgatctcggttcactgcaaccactgcctccagggttcaagtgattctcccacttcagcctcctgagtagctgaaagtctaggtgcgagccaccatgcctggctaattttttttatttttagagacggggtttcaccatgttggccaggctggtctcgaactcctgagctcaggtgatccacccacctcggtctcccaaagcgctaggattacaggtgtgagtcacggcgcccggcccccaggtgcttatcttgatacccccactcctgccctcgggtgtctccctcatggttcttccccggctctcagcacagcgcctggctcacagcaggtgcccactaatgagttcctgaaggagcccgtggacattacagatggtgcccagagtcactcagctggatttaagctgggtctgcctgcctgactcccaagctccagctctctaccatgggccatgcaggggagcccaccctggggcccttgggaggcaggacctgggccgggagctgtgtaggcgacaggggctgctccaagggcagtggcaggaggccagagccacgaaggtgctcaggtgcaggaactgcctctgctgttcccctgacagggacgaaatcctccagcccagggaggggggctgccgagggcggtgaggggtgctgtgtgggggccgggacatcagaggagacgcagtgacccaaggaaagcgctgagcaggttcctgggccagggagaggctgggcgagcaggcacagaggtgactttgaggcgggcacagcccacctgcatgtccctggaggccgcctccactccccctgcttgctgctctgggcctcaccctggcctcagctgcctggaggggccccagccaggagttgggggggtgggggctgctcccctaagtcacccagcgtcctggcctggccttcattctcctcttccccttgtgagccggatctcagccttctgttctctgacaagtgtgcagccagccccaccgtgtgccaggcgctgggacacggatggggcagccctgctggcacgtgcatcatctggctgggagaccatcaggaaagacagcacgagaatcaacttgcacaagaatccctgtgagtgccagaggccgagaaggaaatgcaagggagtggcagggggccggggggggggggggggggtgtgaggtggcggcgggcagtggatctggaggggtgggtggggcctgctgaaccctggagctggtgtgagcagcacagccaggcaggggtgggggacgaggagcaaaggccttgagacctcaggggctgaggagcagggaaggaggacagaagtgagggggctcaggcaagagcagcccctggggggccttgagagccttagtgagaaatgggagctgctggggggtttagacagaggagggatgaaccgcacagggaagggactgggggcacaggcagtggcaggaggggcctcctggctactgcagtgtccgggtgacccctgcctccgggatgcctctcagacttcccctggggatagcaagcctccttggtgctcccacaaagtgtgtccccagcatcctcctcaccctccccgagctcagatccccgccatcagcacagagcctggcacctccaaggggctccatgactgccaactgtcccagcatctgaccagctggcaggcctggccccacagggggcttaggggagcggagtttgttcttggaaatcgatgccccacttcctgcaggccagcggtgggtatccgtgtgacttgagggcgagtcgtttaaaacatgttttagattagaaacaccccgcagatggaataacatgtgaaatgtgctggattttgaagataaaataagagacttcaaaggcccctcaagctgtgagagcagttgcttgtttgacaagctctgtccccccaggccaaggtcactgtcctccgtggtagggcggcccaggtggaaggtgggagacttcctggacattttccaggctggggagccaggggagcaggggcctcactggagggtgagggctcccatttatgggcaccaagtgcatccccagcaagcttccacatggatttttttttttttttttttttttttgagatggagcccaggctggagcacagtagtgcgatctcagctcactgcaacctctgcctcctgggttcaagagattctcctgcctcagcctcccgagtagctgggactacaggcatgtgccaccacgccgggctaattttgctatttttagtacaattggggtttcaccatgttggccaggctggtctcaaattcctgatatcaagtgatccatctgccttagcctcccaaagtgctgggattacaggtgagccaccacgcctggcctccacatggatctttgaccatcatctttgcacacaccctcctgtcccacttacagatggggaaactgaggcccagagaagagaaatgacttgcctaaggccacagacttcagtgggaggagccaacagtcttatgctttgccagccctggtcctgaaacccccagctgtgatctcgggtcagctgccccacctcctggggcctcagtttcctcatctgtagggggggtgatcatttaactgaggcccttgtgaggcatagatgataaagttaaaaatgcccgtaaaacctacagcctcacagggcttcactgtggcagtgggccccgaagctgggtgggggcggttcctgggggcagaaggtcccagcactcctggtaagtcagggagaaggatttgaaccccgctgctccagggctaagcccctcaccacgtcttctctgacgagcctgggagctgctcaaagctgctggggtggtacccagctgggcatccccactagattcccctgggtctcctccttcccactgggcccattccaggccctcctttccccgactcccctgtacctcagagcggcctccttcactcccacacacctccaggtgccccctgcctgtttgcccacgtccactccactctatagcccctcttcctggtctaatcgaggcatcccacccccacgcctctccccataaaagcctcacagttcactgtttgaaatggcgtggctgcggttccagctggcctgggcctctcttgtctgcttcctgcctgggtttcttgggctctgtctgcctggctgcctgggcccctggagacccaagctcctggccagtctcaccccaagctgtcccctaaacccctggcaacatggaggtccccctcaacaccccctctccaagccctgtccccaggcaccttccacttattgctattttcctaagtaaaaaattcatgttcattccaccaaatggaataccatgagcatgcaacacaaaaacaagagaaacgcaagtcagctgctcgctcatggcgcagactcggctcgccccattcccatggccctgaaggaccttccagactttaaaacgaaacaaaaaatagctgatgacacatttatcaaataagttctccgtgctttgcattgggccaagtatttccagtggcttctttcatttcgccctccccacaagagcccgttgagggggtcctatgatttttcccactttacagatgagaaaatagaggttcgcagaggctgagtgacttgcccaaggtcatgcagctggggagtggggagctgggtctgaattgggctgtctgacttccatgggaggactgagctgctgcactgcaggacccccagctgctgcctgggcctcccctctcctgggcgccatggggcaggcactcagcatcccacattagcataaccataagcatccctgaaactcaattaccaggagatggcttgggccccagccagccgggcagtctccatccttgcaagaatgaggggctggtgatccagggagccttggcgggtgggagggtggagggcatcagagaagatgagggaggagttggggggccttaggacggccatggacccctcagtctgtgggtcttgaaggcagccttgacccctaggaaaggtcaaggcccagccccagctgggcaggcccgactgccccgtaggaaaagtcacgggttcctctgcacccagcttgctgggtgaccccagaaagccccttgcctctctgtgattcagctttcttctaaaaggagaaaaccagaagctattttattgttctttaatttttaaattttttttgagacagagtctcactctgtcgcccaggctggagtgcagtggtgctacctgggctcactgcaccctccacctcccaggttcaagagattctgccaggcctcagcctcctgagtagctgggactacaggcacacgacaccacacccatctgatttttgtatttttagtagagacggggtttcaccatgttggccaggctagtcttgaactcctgacctcaagtcaaagtactcagattacaggtaggagccaccatacccagctggggctattttagtagaaaacaaagcaggagtttgcacgaggaaagagtgagcaccagctctgaacagccaggccagcctgggctccccctgactcccagatccccatcccaggaggcgtggctgctgtggcctcctacataggcggctcctcagctgcccctcacccctcatgccttcctctcccagcaactgatgagccttttccatgcatttcctgcatggatgaatcaacctcacaaaacagcagaagccccctccctgcagaggtgtccactattctggatttggcatgttattttctttagagttttactatgcgtgcccctcaacaaggtaagataggttctgtgtctttgagttttgtataaacgggagctcccggtttgctgttattattcattgcaatgcttgtaagatttatctgggcaggcccacactgctctcatgggccccccccgctccttttttttttttttcagacggtctcgctctgttgcccagactggagtgagtgcaatggtgggatcatagctcactgcagccatgacctcccgggctcaagagatccttctgcctcagcctcccaagtagctaggactacaggcacacatcaccacatccggctaattttaaaattttcgggccgggcgccgtaactcacacctgtaatcccagcactttgggaggccgaggcgggtatatcacaaggtcaagagttcgagatcagcctggccaacatggtgaaaccccgtctctactaaaaatataaaaatcagctgggcgtggtggtgcgcgccggtaatcccagctactcgggaggctaaggcaggagaattgcttgaatctgggaggcggaggttgcagtgagccgagattgtgccattgcactccagctctgggcaagagagcaagacttatctcgggaaaacaaacaaacaaaaatttcacagagacaggatctccccatgttgcccaggctggtcttgaactcctgggctcaagtgagcctcctgcctcagcctccctaagggctgggattacaggtgtgagccactgcgctcggcctcgtgttcactggtgtttaatgttccatggtggaactaccccacgcccagccacccattctcccactgacccacagtcaagcatgcttggttttgtctcatgcaaacacagtggcagtagcatctttacacgccccatgcacacatgcaccagaatttctcttgggtccacacttaggagtgggctgctgggttgtggagtgcgcatatcttaactttactagttattgccaaattgctctgcaaagtggttgttcagatgatcgtgttaaaatataaattagatcgtgtcacttccctgcttaaaattctccaatagcttccgattatacttagaataaaatccatgcttccctccatggaggcatggctgtaccccacacccctcccccacaatttcctggcctcttttctcttccttcaataggtctggctctttcatgccccagggcctttgcacatacgtttccctctgcctggcacactcttccagctcttcccaagctgagctccttcttatccttcaggactcaatgaaaatgtcacctcctctaaggggctgcccctgaccacccagttaaaaggccttctgccccattccccttatcagcctctttatttcctctggagcccacaccctgtgcccataatgacctcatcctctgatgtgtttgctggtttattaacagcatggcagcctgtggggagacgacctcatttgctttgtacattcctggatcccaaaggccggcatggcctggcacctaagagctcctcttatgactactcattcattcaacagacattgatgaggccaccgatgtcacagagggttagcagtggggaaggggctttgcagaggggagtgtggctgagaggagggcagagaggtgaccaggcccacggggccctccctgatccttctcccacagtcatggggtgtcatggcgggtgctggagctgggagcagcagggttggtcttgccctttagaaagaccccctttagagctggggaagggagcagattgaagaggtggtcctggaggcaggggctgcagggatggtggtggctgaggatgggttgagggagggctgggagaggcggcatgattgagcccatgggaccaaagagaagaccgtggagatgggactggatcaaggatgcgattggctcagaactggctcaatccagtcaatggaagagcacatggtctatgaagacacagtggtagctgtagccccgccaccctcctgcccatgggggcttccaccaccctctgcaggaagctgggaaggggctcattcatgtctagcccacccagaggctcaggtcttaacctctggggttataggttatagcctccccctggcccccagtgaccgctttgaacacttccccagacgctgcctgtaagcactacactcggcctacaatttccgtgggaggatcctcccggggcccccagcaaggagcccttgacctaggttcccctcccccaccacggatttgaaaccgaggccctagaaggaaaggaactggaagaaggtggcacagctgaattgtcactttgctttttagaataggaagtgttgcaccaaggccaaaaacgttcccttctcagtaaagacagaggaaaggcagcagccacttgctgcgcagggaatctaagtcagacaccaggaagcaccgtcctctgcctgccgggcacccgccacctctctgcagccagtggctgctcaccctctgaggctgcccaggactctcaggatgcggggctgggcaggcggaagaagcagttgtgtctgactctaaaactagtgcttccccagtggggagtgctggggaggcgcatgggaagggccgggtggggtggggaccaggccttctagttccctgctgtccccagcgccagggcctgtgctgagggtctggagccgagggggccccttgccctgtgttattacccctcccaggccttgtcctgtggggacacgacaggaccctagcctggtccctgcctgcctgccttagggcccccctggcctgggcgcctcctcttctctgttcccctgccctcccagcttgggctccacgctgcagagggaggagggagagggaggagggaaaacggtggagggaggtgggaggcaggaggcggaaggaaggagcaggaggcaggaggaggtcagtgtggcagccattggtatgcgaggcccggcctcagcccctctgctccctccgcggcccagcctttctgctcagctctttaagaatccctcctcggcagcggcagcgtgctggttgctgggcaaccccatcgcgccccgccccctgccgctggcgctggccctcttcccctccccctcctcccgcagctcctcccagtgcccccagcctcagcggcgctggtgctcctagctcagaacctgccaggcctggctgctgggggcacctgtgcccggcaggtaagtggctttgagtgactacatccagccccagctctggagtacagctctgcctcccaggactcagggagggagaccctgggcttaggacactctttctccttacttccctgcccctggagcacctaggccagcaggcgagggcaggtgaggggtcccagaagatgccatctgtttccgcaaccccagctctgcagccccaggactctgggagagggaccctggactcagggcaccccacctcagactctcccatccccacctccccgccccagggcaccatctgtggccttagctttattggcatctgttgggggacagagacaacccaaggggaagggcgaggagctgcttgagttcccagtgaggtggggagtggccacctgctggggttggttgagccgggtgctgggatgtgggcgctgggcctcaagagcctttgcgctgtgggggaggctgaggccataaagcagctcacacgggcagaggaacgggaggggagatgagggggctgcagagcttggggcccctgaaacaggcatctggcggccggcagaagaggcacagtgacggggtggggggatccccagtagaggtctctgagacaccaatctcagagcctcctgcatcccctacctcgggcagtcacagggaccccgtcccctggctccctgatgtcttggggctgccaccctctctttggatcaggccctacctctcgctcccaatggcatccccttcctcactgtcccgggggtccagcccccatttgcttccacctgccacagactctgcaccatccagaaggcccagtctctctcctggaggcccttcccagcccaccctgcgcagctggcctcgcccccacccccctctcggacccatgcccatgagctgctcgtcacacagccctccctaccctggctgaggctggtgtctccacagggctgtctttcaggacacagttcacatctccttcctgaacttgggatgtgtgtaacaggtgaatgacagctggagtaaaggaaggtctaaatcaccgcaaaaagcatattctctgctgggaatgatcgctgagaagggagggagccgggagaggcagccctgagtgtctggaagggatgggggcaggggaggtgatgtcactggtggggagcagaggaagctcccaagggaaggaggggcccatgagagaagcctggccaccaaccgcctcagtcctgctggggctgggggctgaccagctgacaggtggaacaaccaccccccgggtgacacagtcttgcctttgcccaggcctgcgttcccaccctctctggcgtctgtctccccacccacccaggggcagctggttagacctgatctcccccgtcatgtctccatcaccccccaaactcacacccagactctacccactccccagtagctggatgtgcatctggccccccagaaccccaggagccatcatctccgggcaattcccagttttatgaatcatggttggccttgggacagctccgtcattgttgccttgaagggctctgtcagcctgatgctcgctcctgtttaatgttctgtccattcattcaccacattcaccaatgcctgaccatgctgtccccacatgctggacactgtagcaggggttggggacatgcaggaacccaaataggcccggctgtgccctcaaggtgccgacagtctggtgcagagatgaatactaacaaaacacacatcactggacacaggtgcctgtgattctaagtcacgatactattgtacgtactccccaggaagcaaacacaacgccagagaaaaaatcagccacacccggatcttagagatgtggacatgttggccggtagatgaaaaacgcagtcatagaaatcataagcaatcaccaacgagctgagtgctacaaaacagaagtggaggagggagacagaagaaggtgacctaatcgggaaggtggggttagaagctgggcatggtggcggcacctgcaattccagctactcgggaggctgaggtgggagcatcgcttgagctcaggagttcgaatccagcctgggcaacatagtagatcctgtctcttaaaaaaaaaaaaggaaggtgggtgggtggtggggatgtgggggttagggaggcctttctgatgataggttggccaggctctgggctgatgaggaggagttggttaggactggagaggcggaagggtgcagagaagtaagacccttgtttcaaggcctgggggcaggagcatgctgaagggagggatgaggatgaggaggaggcaggcactggagcagggctggaggggtgctcttgtcctggctggcagcctccccggtgccagtggcctggtctgacctgccttgggcccctccctgctcccagcaccagtcctgggggttgctgacttcaccctacctggctttgtcccttctgtgcctgctccttggggcaccctctctgggactttcctcctgggctggaggtcttgctctctggctctccctgaagctctgcgccagggcccaccctcctggtcctagaccttgtgcttagaggggagaagccccagccctctgtgttgtgcataatggtgggaggggagcacagtggagttagaacttggatcagagaagctgctggagcctgcctgcctgcctgcctgccttcctttttttttttttttttttgtgacgtagtctcactctgtcgcccaggctggagtgcagtggcacaatctctgttcactggcaacctccgcctcccaggttcaagtgattctcctgcctcagccttcccagtagctgggattacaggcatccgccaccatgccagctaatttttgtatttttagtagagacggggttttgccatgttggccaggctggtcacgaatggctgacctcaagtgatccacctgcctcggcctcccaaagtgctgggattacaggcgtgagctactgcacccggccactgctggagctttctgatgtgtgctggcctggtgtccctgaagtggcatgcacagcccgcctatccagaggttacatatccatgcattcgcgtgaacatcccgtagtatactggggcatcactggggccccgagctaggagtccacccctccttggaggtgatacccaggctggggcctgtggggaaggctgaggccagggttgtgccctctgaacatctgcaatttgtccttgccttggtgccaacccctgaccactgccctgggatggcttcatgcctggatgcccagcacagagcctggggctaagggtccctgatgatgaccacagaccccaccccccagtgaggaagaccctgttcctcccttgagtcaagtcacctccttcccctgcccccagctgagaacaggcccaagtgaagccaggggtggcccagctttagttgaccacagtctaataatggtgagtcatattgtatactttgtatacttcactgtatacgaagcactttcctcctgggacctcactggactctcgctagccctgggaggtctgagatggccttgttaagataaggaaatggaggcacagcaaggctgggatggtgcccagggccgatggctggtgagttgcaggatggcgagcaggacccagatttaggggctccagagagggtagatggcagctggagaggtaaggatgcttcgggcagggccagggtgaccttggctgcccggtggtaaggcccaccccaccaggctgtgtgggttactgcccctctgggagccgggaagctggggcttggtgagctcaaggttgaacctacaaatcatcgccaggtgacttgagctgcccttgcggctgagtgcatcccccatgagtgcccagcagggactagctcagtcctccagcccaaggccacactgcctttaccagtcacctgtgtcctcctggagcccacagctcccaggggctcggcaagggtttgttgactgaacagtgatctttctgactctcagagcccactgtccccttcctggaatgacactccctcgtggtgccctactccttccaagataaagaagaggcactccaggtttgtctaagaccctgcacacccatcctggctgacaccagccacctcatcttccactatccgccccccagcttctgtcccccactctaaccaagaattcctgagcctcaaagccaaggctgtttcacgtcacagcaactgtgagcttctgctgtctgcaagaacatccctcctgcccctccaagacccaggtcaagaggcacctccctgaggaagctgatgtcaaaatcgacttggccctctgtcttggggtcacgaggtaatgcctgcttcagcaagatcttgctaagccataactgtctaggtgcccagcccccatgctggaatttcagctttgccagggcgagatccagcagggcccgattcacttctggtccctggtgccctaaacagcacctggcacacagtggactcccagccatatcccccgaactgtgcacagccaccaggcatggctgagcgggttattccatcagctttgtggaatatcgtgcagctgttaaaaccacaattatgaagatgatttttgtttgttttttagggacaaggttgcccaggctggagtgtagtggcacgatcatagctcactgcagcctcaacctcctgggctcaagtgatcctctcgcctcagcctcctgagtagctgggactacaggtgcctaattttttttttaaattattttttgccgggtgtggtggctcacgtctgtaatcccagcactttgggaggccgagttgggtggatcacctgaggtcaggagcttgagaccagcctggccaacatagtgaaaccccgtctctgctaaaaatacaaaaattagccaggcgtagtggtgcattcctgtagttccagctactcgggaggctgaggcaggagaattgcttgaacctgggaggcagaggttgccatgagctgagatcgtgccattgcactccagcctgggcgacaagagtgaaacgccgcccccccaaaaaaattattatttttatttttttgtattttttttatctcaaactcctggtctcaagcaatcatcccaccacagccccccaaagctctgggattacaggtgtgagccaccatggctggctcgaagataacattttgatatctaagtgtgacatgtcaaacagagctacaatcatacaatccattccactgcgaggcattgagtgcccgcgctctgtgccagctctgtggcttggtgtgggggtggcagggatagaaaggggtctctccttcaagacatttagttcagaagaggaggaaggcttgaacataattcctgagccacacgccaagtgctgggatggaggaatgacagagccccagggccacacgtccatctgggggtctgggaaggcgggacggaaaccacagctctgtaaaaattacagccgtctctgcatggacaagcctggaagggagcagaggaacggaagctgttgacgccacagggcggtggcattgtgggtgatttttctttcttttattgttggtataatgctgtttgggcaataaataaaaattgggaggaaaaaatagctgtttggtgaattgagtagaaattgggagaaagaagaaagggagttaaggggagggaaattagaagggtgaagtgaggagggagaggcaggaagggcaaagacaggcgcatgcagagcgcacagaggccagaggcggcggcctcaggctaggccccagtctgttcccggactgggcgcaagagggctgggtttgcacagggaaaggagggggagaggtgctggagtctctgtaggggggaccctccccaaggggatctgggagggcatcccagaggggaggtggcccccaggcctcgatggacagcaaagagcagggccggcagagggggtcccagccagactgtgggcggtctgagggtggatcaggagcactggggccctggtgggggctctgggcaggcttgggactcagagcagccactgacaaggtgatgaggtctgaccagggcaggccaggctgggtatatgggagagtcccttacttagtgtcccagcgaatgccaagagcacggggactttcaggctaagaggaggctgtctggtctaaacactccctcaccccacccggatgccacccacaggcatgaacatcttcccagtctctaataggtgccaggcactgggccagccaccctcccattcaaggtcttcttcatctctcacagtaacctttggagctaggtagtaacggtcccatttcacaatccaggacactgaggctgggagaggttcagcaacttggccaaggtcacagtcagctggggatgggagggggcgctggcatgggaccctggcactgcccccttaataggtgggaggggtattgctggggagcgcccgggtgtttacagcacgcggcggatgagagggtctgcccagggaaggggcgccaggcaggaaggaaggggttactttggcatgcagagtaggcggtgggtacctgtttgtgaatgaatgcacgggtggacggatgaatgaatgaatgaatgaatggatggctggagggatggttgaatgagtgggtgcggagaggagggtgctggggaggcggcgcgtgagctagaacccctttctcccccgcctccacggtggaggttggctttgggagcctccctcccccaactccccagaggggtcggctcccccacccgcccttcccccagccagtttagccgagggcgggggaggggggcgcggaggccgcttctccccggctgggccagaatccccgcgcggcggcgcagcctcccgcgccgggtcccgccggccagtgcgcagcgcggcgcccccgtcctcctccccctcccctcctcctcctctccctccccgctccgcgcctgcacgcacggcccccgccgccgccgccgcgaggggagaggcggccgcacagcctggttccccgcgccctgctcgccgccgccgctcgcgcgggcaccgccgctggtccccgccccgccgccgagcgcacccgcccgggcacacgcaccccgccgctggacgcaccccccgcactcctcccgcggctccgccgggcgcccgagccgggcagatgcgccgccgcgcgccccccgctccgggcccgccaccgtgctctgccgcgcgccgggggctcctctcccgggcccccctgggcgccctccggctctggttcccgcccgctccttggaataacccctgaggctccagccgtcaccgcaaagtttcccgaggagacccgcctccccggccgctgcgcaggtagggctggctgcaccgggcgggggtcggggtccgcgcgtctgggacagggcgccagagccgacggggcgggggccgggggcccgggggcaccgaagcgccacggggtcaggcagcctggctttgccccagagcggcgggagatgggacgcccagcctttgggatttggggtgggggtccctgagtcaagagccaagcaccagtagcggtggcgctggccccgccgcggggaggcgcggggtgcgcggccggcggctcagctctcccgagccgaggctggaaagggcgggggctcagctggagctctagtccaagccctcgctgcaccccccagggagggggcctggcccgtggggggcgtcaggccggtcatgtgggtcccagctcccgcactcgggaaccggaggagggcgcgcggccagggacagccggccggcctgggcgccgcgctcccgtccccaccagccgcgtgagtcacggttggagcgaggttttatttttaaaacgacttcaaggggggcatgagcagcctccaacttccctccctgtgcgcgctgtggaccgtcagccctgagccgggcgggggctggggccgtacacctggcggctggaacggtgagaccatggtgcctgggcggggggcggcgggcaccccccatcccccagctctcaagacaaggaggcggcccgacccggcggcgcacgcccctcctcgcgggcactggagaccccggggaggaaggctggggagtgttgtcgcccagctgcagggaaccgtggttgatcagagctccccgaggaggagaaagttgtggaacagggacaccagggagctgccacagccttcccggtggccccgggaggtcttcgaggccctccagggtgggcagttttgagagaatacagcccagctggggtgtgccaggcccccgaggcccaagccagagctctgatgtgaataaatacagccaaggctggggacggaggtgaggggtgactgagaacagccctgcctcaccgcggcccctacgccctcgggttggatggaaaccagcccctccacatccccctccccaggtggctcaggagttaggaaggaggctgtctgtgggggggacccacgatgccactgtggagggaggtggctgaggcaccctgtctctgcccggcggccgcgggggaggcagccgccgcgctcaggggctccagattccagtttctggagttgaaagctactgcatctcttccgccagccccgggaggagaggcgcagacatcacctgtcagctggtgctgactccgtgggcgactgttcagggcttcctcagaaggtttaaaatggaaatggcctgagctgacagggcccgtgcctgggaggggacgctgcctagctgggccagcagtgagggggccctggtaggtgtgaggggcaggaagagctgagggctgtcacatatctggctgaagggtcggccatgggcacagggtgtgtgtgtgtgtgcgcacccagtcccatgttctttcccagacacagagactggatactcttcagtaaaaagcaccctgaccccagcatggaggctccgtagcccacacccccaaggcagctgtggcctgctggacttcacctagacctgggtctgtgcatccgcactctaccatttattggtccctccacctccctgtgcctcagtttcccttgttggtaaaatgggattgatagtgccacctcctgagcctgagccagggtgctgctttgtaagtgcatttgacgcatgttgttagtggtcctgctcctggactggaggattctcaagggctgagggtatctgcagggacttcagagggtcggggggtcggattttcccaccaccagccagtgtgctgtcactggacttcatcctcacgctggccctcagtggcagcgccctgtgtcccctcctccccatctccgaggcctcccatgaaagcccctgggaggtccgcccagctgtttctaaggaggtgatggggagggggtgctgccatcccactggtcacccactgccagaggtgtacagacttagctctgtagagattcatgcctggtggctgagcctgtgtcgcattcactgggtgaccctgggcctgcagcctcccctctgggaccggcttccttgcctgcgcaggggtttacagcagttgtcccacagagaggatgtctgggtgttctgcgtgtgggtgcagggaagggcagtgcacacatgagcaggtggcatctgtgcttgcttcgaagttagctgagaggactagggctccaggtggccttgaccctgcgggtgttgagggacggagaggtgggtgtagagcccagaggccagcacgggggcagctgtcaagtggctgctctggtgcagggggaggatgaggcctccaggatctagctgggcacagccacctctgcccagtcatggggctagcagccccctccccagccagccagacatccccagaatcagggctggacatggcctgatctcagagatggggcctgtatgggactgtgtgggtctggctgtgctggcccttctgctctagagtctggaaatgatatcaaccacctagtcatccctgttgattgtgttcctgggacactagaatgccatcacagggtcctaaggactttcggttcctggggagggtttctctacctggcctgctaaccttcggcaagtgacccgtcttcctcatctgtagggtggggtaacagcagtacctaccttggggaggcacccacgttgagaggatgcgtatgaggtttctagcagagttcatgcctagcaatgtggggcccttgcctagtctacacccctcgttcactgtgggccaagggctttcagcttcttcaggccttggggtggcagggaggactgaggtggccctcatcccctgcaggcaggggccatccactctggtacctggcccaaggggcagtgggaaatgccccagagcaagggggagctggagggcttttgctgaggccccttataggatggggtgcgtgaggcatgtgggtgagcgagcgtgggtggacaagaaggggcgtgggtgtggcgagggtgctaactgcctatagtggggtgggtggggactgccccgggggtagctttccctgctcactggcagaggagagcgccagcctctgggaggcccaggccccaggccctggctgctgcccccggtgtactgccttccaagtgtgtttgaggtcgggtggtagcggggggtccctcctcagaacctgtgttgttctgccggagacaaagttcaggctctggctggcccacgaggcagctgcattctgtcctctgccatgggacactcaccctgagagggccagggctgtggtgtggggcagactggatggccgggaggagacgggaaaaggacagcacccctgttttgccctcctccccccggacagcctgcctggagttctctggcagcagctggagacaccaagagggttccatggagcaggctgtgtttgtgcaggcctgtgtttgcctgtttaccatcgctcgaggcccccagagcactgccgctccccggggccagcggctctgcagatgatgtcagggtttgggggcctctccttgctttgtggaggttgtttgctggattcctgcagccctgggttttaaaatgacaacctgcagagctggtggctagtgagggtgggggagaggacagggaggaggatgggtgggagtttggggctgaagccatggaggataaatgggctggcccaccagtgctcctctggcacgcctggctccctggctcttctgttttcccttccctcactccttccctcctttcctgctcattcattcattcattcattcattcttgagataatcattgagcattagttattgccaggcacagtgctgggctctgggacaaaagtggggaacaaaagcagtgggtgtcttgccctcagggcgcttccagtcagatgtggtgtcagacattagtcagatctacctcttccccgtgaagccttggctctgaaggcgcaaagtggtgaggtcaagtaacagaggggcctgctgaggggtgggattgagggggacttcccagggaagggggtgcttaagacatgaagagtgagctggagccagggaagggcagggacagaaacaagggcctggaggacaggatggatggagagggctgcatggagacccccggcaggagggcagaggggctcaaggcacccggccagggctggggctggtgggctgtctccctgggtctctgtggcccatccatccccagctctctcaggattcctgggtctgcctcagggaccctctgcctgtccttgcagatgggcctctggaagagtgggcttcctaggcccgggatgccaggtccccttttcccgagagctgtgtgttcacctgcgtagacaggttgccccagcatctgatgggctgtgagacaaatgtgggcttgtttatgacgggggcggtagccctgggtggaccgagagctattagtgatgaaggagagtccgcagaaaccctccccagccctgaatgttcccggtgcagggaagtgggctggggtgcaggcagagggagaagggagtgaaggggctgtgtcctggagggccccggacccggctgtatggggctcagctagccactaggggacactgcctcccaggcagaccgcaggacccaggcatccgacgtccggccaggccccaggtgtggcaggctctgcttcaaggggtcaaagggcatcctcatgggcagacggggtctattgtctggctggcagggaggcagtggccgggctggttggggatggcttatacttaattaaaactgggattaaaactggggtcacggggcgctagtcctggccattcctgcccgcgtcactctccagaggcagctctgtggcagtatttttttcacgcccctttccctccttctgcctgaattaatcgttggcaccagattacaacagatttagcaaactgtaaaaaaaaaaaaaaaaaaaaaaaaaaaaaagcatgagcgagagaggaagagagaaaagaaaggagggaatgccttccgtgaggagccggcatttatctccagaagcaaattgctcttcttgaaccattcctgctgccccccacccctccaccccccgtgacgcctgggaaatgctgctcgggaaaatgtcctcaaaaatgctgccgggtgctggaaccaggaggggcttttcctgggggaggtcagccaggggctgaggaggagaggagagctcaggggagtgaggagggtgcccggggctgctctggagggtgtgttgggggacacctggctggttctgagtggtcgcagaggtggggcttcgtgtagggcagagcgagtgaacagatgaatgaatggaaaaaggggtgcagccaggaccgaatgaccgcctcgggagctggtgtggtggcagtggagggtccagcctgcccatcaggattcctagggacaaaatccgagggactgagctctctcaagcgacatagcatcttgggtcttggatccaattccacttctctctggtcagaccagagggggcctggctttggttcagggaatctggctgttagggggtgggtgtctggccctagggacatggcaagtcgcagagggtcacgggagtttcacctcaaggctgagggtgccccgcccagttaaagcacaggagtgagattcggtgggctgagagcccctgggctcctagcctgggctgggctgccccaccctgagtggggacttgggttcagtggggggcagttaggggcccacccttccttcttcgctcactcactctctcgggcagcggccatggtgggccaggcctggagctggccacagggaaggtggcggtggcccagtccagtgggaccaggcgggagggggagacagatgtgcaccacgctcacacctctggtgggcacacatgcaccttcatgcacacactcttgcacacacatgctcacacctaacccaccttcctctcctgtcttccctgagccagcctgagccaggctctgaggtgaatgaagcccacatctcacccccacctctggaagctgccacgaggaaggggctggagtggctgccccacccttcccgtgcagtcccctgcccttcctgcccccagacagtggccatctgttgcccaggcctggacccctctctggggaatgggggggtgtgaaggaatgagaagtgggagtgacagcccctcccctaagccctgctccaatagaggaggccctgtgatggccagccctgcagcgtaacctttgaccccagggagccagcagtcaggtaggctctgggtagggccacccccttggctagccaatggggggctggcctggtggccaggcctgtgggggtcttggaagcccttccctgcctcactggggctgcatgcctcctaggctgtctaccggtcccagggagatagacaacactcccctgatcccccagtcacagtggggtgcttcatgcctcagtttcccactacttctggacaaggggttggaccactaggtccctagtagctgccactcagagcagcaccatggctctgagccctgagacccccaccaggcttgggctagccagaggggctgggtagtgccacaccccagtttccaggggcttctggcttgacaagctctgcctggtttatcttcttcccactgtgagagcagggagactgaggcacagagtggagacacgccctgtccagtgccatgtggtagtcaggacacattctggggcagaagggctatgaaatgaaagctctggagtcgatgaacttgggctcgaagcccacctttgttacttatcatctgagtaccctggacgcctcacgtcccctctctgtgcctctgtctccacacctgtgaaacaggatgatggcatacgtgctgacatcccagggttagcatgaagactccatgtgactgtgtccacagaagggctttgtgggaaccagtagttactttggatcattggacaggccccgccagacacgtgctgggataatcaccctgctcggggctctgaggagctcaggggctggagaggggctgtacaggctagctttccgccctcaggaccccaccctctctggcaggaaggcttgtggggcactgctgagccccgaggtctggggcccatgcagtagcaggtggaatgcatcagggagcagtggactctaaacgcctggttgtgacaaaagggcaagttgaggtgtgggtgactcctgggggagctggggagagctgagctctggagggctctggagagcagcaagggttaggaggcagcaggtgtgggaagggcaagaggtcaaatcgtggaaagggaaagcatggggctcaaatgtcaccttctgctcattaagggtggcagagaggtcattattgagtgtttactgcatacaatgcatatttcatagagcaccatgctaaggactctaccttgcagaatcccactgaggcttcacaacagccccattgcacagaagagaaaactgaggctcaggcaggtaaagtgattggaccaaggtcacgtagccaggacatggcatcttttttttttttttatgacggagtttcgctcttgttgcccagactggagtgcgatggtgcaatctgggctcacagcaacctctgtctgcaacaggttcaagctattctcctgcctcagcctcccaagtagctgggactacaggtgcccgccaccacgccgggctaatttttcatatttttagtagagacggggattcaccatgttaggcaggatggtctcgaactcctgaccctcaggtgatccacccacttcggcctcccaaagtgctgcggttacaggtgtgagccactgtgcccggcccaggacatggcatcttaaagcatatgctcgtaaccccctcagcctacaacacatgagagtaatcaacacagcaatagtagctgacatttatatcacacttactatgtacctggtggttggcagttcccccaacaacttttttttttttttttttgagatggagtgttgctctgtcgcccaggctggagtgcagtggtgcaatcatagctcactgcagcctctaacttttgggctcaagtgatcctcccacctcagcctgccgaatagctcggactacaggcacgcaccaacacactggctaattttttaatttggcagagacagggtttccttatgttgcccaggctggccttgaactcctggcctcaagcgatcctcccgccttggcctcctgattacaggtgtgagacactgcgcctgctctcccagcaacttctgaagtaggcactattattatcctgattttaccccaggggtaaactgaggcactgagtggcaaagtcacttgcccaaggtcacacagaggaaggggaaccacgttcattagggtgaacttgggtcctttacaaaggaggatgggaaactgaggcatggagatggcaggtaactgcctgaggtcaccagcacctgagctttggtatctgtcatgctcccccctcaccagacccctccccaagctggggacctgcccaggacctctgagctgtctcctgtggtctaagagcctcatacttcctcttccctgcctggattctgccttcgtttcctgaggccccactgtgtgctgggcctggggctggtactgacagtaggtgatgtcatttaacacatgtgtcagggaggaatcagggaaggcctcatagggtaggtgtcatttgcactttggagccaggtgggagggcattattcctggaggggaacagccttggcagaggcattgtgagcagtcaggcctgtgcgggctgagggggagcagtccgggtgcatgtggtgggtggcatgtgcttctgcctcggccgagtgcttttctgcagcccagatgctggcctgtgacgtcagcaggtggcccagctgggcctcgctgcccgctggtgccctcgggaggagtggggcgggtggtgggcgaaggggcccgggagggtgctggcggcctgccgtcacagagcaatctccattagggcccctgagcgagtggcagcagctcctggaatcctattaaaagctttttcattgttccccgagttatgctctgctccgccgggacctgggcatgttgataatttatttgtggaagggaaaggggtgaagagcgcaggagagaggaggaaatgtcattatttactcagcttggtttctgcagcgtgggccctgccgtggggcagctggagagggggctctaccacccctatcccagcctctgggtcacttatgggacccaatttggtaggtagggggtgagggtctgccgagggagcagcggcgttcagctggggtagccaccttgctgcgtcctgagggtacagattggagagactgctcctggggtctcaaaggcaggcgcacatccctgctgctggccagccatgtggttgcataagccactgtacccctggatgccaaaaaccagaaatagacctcacttttctgggggatgagaaggaattcagaactaacaataatagtaataacaggtgggcatgctggctcaaacctgtaatcccagcatcttgggaggctgaggcaggaggatggcttgaggccaggagtttgagaccagcctgggcaacatagcgagaccccatctcttaaaacaataacagcagtgacactgggtaacatgactgagcactcactgtggacctgcagtgtgctaaacatgtcacgtacagtactgtatctcatttaatccccataagtgggcagtgatactgttattattccctttttacacatgaggaaactgagttacaggcagccaaggtcacacaggtcacacaggttctgagcggcaggggtaggatgggaacccggcttctcttagcatgggtgctgcctctggcctcctgagcctctgttctccagagcagccgactcccactgggtccccagtccctctcatccaaagtgaggaagccccagaagagggacaggggccacctcctgcagaaccttctagtagcaaacttagttgctactagagcctggtggggcacagatgaggaaacagaggcttacagaggtgacaaaggcagggtggagccaggctggccctgggttcccaaagtgtcccctgtgctggggtgcgaggctgcccaaggggacaggagggagctgggtcctacccttgccctggaccccagacagtgctggcctttgtctgggaccctgcgctgtgctccagcccaggtcagcttcatgcacactcctgattggcccgttctttttttctttttgagacggagttttgttctcgtcgctcaggctagaggacaagatcatgtaccctcccaagtagctggggctacaggcgtgtgcctctatgcccagctaattttgtatttttaatagaagcagggtttcaccatgttggtcaggctggccttgaactcctgaccttgagtaatccgcctgcctcaacgtcccaaagtgctgggattacaggcgtgagccgctgcgcctggcctggcccgttctttaagctgtggaggaattcatggtgtgatgtgaagtcttccccatccctgcctctccccatcctctagccagatactgccggacattttaaaacacttgaattcagtcaagtcacgcactagctctgagaccatcagtggctctctagttcctgagaagtccagcgccctcagcctggcatttcagaccttcccagcatggccctggctgatgcaccagcctcgccccagtgccccccccggctagcatgctcacacctctgagccttcgacgtgctgttccctgtgtctggaaggccaccctcactccccgacattggctgcctcatgaaaggcggtgcaggtggcactgcctgcctccacccacctgtggtgcccccctcccctcccctgccccagagaggtgctgctgaactgtggaaccagtcagattcctcaactcctcccagcaagccttcctggcccgagataaatggctttctttgtacaacagccctgggagtgggtagcgtgagcccattttaagaaggcgaaacctgaggctcagggaggttcagtcactgggccaaggtcacccagcaatcggaggagataaagccaggtccatgccatggggtccctgtcctgttccgtttcacccccagcagccgtaaagcaggtggaggagtgaccagcttggcattccctgagccctcctcacctgcctggcattcacagaggatcacatttaatctttacagtggcccagatgtacttagaggctccattttacagatgaggaaactgaggttaatagagggaaggaaggccgggcgcggtggcttatgcttgtaatcccagcactttgggagcctgaggcagatggatcacctcaggtcaggagctcgagaccagcctggccaacgtggtgaaaccccttctctaccaaaaatacaaaaattagctgggcatggtggcaggtgcctgtaatcccagcaactcgggaggctgaggcaggagaatcgcttgaacctgggaggtagaggttgcagtgagctgagatcgtgccattgcactccagcctgggtgacaagagtgaaactccgtctcaaaaaaaaaaaaaaaaaaggaaggaagcaggaaagcagagccccagccctgcagcaacttcctgggaccctgatggtggataggagctttcccagtgccctgtgtgctgggcctgagccaccacttcagagtggggatgctggcaggccctgcccgcctgaggcccagcctggctctcaggcctgcagcctgccctggccggcgggaggcagtgggcccagaagcagggccgggcaggggccctgcccccacgacagctgcctctctggcccactggcctctcagacagacagggcttgtgagagccgggggccttcgaggagagctcagctcccgccggcagctactcaaaggcctcattgtggcaggagagtctgccatgggcagctgcccccatgggaggtgcagacagagcccagcctttgtgccagtgcactgtccctgccctgacccggggtcagcaggacagaggcccttgtctgtggaggctgggggcctcccggggagggtctgccctggaccctccgttggcctgggacgggtgtggcctgtgttgccaggctgtggttgccagggacccaggagcccttccagctcccagatccagccatggaggaggctagtccttggcctgactcaggcttggagaggtgcagaagtcaagcaggatggttaataacagtcatggcagcaggggctgcagccccagcggaattcttactgttcctgccgctaagcactttatgcgtcatcaccgattccttaaagcagccctacaaagtgcctgcagtttttgctccattttagagatgagaaaaccaaggctctgcagggttaggaaattcaacccagatcccataactctaagggcggagctggatcccactccagaacccattctgagccccaggggctgctatccccaccaagcacccgaggtgggccaggcaccagggccatcccatggtgcaaacccaaagccgcccttgccctgtccccacagagctcccagccagctcgccagaccctcaaagcagtctggtgtgagggagagcctgtcatcccattttagagccaaggaaactgatgctcagagagacagactggggtgccggctgcctcctgccctgagtgtgggtgataggcagatcacatatttgtccttcagggggtggggcctttgcctgcactttgtgggtgaggtattacattcactggagtggggaacagtggaggaaaagtgacagagcccctgagaggtctgggggacttcagggctgagccaccccattcatagtcccactcttggaaggacccccagagaccactgtgtttgttaacaccccattgtgtagtaggaaactgaggcacagagaagcgaaaaagggactggcccaggatccccaaagccttggggattgaacagggtcctaccgatgcccaaaggctgtgctgttcacagcggtgcccacggccagtcctgggcagggaggtcagcaggccccctgagcacttcctgtgcgctgggcccagttctgagcattacccgcatgactcgcttcatcctcacaaccttatgggggaggtatgaggaaactgaggccccttccccaggccacacctccaaggtcagcctccccaagcggtcttggtctccgagctcagctggttctattggcttcctgtcctgcaggacctgctgactcccgcacagacatcctgatggttcagggttggaggtgcctgctgaagggggtggacgctgggggtgcagacagacagctcagtgatctgcggggcaggctgcacaccccagagcccagtgtcttgccttctcatcctgagggggatcggtttctccatctgtgaaatgggcgccagcctgtgggggacccacaagtgaagtcgtctctgcagactccctgcttgctagggctggggcctggctgagctgtgatccaccccaccatcccccagctctgttctagaaaggctgtgtcccagaccaagacgctgtggccccgggggggaggccaaacctctctcagagccctcttggcctagcgatcgcacagagccagcccaggcctggatgccatattataaataatgctattaatattaataagaaatggcctggtaaagtgatgatgagggtgatggcctactcttccctcgagatctctccggaggctgggaaaccaggccctcggtccttatgccccacagggaagccgggtgcaggctccgtcttcaccctgccactcccacctctccctccacccatccctccctccctagaccccagcctggggatgcagggagggccgatgacccatccccacaagaggagggacctgagaccccgagagatgagtggctccccaggactcacagctaccacgaggcccagagcttgactgagtttagtgctcttcccactgacccttctgaaatgtgcaggccacctaggggcagctggacacgtaggggtcctggggccaggcccttggccagccctcagtgtgacagtggtggggacccagatgcccgggcactgcttccactctgccccttcctggctgtgtggccatggatgcttcagcccccataccctctattgcttctgttcccaagggtcacctggtgaggacagccctccctcacagcgctaaggacaggcctggcacacagtgagggctgtccagcggtgaccatgacccagcagtgaccatggcccagctgactttcactcttgtcgcccaggctggagtgcagtggcgcgatcatggctcactgcaacctctgcttcccgggttcaagcgattctcctgcctcagcctcctgagtagctgggattacaggcgcatgccataataccccgctaatttttgtatttctagttgagatggggttctgtcatgttggccaggctggtctcgaactcctgacctcaggtgatccgcctgccttggctttccaaagtgctgggattacaggcctgagccaccgcgcccggccacagccttgcttttcttgaccctccaagactttcttgttgcaggcagccaggcctgtcccctgagccccactcctgaatcctctggaccagccttgcccagggggacagcctggtaaattccaaggattgaggctcaagtattgtgccccaccgatctggaggagagattcactccatggatgctgcctgtgggtgcagcccccaaagccccaggtttgaggccccctgaccactcacctagccaccttactaggcctcagttttgtcatctgtgacatggggccaggggtgccaagacaggatgatgtgggcagcagccttaccccacgtaggtgcccaatcaggggaggggaggggctggtccctcttttgaagtagctctgggcagacacctgccttgacggccctctgggtgctgatgtggtggggtgggtgcgtgtggtcacgagctagagaggcagcagggactctggcggcttggcctgacactcagtggtgacagtgatggcggacccaccctccccagggtggcactgattgagtctcattgttgtggggcgggggcaccctctcggaagcctcgctcctggctcctgggcggcagagctgtcggccgggcaggctaacagctgtttgtgcagagactaaatctgtccgggtctgacagacggccttgtgccaccaccgccattcctgcgtggagcgggcagtgggctggtggcagtgtgtacatcagccctctccgagctcacggcccggagcttataggggcaggggccgaggttggtgagctcctccctgaacagtggtttggccagatagccctgcggcccagtccctctcaggacaacttctgagggtgcccattgcccatggcttcattgcctgtccacccccagggacctcaaggcctagctgggatcctctggatattgggggccatggccgtcccatcgtggggtcctgcctttcctctctcgggggctgcaagagaggtagagactggatactccaaggccactggtgcccggacagtgttatgtgtttgtgccattcctgcttggatgagagggggtccaggcgagagctgggggcttgctaatgaacttggctggtatctaggggggcattttgggaaggaggaaggcagagtccctgcattggagcaaatcccttggaggaagccctggccctcctccctgtagtgagaaagagtggccttggggccagaagatggctcccaacaaggcacccagagccccggtgccaaaccagggatgctcagttctaaatctagaagggtggtaggaagcccaaataagcattgtcggggtgggggaaaaaaaacaactttttttgctgtgaggccttgaaacaatgtgagaagttgtgagaattatttccctgtgaccctggaaagagtttttaaaaatttttaaagagatgggagtctcactaggctgcccaggctggactcaaattcctggcctcaagcgatcttccatcttagtctctctccccagttgctgggactacaggggcaggcctgggccaagcttgtgggaaggtttaaatgttgacatgaagttagcccttctgaggttggcaggatggtcaggagcaggacagtatctgagcttccactcctcacccgctgctcttggcagacatggctaatcaatcccagccctgtctcctgctgagtccagggagggcccacctgggagggcaactgacctgggcatccctgatagtgttttgcaaatgaggaaatggcgcttagagaagccaagtagcctgccacaacctcccagcttctaggggtggagttgtgatgtaaacctgattctcctgactccagaactttgtgatcatggaagctggtggtccaggggccctttgcccaggtggggttctgccgtggtgccagcagctttaattatgcccctgccagagcccaccactactccacccagctaccctccagataggcacagtatggccaggcttggcctcacggtcagggccatctctctttccccacccctggctgcaacctgcctgtgcttgggtataattacattcggttgcttacaccccgggctctcaactgcagccaaacagtgcgctgcagcctccgaatgtggggcttctgattccctccagcacgctgggcctgcctgaggggtgtgcagggaccaagaaggtgcagtcaccaggctcatgcgggccccagacggagagctggggctgggcttggggccctggggtgggcgtgctggggagcagggtggggtgaggctcccctctttagctgctaggctggtgcctcagtacaccttgggcctcgttaggaggtagttttcctggctttgaggttacccttttaattaagccaattaattagtgcctttaatgaagcagattaagcaggctgggctctgttaactggggctgtcacagcccatggtttcctgcagatctgtacttagaggccggccctccctccaggggcactgaggtgcagggttaggctgggctggggatgtctgtggccccgatgggagtgtggccaggaacccaggcctgggttggggaggcaaggctggtctgaggctgtagggacaaccctggactcagacaccacagcacacaagggccagagtgggagcaggaagtgggagggatgtggggcccctaccctggggatctacagggggcagctggctcagcggggtcctcagcaggtgtgactgcctgggggaaggggcttaaggggcctggagcccctactttctccttcccttgccttccgctctctgggactgctgggccttggttgtttctagcccagtggggttgagccctatagcggcatcccgagccccttgcctgcccgcagatggggaggggagtgctcaaggtcacatgggagttaggggcagggctaagatgcaaggccgcatacccggttgcttccgtcatcccccccaccacctctgctggcccggagtcatccttgcatggcacggagctgttcctgcgttccagcaccgtgctgggcgctctgcactgtgatctagttgactccttgctcccacgtggttcagaaagcgaggccctggccctggtggcagcaagcagctgtcacctccacctgcgaatggggatgaggatcccagctccacagcccctgagttctaccaggcaggagcctggagccccacggctagccagggtcagggcagggaagcggaaaggaggccccaacctccctggggacgtctttaggtcttccaggtttgagaggacagaccatagcctgcttcaggagacagttggctcaagtcatgacaggagagatttaggttagacagaggaagaactgcctgacaacggggattattaacaagtttgcaaaggaaagaagcggccacttctccaggagactgagtgctttcggcagccagcctgataggctttgagctcttctgcaaacaccgcactataaatccagggtgtttccagtaaatatcaacaaagtgggtgctgggttcgctgtgcagtaccctcggcagccctcaccccttgcatcttctctctgctcagaggtgcctgatggggtgcagagtggcagccagccagcaggccccaggctggtccatctaccagggcaagccacggttcctgggcctccgtttcctcatctttaaaatgggtggagtacttggtgaggagagagacaacctcacctcctgctttttgaagaagacattcccctctatcttgctcccaaatcaacaaacttccttgtttcctgcctgaacccccacctggccagccccttcctgccttgatgggtcctcctgtgtcactcatcttgtctcctcaagtggccaccccttccttgggtggtactttccagccagcttttaagggaattctagcatctcccgtgacaaatacccccactactctttctgtcttggtgaccgccctctttctcccctgctcttcaccgctgaatttctcaggatggctcaggatctcctaccagccctttcctaccgccactaccatccagactctgccagtcttctcctttctttcccatgctgacagcccttcctccaggaagccttcctagatccccccagcctggtccagaaggtgaccctcatcaccgccaacctgtgtgtcctgagagcagccctgggctttagttgtccccagatccaccatgcccagcacagggcctggcatggagcccagcctgcaggaggtgctcctctgggccgggagcagggtgaggggcagccagtagctttgcctcgaatttgccttgagcgggacaccatgcagtgggcgggagacaggaacaaatgccatcatcacactcagagacacctctttaaataccagctggaagcagcccggtttctgggtgggtggagttgcccttcattcacaagaaacgatgggggatgggtgctttgcacaggccaggacgggagctagtggcagggcaggtagctcctggggcccagggtctgcttgtccccatcctaagtggctcccctgccccattagggggctaaagaggagcgggggaacctttcactggtgtcctttccagcacggagcacaaggggactttctctgtccctccacgaggcagccagcccagcagaggcagggacatcatcttttgcttctattccccggggcctgcatgttagaccaggaataaatagcctggatggatggatgggtggacagatggatggatggatggatgatgggccatgggagggagtggcagggggattccctgctcctctgcactgcctcagtttcccctttcatacagaggatgctggtttgtgggattcagcctctttctgggtaccattcttagcaccaggccaggccggtgactcttgggtctgctattgtccttccagggcttttggcaggcagggcacagcaggtgagggacagatgccatgctgcctgcagccgacagccgtatcagcacccggggagctcctgggagggacgcgctgtcggtcctctgggcctcaggcctcctgtccacagaatgggagcacagtttgtcctccctgtgggccagggttggcaggaggctgtattcagacaggaggaggaagggagcttggagtctgctccacccccggcaataagcagccccggcagttgggacccccgcccactttgctcccatcttttgggctgtgcaggcaaaaatgcctgggtgtctttgcccatttggcttccctggaggagctgcagcaggtgggcccatgggagaggctgagggagctaggcctcagcctgtctccagggtccctgctgcagcccctacacgttttgcttcctgctcctcccgctaccccgccactccccgcccaggctctgcttcagtgccagaatgaacaggccccctctcctagtggaaatttacacccacagcccaaccaggctgcctgaggggaggagggtggggaggaagggggagcagctgcgggaacaggaggctgtactagagagaagacagacggacggagagacggagcctgggtctccatctgtaggcaacagccgggggcctggcccaaacctcatgccccaaaggctgcggccagggtggccagccctgagtccggatggcagcagccagggctggttgtgatggagaaacatggccgacaggtcacaggggacaggcaccacccggggctgtgcccaccagcagcactcataggggacagcagagaacccggcaggggtgtgaggcccatcctggggaccccttggtgtgggatggggtagtgcgaaccctgggctgaaggaagggttctggctggtgcaaggcctgtcccaccccctgggatgacctccactctgccttctaaactcatctacactccctagacccaaggtaccagggtcggagctggtctgcacccatcgggctgacactgccacaggacagcccctcctttgctcccagcttccccacccagcccgggtacagccttggcccttcctttcagcttctgcgcccgtgtcacccccctaagcaagcctgccctgggctcccaggctccaggcctccctgcaggccagcctgcgtcgcaccagctctcacgaaacagggcttcctgtgtgttcatcggctccctaagtgcttgctggacccgggtgcccctgtgccactttaggccacagccagccccgtgtttataaggctgggagaaagggcagcctctgggaccagcttggctgggggctgaacgtaggggacgggacagcccattggtggttcctccctgcagactgagagcaggtggggtccctctgctcaggccgcaggg

SEQ ID NO: 35781 - DNA, 8178 bp, Homo sapiens
cgctcgctcagagggaggagaaagtggcgagttccggatccctgcctagcgcggcccaacctttactccagagatcatggctgccgaggatgtggtggcgactggcgccgacccaagcgatctggagagcggcgggctgctgcatgagattttcacgtcgccgctcaacctgctgctgcttggcctctgcatcttcctgctctacaagatcgtgcgcggggaccagccggcggccagcggcgacagcgacgacgacgagccgccccctctgccccgcctcaagcggcgcgacttcacccccgccgagctgcggcgcttcgacggcgtccaggacccgcgcatactcatggccatcaacggcaaggtgttcgatgtgaccaaaggccgcaaattctacgggcccggtacgcggccggcgaggggggcttggagacaaaagaagggggccccggcacggggctgggcgggagagaggcgaggcgggagcggggcgcccctgagtggagggaggaatggcggcgagctagggtaggcgggtaggcgggcaggcggagagccgggaggctcccggggcgggcagggaacaagaggcgctctagaggggctgcgggccagtcagggacgcggatccccggcccgcgctgacagcgctgggagggggttagagaaagaaggctgaggcgcttaagccgggggtgggtgggaccacgaagctcgaaggcgttgaggggggacacatcaaagcccaggctgttggggtagttttcgaaggtcctgggcttggggattcctggaaggaggagggggtagtgtcgggttctaggaaggaaatgagggtgttccgagggaggcatgggggagggcgagagtgagaaaaggtccagacctagagaagacgggaaggccaatgacaccgggagtaggtttgaaatatgagggtgtgggagaaaacgccgagacgggattagcagcaggtaaaagctttgtgcccggtggatagtgatgtgtgtgtgcactcgtggtgtgtgcatgcgcggtgtgtgcgtgtttagtgtatgtgatttatcaggggtgtgtgtgtgtggtgtgtgcatgcgcgcttgaaatgggtcatgcgtcaggtatgtgtgtggcatgtgtttggtctgtgtgcgcttgtgctgtgtgtggcagatggggaaaggctggaaggtgaacaaggaggaagggggctgtttgagggaggaataaaggctgaatatggtggacaatggtaacgtggcaagcttttaaggtaatatggtatttagtctatagcaggagagaaaggattagaagccaagaaaaattaaaatggagggagggagaagtgggaggataccaagaaacaaaaggagtagagctaagaagactgctgggtggggggatatcaggaaaagccaaccagagggaaatgaagaatggatgactgctgcactgctgagctgttggagaaggcaggcctgatgggttccttagaggcgaggtttttgcaaacctggttgcgtatcagaatcacctgatgcatctgaggaaaaatacagattcccagtctaaccgccagagctgcaaatgagtctcgggtggtccgggagtctgtattttaatatgcttcccaggcgaatttgaaaagcagccaggcttgcaaagtcctgctttatagaatacttggagatgaggaagaagaggttttggctcctccaatatggactcctctaaacacagggagcttagaggatgtccacatggacggtgctcattccacactggcctgagagagggaagagtacagaaggcagtacacaaactcaggcattcattttagtctcccagtccaactgatcaaaatcagatgtgttaaggttaaggagctcagttttttcttgcagacatttatttattataaaaaataaattttatttattttttagagacagggtctccctcctgtgttgcccaggctggtctcgaactcctgggcgcaagcagtccttccacctccatttcccaaagtgctgggattacaggcatgagccactgcaccgggcctgtggatattttagaatacctgctttctataggcatgtaactgtcaaaatcatttgaaaaccacatacattatttgtcacttagagtagcacacatagttgctttatcaataaacataatcatgtaaatacctgttaatattgagctcaatattaaaggagtgaaaacatgtgcatgaggcatcatcatgactgtagtttgcagagtcattgagaggatgtcagcctgtgcacagagcacaaaactgggagtcaggcaacctgcgttctagtcctgattgggtcatgactagctgtgtgaccttgtgcaaagcattgttctctcagagccttagttttccctctgaaaagtgataaagatggcctattgtgagatctctgtctctatcttgcactgtcattcagtgagcccatgactacgtgacatcttggtagaaagtgatgcttcatgttgtaaaggattcctaaaaattagtcattctagtgcctgttaattctgtgcaaggcactgttgtagatgtgggaatatagcagtgagcaaaacagacacaaatctctgcctatggagcttacgttctagtgaatatatgttgcactgaataatatgtatttttaaaagacttttaatgttcccactagagaacatttaattgtttaaatgtttaaatattctatgaggtttaaatattctatgtttaaatattctatgaggtttgcttggtaaagactcactctaccaagccaatgaccataatttctgaaatggtaaggttcaaaccattgcatttgcctattctcaagcactaggtgctgccatttccactaggggtgtacatttatgaaaaatgtgggcttttttttaccttctttagtgaatgtggcagcatgtaatgatgattaaaaataagcatttttctttggaattttacttgcatttaaaagttgtaaaatttgtaaaaaatttctgagtgtattgaggtttcaggtgaacaggccatattgaaacttgatctattctcatacttggttccctacaaacattttaatgtcagggctgctattcaatctgccttgggggaaacaacacattgtttaaagtacactggattctcttcatttagttgtgcaatatttaaataagtctaaatatccactttgtgtacccacagaatgattctctgctctcttagacaaaagttcagtataatatcacaaataatcacattttatagagttgttttatagagttgttttgcagtattgattcagcctcttttccatgaaaattttagtattttcacagtcttctcaagcccaccaaaaaacagataatgaagactgatctctgtgttatctatttattgacagtgaaggttatgtaatgtggatagatttttaaaccaccgatactgttataaaatggttcttctgcagatgccatgagttaatgtttaattgagccttggaaccaaagatctctataagatacctttgtttcattaaaacatatcagaatatattcataaggaaatgtgttttcatgtacacatcagtgcttattatcttaagaaaccataactctcactggtgtagccccaagtgcctagaactgtcaggctcccagttcaatgttcttgtatgattccctactaccactaccccaagagatcactaaccacgtatgacttttttactagctatttggaaaccacaggagactgacgcaaatgtatagcagtttgatttacttttagttatttaaaagttaaatgacaacaggtctttctgtgtctcctacataatgttcagaatatcagcattactatggtttcctaatggaatttgatattcaaaaatggggctatgttgatgaatagggaagccattttctgtgtataaatcacagagaaattgactgtctaataaagaattgatctttggttttgtttttgaagaggggccgtatggggtctttgctggaagagatgcatccaggggccttgccacattttgcctggataaggaagcactgaaggatgagtacgatgacctttctgacctcactgctgcccagcaggagactctgagtgactgggagtctcagttcacttgtaagcatttttaaaattgtgtctgggtcaaatttctaccagtaatggggattcgtggcaggacaatagttattactaagcagcctgaaacttgggtgcattttgataggctccttaatcttggacgcatcaagttcatggcttgaagtaattgtagcagtgctgagtcacttgctatgattgcataccaatttttagccagttctctatggaaacttgggtttctggttttgattttaaaatttttgagagatttgctagattccaaatgaggatttggtgcttggtgtgtcagggaaaggacagtgtccatcttggctacagaaagggattttcataagccctctcttgtagagcttgccgtttaaaagcagcccacatctctgttgaagaatgggagacttgtattctgtgaaacagcttctctttgaatctaattgaacctaactataggcctcatctacaaatgatgcttataatgtgcccagcagcaatggtgtctgcatttttaaaaagaaagtaaaaaggagatgcttgtttctggcttatgctatgggctgaggtctttggggagaaataggaatgaggggttaagttcagattttgagaattcaggaattggtttctgtcaaatctaactgtttaattgtcactctagcaatatttcactgccaagaatttgaataagagtctttcccagcttttatgaaacagtatataaagaccatgagcattatttgaagatttttcatttaaaatgtagttttctatgtgtgttctctataatcagttaaatattacatgttctcttggctatatccaaccattttctttgaaaataatgctgacttcagagagagttctggattaataattagccagatgtgtctctgcctttgagttttggtctcaagcaggctacatataacttccaagtctagaggcaagtttttatactttggaaaacatagttcagttacctaatagagtccctaatttttggcatcataaggatgcctttgtaattagttttctatatgaaaccagtgaattgtagtgtctaacttacaaagctctattttctagggcttgccttcatcagtgggagaaaaagtgtgattttttttttccactttaaggctagccccagatgctgttgtgacacctcagctacacttaaagttggtgtggattccccttaaggcaggtttcccaggagccacctggcttttatttgtctcacacagttccaattgttcccaacggttatttcacacaaaagcagctttagttacctggttagacaggttggttactcctctaattcctactcatattcaggaagaggagactcttggctttggacattcagatgatcgaccctgcattagtttggctacagtgatgaggtggtttgctgatgccatctcttctcaagtcttttgcattctggtttgcacccttacatctgttttctccaacacctccagtcatctcctggctcctttaccacttcctttaaccacccataggtttttctctgtgctgggaaaaacgttctgtctcttgctctcctcttcatctatgagactattattccttcctttcactgtcaaacaaacttcttacaagtttttattcctaaccactacttcatttcctctctataccttcttcctccctacaatatggcttctatccccacaattggattgaactctctttctgaaagattttcagggaaaccttttttttttttcttgccaatcctgacttcacttgtccattccatgttttagatctcctgtcatgtgagcctccagaatggctccctccacagagttcccattttggtccatgggagctccaattttcacttaattaattcatgcttccagttttctttcaaagtacttctcatctgtccctttccattcccctggacaccaccctgctcctggcgctggttcctttgcatctggatctgcactctgcctctggatcgccctgttcccagtctctccttactgaaatctgccctatacaccacattgataatatcgttgttaaagcactattttactgtgtcattccttcgcttataaaccttcagtgccctttgccacctataagtccaaactcaggctggcttttcagatctttcataatatttccccacactacttagccaatcttatctcctactaacttctaaatgttaactctactcctgccaacttggtctcttcattgcttcccagatacgttgtctcacctgtatgcatttgtacatggcgtttgcattttctggaactccctccctaaatccttctatacatttttccaaaatatatcctccttccatgaagtattctgtaacccttctgatgaactcatcacttgcccttgttcttctaaacattccttacacacaaacaattcattttgacgttaccttgcacactcattgccagacgttgccacctgttttatatgtctgtcttctgaacaaaacaaattccctgttggcaaggacggtggtataaaccacctttgtatccttcaagaagcccaacacattgctgagtatattgcaggcctctaataaatgctttaaattgaaacgtggtaatgatgttttagaaagaatgagaatgaccatttgtgttttcttctctacctccagtcaagtatcatcacgtgggcaaactgctgaaggagggggaggagcccactgtgtactcagatgaggaagaaccaaaagatgagagtgcccggaaaaatgattaaagcattcagtggaagtatatctatttttgtattttgcaaaatcatttgtaacagtccactctgtctttaaaacatagtgattacaatatttagaaagttttgagcacttgctataagttttttaattaacatcactagtgacactaataaaattaacttcttagaatgcatgatgtgtttgtgtgtcacaaatccagaaagtgaactgcagtgctgtaatacacatgttaatactgtttttcttctatctgtagttagtacaggatgaatttaaatgtgtttttcctgagagacaaggaagacttgggtatttcccaaaacaggtaaaaatcttaaatgtgcaccaagagcaaaggatcaacttttagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaagattgtaggactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagatttcaaacttgtaattgtggttaaatagtcattgtattttcttgtgaactgtgttttatgattttacctcaaatcagaaaacaaaatgatgtgctttggtcagttaataaaaatggttttacccact

SEQ ID NO: 35782 - DNA, 8178 bp, Homo sapiens; identical to SEQ ID NO: 35781

SEQ ID NO: 35783 - DNA, 52092 bp, Homo sapiens
agccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtgagcacgggaggctgttttcgctggctggagcccgctcgccctaggagcttcctgcctccgtcccccaacccggaaccgccttccccgacgcgggctcggtgcccacgcgccctgctcggaagttttgagggtcttagctttaggttagccttcgcccggggtcccggccggtggccgcgtgtcgacgcccctcccctccccccgcgcgacacacacatattccagttcctgggagtttgcatggggcttgccgccatccttgcctcttctgcctctgccacattgcatggtccccctcctggcgcgcctcacccctcccgggcacagctatcgaggctcctcgggctcatcgggacgccttttggctccatccgggttcccccatcggatgccgggacgggaagtagagaaagcggtggcgactggtcccactccgattcctcactggccgggctcaggcccttcttggttccgtgggtacaaaattgagctccacgcccaagtggagagaatgagctatgcgcgcctccggggcgggccacgcggggccaggctgccccagggtgcccgaggcctcgcctcgtctcgccgcgaggactggaatctcgcagcaaggaccctcctcgcactggaggtatcgtcgagtccagcccctaagtgacagatggccggggtgccaccccacccttgagctgacgccaagtctggccggggaaaggtcctcaaggggctggaggatgctgccgccgccctcctgtcgagcctggcaatgggccagtcccagcgcctgccgcggtctccaaccttggcagataccgtgcagtgccgagttctgccgttatggggtccctggaggtcttcctgggaagaggattttggaagagacgataaggaaaagtgcacagcacagtttggccagctagcctactcctctccacccttaactttcctctgtgttttcagctggctcagctgaactaaaatgtggggtgagggacagctggtaggtctcatttgcccagatgggtgattttcacctcttagaaaccttcctaaacagcttggggggcggtagtgggaagacccctcagacactggacagcttatggctccatccccgttctgacactatgcctgccgcagtaaggggcactcacagaattctgcctctctagaatttactccagggattgcctgtcttctcaaaaaataaataaataaatacctacatacgtaagtcccaatcctgcagatactaaccttcaaatgagtgtttttgtctttcccagaggcacccttagtagcatccccagtgattcccttcccctggctgtgtcccaggggcgtgttctggggaacaggcttctttcattcagcctcctgtgtgggctgcttctctcagtgtctgctaaaagtgaactcaatcctgggtcactcacccgtctgcagaaagactccattcagctcataaggcccctcccttagagaatgtgtgtatgtgtgtgttttcaggttccttggcatgatttcccccaaatggtttacacatttagctgttaccaagtaacagttcctggagtccaagctcagcccaatcatctgttacttgtttgacagcacattcagctactggggaggcagactaagacgttctggggagcggtcccaaacccagataggtatttgtaggtatttgctgattccactagagcaaatattcttttttttttttttttttttttgagacagagtcttgctctgtcggcaggctggagtgcagtggtggatctcggttcactgcaacctccgcctcctgggttctagcgattctcctgcctcagcctccccagtagctacaggtgtgcaccaccacgcccggctaatttttgtatttttagtagaaacagggtttcaccatattggccaggctggtctcaaactcctgacctcgtgatttgccctccttggcctcccgaagtgctgggattacaggcgcaagccaccgtgcctggccgcaaatgttcttaactggtggtcagtctgtgggccatcggatcattgtcacaggtgagcaccttgaaacaatatgcacaattggatttgtgtacctttttctggggtttttttcagtctcagaagagtctgaggcctcaaagaggttaagagccactgccttagagagactttaagacctcactgaaggccgggcgtggtggctcatgcctgtaaatcccagcactttgggaggctgaggtgggtggatcacgaggtcaggagttcgagaccagcctgaccaacatggtgaaaccccgcctctactaaaaatacaaaaaaaattagatgggcgtggtggcgtgcatctgtaatcccagctactcaggaggctgcggcaggagaatcacttgaacctgggaggctgaggttgcagtgagccgagatcactccactgcacgccagcctgggcgacagagccagagtccttctcaaaaaaaaaaaaacaaaacaaaacaaaaaaacagaagacctcactgaaccactaaagttgcgatttatctctactgagtccactccctgggtttgtgagccatttgccttctctttattggtgaatttgcagaggccttatttttattatgttgtatacattccttgtctcaacctcccgtctctaagccagaatgctctagtggcaaatctcttgttttctatcctgtattatcccattgtgtcttctctcctatcccccttccaaagaccctatggagatgggctcttggacctgaaatttgatctgggtctcaagaaaactgtgatttctcagctgcaggggtccattttttctcccttgtcctttccaaagttgggtcttgtgtctgttttggaggtgccaggttcaggggactgttttactgggagtctcagacttctttcttctagagaggcatagcccagggacttcctttcccctggagttatggaaggagtctgaattgctgaggatggtcagccactgccccctcctctctgagtgttccttgatctgccctgggctgcactctctttggaagggggtgggggctgtacccattcaatctgaggaccagtttttctggtctgagtcaaaaatattgggaaatggagcagtgggtggggggtggaggaccgtggggcagtgaggtggttgggacgtctctggaaactcatactgagaaggaatctcaagtcattccaggggaaggccagaaaagggaacatctctgagccccttcccagctaccccactttaggcagacaccaggctgaatacacccattgtgccatgctggatactagctaggaggccgacagaggcagccaagccaggatgagaacctgaagccccaccagcctggccgattgggagggggcgcaatgtagcccctggaatgttggccttctctgagttgggaacggagacccaacttccagcacgtgtaaacaagccggctccttcactctgccctcctttatttgtacttgacttttttctcccccagcaaattaaacagctttgcttctgggctttgggggagtcaggagtgacttttcctgatccggccaagctcttggcctgaatttccatgcccacctcccccgattcccctccccagctcagtccttgagttacccacaggagaatgggtgtatcaggacagagtcttggagaggggagatgatgaaattcttatcatagactctttgaagtgaaaaggacacatgggcctggctcttggaaaaatggtcttttcttgggctggtgtggatttttctggggacctaggtgtaagagggtttgggttcgagtcttgggtcataaccttgcttattattaggtgggcttcttgggcaagttatcctaacgcctctgagattttattcctcatctaagaaatggggttataaatctcagtgtacctcccagagctcatatgagatgagtttctttttatctttttttagacacaaggtcttgctctgacacccaggctacagtgcagcggtgcaatcatagctcactgtagcctcgaactccaagatgagttttcctatacatgtgatggaggatggtttctgcctcttcctcctcctcctctcagtccgccccagttagaagtgaccactacagggtggtccccagagaggcatctgttcttcttagtgagttttgctctaaattagcagctggatgacgcagtggggcgggtggaatgtgctaaaggtcggtttccctgccctgtgtctgctccatactcaggattgggaggctagtgtccaggagaaaagaggagaaaagagcttagcgatgatcctcccccctcccctactccccttctaaccaggacctgggggtgtgaccctttttgaggctaagtaaacttgctggcttggccattggcccggtggtgtgtaagggtgtgtataggggtaaatctgggtgtgggggagatgaaacctgtagggagagaaaggctagccttttgcaatttcagccgtactctgcactggtcagagaacagaaaggtgtttcagtgtctgcccacctcagatgggaccagcactcagatttgggtcaaagcaccggttttcttggccttctagccagctgccttttgctccaggatgagtgtggttgtggatcagctagtttgcctagagggaatggggcagggtaaggcaagagtcccaggggaaatggcacttttgtttttctctatcttccctcacccattatctctggatcttcttcctctgctggcaaaagtgctgcttgatatctctcttccatccctcccgctgggacagcattttttccttcctcttgagaaaagctgagatctggttttattgtctgggggcaactgggagtgggtctgccctgctggggaagatagtgcctccacacgcctgcccccttctgaccagcttctctctcccagacaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccaggtgagccctgcctccactttgggcctttcttccaggcccggggtctgaggaagagaaagccattggtttgttggtgatgccgatagggtcatggggttggaggctgccagcagcagctgtgggaagcatgccatgggctgagcagggtttgtgttcatgctgagccctgcatgttgaggtaccccagcatggtataccctgccatgggcttgaaactggacaaactggtgtccaaatcaaagctgtgtttattaaccatgtggcctggggcaagccatttcacctcttttgagttttagattccccatctctccaatgggataatactcactttgagctgtaaagattagcaagaagcatttagcgtgcttggtgcctggcacatggtagatgctcagtaaaaagtagggatgtgccctctcctcccctaagtggagtatatcaggaatgtatcaaggcaattaggaagtgtgatgttgtactttgtgaagaatggccccgaccctggagggtcagcctggaatagagggctctgttcttgagatctttgcagggccattgttagaaagctcttagatttccttggcagggctcagagagtaagcctaggactagtggtggtgtttcttcccactaggaggcagctcaaccacaaagggatggagggagtttcctggccctggagatgtatgagcagtggttaggggctgcttattgggcctgttgtagacagggttcaagcacagggatggggttgaccagatgacctctaaggttccttgctgcctcaaggctctgtctctctgttttcctctttggaacacatgttctggtccatattctgaggggcttactgttgaatgaagaagctaatgtatcacatagggagggtagagaatcacttattcactcagcaggtatttgctgagcgcctactctgtgccaggctccatctgggcacaaatgcctctagatacctggttgtcaaaagcaagatattggctagggtaggtggaggaagcatccaggagttgactctgaaggatggttagggctggctttggagcagagtgaatgggaagtcaatccctgctgtcctctatttggatccccaaaatactacggtttatctaattcttcctcactctaaatacaaaccgcttttgttccagaacttggtagtcaagccagaccagctgatcaaacgtcgtggaaaacttggtctcgttggggtcaacctcactctggatggggtcaagtcctggctgaagccacggctgggacaggaagccacagtgagtgggcatggggtcaggatgaacgtgtgtggtaacagaagcaaatatggtcacctccaggtcagcagctctgtggatcacccccacagccagtctcattgtagctcagggaaggcaggagtcctgtggcgctgacccactcaggtggctgccagcagtaggctcagtcttgatgcccattcccagctccctcatcatccaaacttctttgttttattggtttgggcaagatgtgctgcagaggtaacctcaatataattcaagagccaggtggaaatggtctgattctttttttttttttttttgacagggtcttgctctgtagcccaggctggagtgcagtggcgtgatcttggctcactgcaacctccgcctcctgggttcaagcgattttctagccccagccttctgagtagctgagattacaggcatgcagcaccatacttggctaattttgtatttttagtagagacgaggtttctccatgttggccaggctggtctcgaactcctgacctcaggtaatctgcctgcctcggcttcccaaagtgctgggattataggcatgagccactgcgcccggcctactttatttttttttaagacagggtctcacactgtcactcaaggctgtagtgcagtggcatgttcacatctcactacagcctccacttcccaggttcaagttatcctcccacctcagcttcctgagtatccgggactataggtgcatgccaccatccaggctgctttttaacatttttttatagagttagggtcttgaatgttacccaggctggtctcgaacttctggcctcagggaatcctcctgcctcagcctcccatgtagctggaaccacagatgtgtgccaccaagcccaaattcaattattaacttctcccagcttggtgatgaatttcaaccacgtagatgagagagttaaagtgaaacatggtttaggaagggtaagagatgcctggaataaaattatgtttcttcttattccccaggggagctggaggactaagggagggagtggagctgaggcctggcctagcctgggaagaatgtgccatccacacctggctctgtagagcacgtggctctgaagggcctggtgctcatctggggtgaaactgtaccagggatgagctgttctcttccttggctgcctcgagaatagcaatgaaggtggtgatggagatgtcttcctccctcattgggcttcctcagagtagcccttaaatgttaatttcccagtttctggccctcatgggtaaagcgggatccttgaagttgcacatggacccaggcgtgaagcgacctgtcccttgagttcccaggcctttggagagaggatggtgggattggagggagggatgctgagcatgtccccagggagcacatcctgcttccttctgctggcctctgggaggggaaggtgggacatcagacatctgagctggcagcagcgttgggccagcaggagtggctcattacctcttatggattgctgtctggtccctgactcagcagtgacgcacaggccaggcgggggttttgggacttactaggatgagggctgtctcgccacagccgccgccagggaatcactcgaactgattagctctgcaggcctgtggtcctcagccaggagagtctgcgtggagaagtttccctgattaagccctggctccccacttctccacccattccctgcgcccggacccatgtcctgaggctgagtcactgtgccttcctcaaggctcatgaagcagaatggttacctcccttctacccggtttcccctccccgtcaagctctgccacagccgtgacttgttggagccctttcacttgcgcaggtcctgtgtcaccctccagaggaggccaagagtgggcaaggtcggtgcctgttcaggcacagcccgcaccagagcaaggggtgaaagggcatctcctgaggacttactgagcttagggatctgtgaccccattttttctggaaaaatctctctttgctgggtgtggtggtgggagtgcttgggcaccacccctgtgcagtccctccttctgccctaggggcaagacgtgctgtccctctgagtttcatctccctcaatttttctgtaggttggcaaggccacaggcttcctcaagaactttctgatcgagcccttcgtcccccacagtcaggtatgtgtgaggcggctccaggctgggtcttctccctcctggaaccttgggtttgtccaccgtaacctgaggaaagaagtcaagctgatgaggacagtcagagggaccagggtccctgaagctgcactgaggatctgagggtgctgcggactcgggagtccagaggggaaggaaagggcttggtctacagcagagaggagttaggactggtaacaaaggggacttccaagtgcagggatgagaacgacctgcaggcaggccccacccctcagctggggttggtcatactgattcagtctggaccaccagccagtggggtagaggcttcttcctcttgtcctcggggaaaagatggtggacaagtctctggatgaatggttttcactgggttttagaaaatgagaccgtggggattggtttcctctcccagtacatggtagaccatcttccccagttcagcgcccctcaccagcttcgcccccacaaccccaatcccactgtcctgtctcttcacctgcaaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagagttgagtgagagggacggtagggaggtggcagttcggatgagaagaccgacaggctctgggcacagactggggagagcagagcggtctcctctctgggagccaggtggtagacacggccctgtcctgaggaagacagctgggtgcagggcggggactggcttggaaccagactgaaatatgccgccagcatccctcacctccttgcccctgtctgtctgacacctctgcctccagcttctcgcctgacagctcctttccgcctcagtggctgaagagctatgtccagggagcaggggttgcagaggagatggaagggccagtggggtgcgtttagggaaatggagctgtcggtggcagtgagagattgctgcggggcgcctggggtgctgccgagctgctccctgatggatgaactgtccctctctccctcccacctctagaattctggccagttttatctccggcctcttcaatttctacgaggacttgtacttcacctacctcgagatcaatccccttggtaactgggtgtgcttggctgggagggggcaagggtcccagtgcctatgacagccctggccttggcattcagagaaccagactcccacttgccagagggtaacacaagacagatgtgcacaagcagaggggtccccatgcaggtttagtgccagttcctgtttctgagctctcagaagactgtagttcttctcttagtcaactccaacctctctctttggtcttagagacagagtcttgccctgtcgcccaggctggagtacagtggcacaatctcagctcactgcaatctccgcctcctggtctcaagcaatttttctgcctcagccttccgagtagctgggattacaggtgcccgccaccacgccaggctaattttttatttttagtagagacggggtttcaccatgttggccaaggctggtctcgaactcctgacctcaggtaatctgtccacctcggcctctcaaagtgctgagattacaggcgtgagccaccacgcccggccagaagtcctggttttgatctgactgtgtgcttctgctcctcccgccaggtcaggctttctgacagcaggaggtgggcagcctctgcactgctctcaccctttggcccttcattcctcctggtacactcagaggcctcacacttgcctccctctgtgggagttggtcaatcattaacccttgatgctgggaagagcttggtctcagtctcttgggctgtgaaggaagcaggtggtgttgagggagagtggcgtgggctggctctggccaggacttctcagggcagagtctaggaaggcgagaaatcaaatcattccagctgaggatgcagcccctctaatggaccagatggccttgtgctaactcaatcagctaaatggccctgggggaggaggaagatgggtgtccagtgaggtggtataaacgaatcctgctgattgggagtccagtgcaccctgcggcccctgctccacctgacactgaggcttcccctagccagaccctgggagacatagatgtgcataccggtggggggtcttctgtcagcaacatgtacctttaaacactttttaaaagtggccggaccatgggtttgcgcatggttagatactcaaaagcagggagtgtagcgttttgtaaagatgtttgaaaattgccatggcaactaatacagacctccatgtcccattgcctataggtcagggagaggggaatggccttgtagaatttgttttgcctttaatggggaaaagctctgtctccataagggcctctctggtttcttactgagcttagagagttctgaggcctgaatgggccaccatgggatcggtgtttgtggaggggttggaggttggtggttgtctctacccagagccggtgtctgatgattgcctctgctccccttgaagtagtgaccaaagatggagtctatgtccttgacttggcggccaaggtggacgccactgccgactacatctgcaaagtgaagtggggtgacatcgagttccctccccccttcgggcgggaggcatatccagaggtaaggctggtttagagaggagatggggactggggggagggcggtggggaggtgactcatctttgatgtgcatttggccccccttcatgagctgtttatttggcagggaaaggaagactgagaagcatttaattttcttaaaacctcaatggggtgggggtgggagtgagccaagcctctgaatcccagccagaaatccttttagatttctctctcaatcagcctccctcgactcttcacttgatttgttgcctctccatgattccaagtgtctcgccttaatcctgatggaaggtcattctctccgcgtctcactgagaattttaattgctctttcccactctgtcctctgagaagtcctcacagcaggactgggctttctgggaagtaccccaggcccagggaagaggctgggctaggagacggtctcgtctggggaggcctggggttggggggacgtgtgatgggccgagcaggcagatgctggggtgagggcatggttgagcagagggacatggttaggctcaggacttaggcagagggccaagtacttgacgtcagagaagggagatgggaagtttgtccctaggcagtgactgtgactatgggtgtttttggtacttggagacaccatcaagtgtcttcaaggcatgtggggccctgcgtagccccttcttcccaccccattaaggcaccttttcatgtgcttccagggaaagcggggaggggtcctaggatctgggacctggtaaagggggtaccccaagggcctacctgttgctgtctggtccccaggaagcctacattgcagacctcgatgccaaaagtggggcaagcctgaagctgaccttgctgaaccccaaagggaggatctggaccatggtggccgggggtggcgcctctgtcgtgtacaggtgaccgaagggggttgctgaagggatgccagcccagtctacccagcatcaacatgtgtgtagcctgggtgggtggggtcctgtcactttggtgtgggaatttggggcagaggaaagcagtggcatcccagagggcttcgagggatgttggtgagggcctgtcctgcacccagtgtcttctataaccttcttgtttgtgtcaaaatgaagctgttttatgagttttaattctgaaaattacgtgctccatacaaaggtacagaaaatgagctagaaagtgaaagttgcctggacatttccccatcctctccctgaccaggtcaccccagttagcaagttactgtatgtcctgtcaagcatatataaatatttatactctttgctttatagaatattaggatcatattctacaccctttacaataattagcagtttttttcactttaagcatggtagacacctgctcacttctagatgtgcaatctgccattcccttctgtgtgtgactggcactatttcctctggctgcagcacactttctcttgggtagcccgtcagggactcctgcagtgtgtgattttgcttgtctttgtgttagggaggtgctcattgttcattttacctgccattgtctgtccagggctccccagtgccttagggctggcagagtgcactgcccagaagagtctgatgtagcaccattaacctgcaggccagacttgcatgggaattgggggctggagatccaagaggccggttccacaggctaactccagtgttttgagggatccgtgtgtcctcccaggcaccaggctgccactccctgccccaagtgtgagagccatcactgacttctgtctccttggcagcgataccatctgtgatctagggggtgtcaacgagctggcaaactatggggagtactcaggcgcccccagcgagcagcagacctatgactatgccaagactatcctctccctcatgacccgagagaagcacccagatggtgagatacttgcacacacacatacctgtccccacttccccaggacagcccagcaggctgcaatgggacagcttcgtctgaggagtcaccaaggctgtgtgtggtcctttgcaacttgaggctaatcattgaactttggctctcagtttctctgactgcacagagggcagggaccacatctatcagtgggaggggactgagagggcaagaggtgatgtgtgataaagcccttcaaacaagtgcaggggaggaggtggctgtggcatgctcctgctacaattgcagtaaactcagtttatccgattgcgataaactctgattgcaataaactcagtgaccctcttatattacctggcctctgtgagtctcagtgcccctttaccacctgtgttttggagctctgcataccagttcttctttccttgagccagagagggagagagattccctccagagatatctagaaaccaacctggatttttggatgttggttaggagttatgtagtgctcctgtgggtttgttctgacccctgtctggtggcataggtaatggagagttgagctgataaagtggaatgtctggagagactgtcctactcactccccagtacctcctggcagatgggggaccctcattcaggggaacaagaacttcctcagttggattgctgggaagatgctcaagtctacctatgtaactgtttttgattctctcttactccaaatccaggcaagatcctcatcattggaggcagcatcgcaaacttcaccaacgtggctgccacgttcaaggtaacagttgcaacagtggtgcagtttctggggaaagtggtttggggaaagcagggaaggggccttgaaagcagagtttgagccagagccaagttaccatgagttcccaggtcaggtagggagctcttgccccagggtctcttaaaggggtggagaagacactgggacaggagctgcccatctgcgctgtgtgtctctgggcaagcagctgctacgctgaactataactctcccacctgaagcatgggaggcgaatttctgctttcttccttctcaggaccaatgctttggagcactggctcaatcgatcctttctttctttccttcccttctcttcctttcccttcccttcccttcccttcccttcccttccttcttcccttcccttccttcttcccttccttccctttccttcttccctttctttcctccctccctttccttcctccctcccctcccttcctccctcccctcccttccttcctcccctcccttccttcctttcctccctcccttcctttcctccctccctcccctcccttccttcctttcctccctccctcccctctcttcctccctcctttcctccttccctcccttcctttcttccttccatggagtttcactcttgttgttgaggctggagtgcaatggcacgatctcagctcactacagcctctgcctcctgggttcaagtgattctcctgcctcagcctcctgagtacctgggattacagacacccaccaccgtgcccggctaatttttgtatttgtagtggagcaggggtttcaccatgttggctaggctagtctcgaactgacctcaggtgatccacccgccttagcctaccaaagtgctggtattacaggtgtgaaccaccatgcccaaccgatcctccttactttcaacactctcgtgagactctgggttctctgcatctctttttttttttttttttttttttttttttttgagacagagtctcgctctgttgcccaggctggcgtgcagtggcgcaatctcggctcactgcaacctccgcctcccggattcatgccattctcctgcctcagtcctccaagtagctgggactacaggtgcccgccaccacacccggctaattttttttgtatttttagtagagacggggtttcaccatgttagccaggatggtctcgacctcctgacctcatgatctgcccgcctcggcctcccaaagagctgggattactgacttgagccactgtgcccggccatcctggtcttatatctttctgtcatgagccctttttccaaaagattggaatgaagaaagtgctttgatgatccggggctcctctcatcctactggggtcttctcaacctgggtgcctgttcacgagtcagggctgtgtgtgcacatgctttaaagcacatgtgactgctgtcaacaaggaagacagagctaacgtgtctcaagagtcatccctttcaagatagccacccaaggaggccatttattaatattccatgctgtcagatgctcagtgagtgtattcaaaagagtgtgtgccacatctggtggtggatccatgtgagttttgagaataatgactagataagtgtcaaacttgaaagtctgaggtctcaagaagtgagaggctgggcgtggtggcttataactataattctagcactttgagaggctgaggcaggcagatcacttgagctcagaagttcaagacaaggctgggcaacataatgagatctcatctctactaaaatttaaaaaaaattagtgggttgagctaggaggattgcttgagccccggaggttgaggctgcagtgagccgtgatcgtgccactgtgcttcagcctgggcgacaatgagaccctgtctcaaaacataaataaaatgtggggccagaccccatcagtcctgcccaaaacagggtgtccataactggacctgatttaacagacaaatctgggacaggggagcctcagcagcttttatttaacttctgagctgccctgtactgacccttggttagggcacttggtttggagcaggtactgtacatggaactttgtgtaaaatgccttgggtgacagaagtcagactctaggctcaaaaatctagcctctgtcttgagaaacagaactaggacacacctttccaccctctcatttttccaaagtggatatccattgtaagaactgttcttacaccgcgctgggcgcggtggctcacgcttgtaatcccagcactttgcgaggctgaggtgggtggatcacctgaggtcaggagtttgagattagcctaaccaatatggtgaagcctcatatctactaaaaataaaaaaattagccaggtgtggtggcagacatctgtagtcccagctactcgggaggatgagacaggagaatcgcttgaacccaggaggcagaggttgcagtgagccgagctcacaccactacaccccagcccgggtgacagagcgagaatttgtctcaaaagaaagaactattcccgcacatcacttaagaagcttttgtaggacattgactatgtcttagtacctctgagaacccttgcatagagcccaacatagatatccccaccaaaaacaaaaatgtagtaagaggcagtaatgactgcagaagggacaaaagagagaccagcaaggccttgctgatgatggaggcctggagcaccatgacattaagggatgtcaatcccgggtaccccacgttcccacctcagcaacattctgagtgatcatatcccaggccgtggctgcttatgcgtagtcctgtgcttcctgaggagcagcacttgtcacatatacctggtatgtttgtttatcacggttataaatcattgacttgtggctgccttgtttttagtcacatgtcactttgggcttccagggcatcgtgagagcaattcgagattaccagggccccctgaaggagcacgaagtcacaatctttgtccgaagaggtggccccaactatcaggagggcttacgggtgatgggagaagtcggtaagatgaggaccttttctctccccctcaccctgagtgtgggtggccttcctctttgggatttctgattcctgagcatcagtcttaggctcttttgctctctactccccttcctgggtgtgcagtttgggtttccattccctgtcccaacacagagtgctatcctaaactttggagtggtcaggaaagcattttcattgagctctacacttaacagatatttattaaagatcactcgctctgtgctgggctttgtgctggtgacgagggttacagccacaaatggacagacagcaagccttgatggaacggaggacacaaactgctatgtcagggggtgccgagtgccaggaaggaaaacaaagcagggaaagggagaatgcatgtgggaggggtcggggcagccttcaacagggagatcagaaaatgcttgatcaaacttgatcaaggctgggcacaggtggctcatgtactttgggaggtcgaagtgggaggatcccttgagctcaggagttcaagaccagcctgggcaacatggcgagaccctgcctctacaaaaaaaaaaatacaaaaattagccggtcatggtggtacacacctgtagtcccagctacttgggaggctgaggtgggaggatcacctgaacctgggaggttgaggctgcagtgagccgtgatcatgccactgcactccagcctgggtgacagagtgagaccctgtatcaaaaaaaaaagaagaaagaaaagaaaactgacatttgagcaaagacctagaatgagggagcagcgccatggtgactcttggagagggaagggcaaattcccataccctgcagtggtaaggggctgggactgagagagtggcagcgagacactacaggtcacaggaggacttggccatcactgtgagacagcaggcacaagaagtgttcaagcagaggaaccacatatttattattattattattttttgagacagtgccttgctttgtcacccagacttgagtgcagtggtaccatcatagctcattgcggcctccaccttgtgggctcaagtgatcctccctcctcagcctcccaagtattggggaccacgggtgtgcaccaccacacctggctaattaaaaaaaaaaaatttgttgtgagatagtgtctcactgtgttgcccaagctgatctcaaactcctggcctcaagtgatcctcttgcctttgcctcccaaagtgctaggattatagacgtgagccactacaaccagccaagtgacacaatttgacttaggtttgaattgaatagggttaattttttttcttttttttcttttttttttattttgagatggagtctcgctctgttacccaggctggagtgcagtggcgcgatctcggctcactgcaagctccgcctcccgggtccacgccattctcctgcctcggcctcccaagtagctgggactccaggcatctgccaccacacctgtctaatttttgtttgtatttttagtagagacggggtttcaccgtgttagccaggatggtctcaatctcttgacctcgtgatcagactgcctcggcctcccaaagtgctgagattataggcaatttttttttttttttttttttttttttggagacagggtctcactctgtcacccaggctggagtgcggtggtgtgatcacagctcactgcaacctctgcctcccagactcaagggatcctcccacctcaacctcctgagtagctgggactacagatacatgccacaataaatacacaatttttgtacaaaaaattagcacacacctggctaatttttttgtagacgaacttttgccatgttgcccaggctggtctcgaactcttggactcaagcgatccacctgcctaggcctcccaaagtgttgggattacaggtgtgagccttttgttttctttttaatagagctggttcaaagctgaggatctgctatgtgcagtggggcaggcctggggacagcacagtgaagttaccagatcatgctcttaaaattagaacattccacaagtaaacagtaggagaagatgctaggggtctgtctgtacaaggaggaggggagcgtggcatgggagagtgaccatcaaggtcagagggggcctttctcaggaggtagtgcttgggttgagctgggagaccagagagcagccaggtgaagctccatggagagctccacgcagagggagaagcagggccagagccctgggggaatgggctcagggtgtttaggaacagagaccaagcactggtggatgcatgcgatgagggctaaggaaagctggagagctggggtccagactgcgaacaggaggaatatgggctctgataatttggttacttgaatcttgccagtaaatatgtttcttatgtggttttttttttttggagacaagagtctcactctgtcacccaggctggagtgcagtggcgcaatctcagcttactttgcaacctctgcctcccagtttcaagggatcctcctgcctgagcctccgagtagctgggattacaggcacacgccaccacgcctggctaattttttgtgtttttagtagagacagggtttcaccacgttggccaggctggtctcaaactcctgacctcaagtgatctgcccgcctcggcctcccaaattgctgggattacaggtgtgagccactgcacctggcctgtttcttgttcttgttatcagcaagtggcctttagaaagatttgtctggtggtgaaattatgacagctgatttgtcctggatattggtcttgcactgaatgcgccaaacactgatcatggctgtaaaaggccctttgcagggtcacatggacttgggcccttatctgcagacttgaattatggatttttttttccttcccttgcagggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcggtaggttccagcctccccaaaccttacaggaaggaaccatctcatcttttccactaggatacagtcttcttcctctgttccctgggggcatagaggaaatacagcgggagttagtgcatggttggtttgtggatctctgccaatttttttcctgtcctgattaaagtagtataatggaaggacaaaggattttaaaattggatccaagttcaaattgtggccgggcatggtggctcatgcctgtaatcccagcactttgggaggccgaggctggcggatcacctgagctcaggagttcgagaccagcctggccaacatggtgaaaccgtgtctctactaaaaatacaaaagttagccagacatggtggtgcatgtctgtaatcccagctactcgggaggctcaggcatgagaatcacttgaacctgggaggcggaggttgcagtgagctgtgatggcaccattgcactccagctctgagcaacagagtgagaattcgtctcaaaagaaaagaaaagaaaagaaaaacttaaaaatcgttactcttactttttgctgagagagcaaccttagccagtaccttgtccacccagggcctcagtttgctgatctgtaacatgggataatattaattcgtatcttagaggattattagtacttttggaagcagcttataaagagcattgctgtgcataatttttattacgagttttctttggggcctttaaggaccagtggcttttttcccaggtgtgactcttacctcttacactctctccttatctcaccccagacgccagcccccagcaggacagcatctttttctgagtccagggccgatgaggtggcgcctgcaaagaaggccaagcctgccatgccacaaggtaactccctgaggcttcaggcatgttgcagggagtggccttgcggtaccctctgtatctctctcccctttccctttcccccctgggctggcagaggcagatgaacagcggtttgggttttgcaatgggagtgcacctgggacacgaggatggtatgacttgagccttccctgtgggcgctcctgaggcagaggacccacgccgtgcctggtcgcctcaactccccctattctcttctacccctggttcttcttatgggggtgtggactgggcagggaggctgtggaggagatagggttacagaaatcccaggaagtggaaagttctctgagactcttctcctgagtggagggcagacaccgggaccccaggacggcagagccagctcatacaacagcagttcccaggccacccccaccatcttggggccctaacagacattccctcctttgaatccccagcaagaaaagcccccgcctgtcagcccatctgtatttcaactaatttttctctccgtgtagatgtgattcctgccggccagcccttgcagccagctctacataagtggtgttagttacccctgggctggtatacctgtgcagcctcttcctgggacacactttgctatggcattttggaaaatagtgacactgtcccaaatcagcatccttgtccatggcacgggtcaaccccatgctggccaatcatctcatagtgtttcatggagacaaaaagggattggcattaagagggtgggactgcgccagctagagagcccagagttcaagtcatccagctgtccctgcagagggcctgggggaggcgctggtgttgagcacatctgcccagcctttgtcctcctcctgccccctctctgcccgtttggtctttgctctttcttgcttccattctgctcatcggtgctttcacctcttctgctggccttactccgttgtccattgcagaacaggagagggatgatgagggctttagccctgaaaggcttgtccatgggacccttccctgttcccaccctctccctccaaagcctccagccatcagtgggtcactcagttgccttggtcattttctttgacagattcagtcccaagtccaagatccctgcaaggtaggatgcccccaccctgcccccactccgcgtgtggctttgttagcgggtgacagttttactgtgtgctctgtttccccctcccctggtgggttgcagtgtcgtctggtctattttctgtccctgccttgatgtggcctgaccccaagtcctaagtcttcgctcttcctcccctcctatccgtgctcagtacgcgccccactcagtcctctcctcactgtgtggctgtttctggctccaagcttgggaaggggtagagattttggaaggagcaagagccagacccacagccctggagagtgtagtggtgtcaaggagagagtgtcgcctgggaaggagggagccatccaactaaatggggagtggcagagagtcgtgggcgtctgtcactgctggggtgcagaaggggagccacaagtcacccctgcttctcatttacatctcctgatgtcattttcccacctttcctgcctcggcttcaccactgccagcttcatcctcaagctccagggaccagtttatctttttctggggttgtggtggaggaacaaaagaggtgaagaaggaggtagacggaagcgcagaagggtgtgcagcggatctagtgactgggtaattggaaggggtatgagctttgtctggtgtatgaggtcacattttacagtggatacttctgtgcatgcgcattcacccaccagcctagctgagtagattaattggttcatggcatcagagcgtccatttaactttgacattcacagccgtggaggcggggaagtctttgttgtccccttgctaaggggaggggaaggagtaattggcagggtcgataaccagctggaaaggcctggaatgcagcactgtggccacctggctttaatcctgatgtttttgcctctggaaaaagttaagagcagagtgagcccagtgtggaaagaacagggaccagccctggttctccaggagctctctgtgctctgaaggggaggagggttatgaggaggggggttatccttgttactttctggagtgagagaaataaaaggagggtgtgtcagggagaacagattatggctgagcgagccctcccctcagcgaggccagaggaggcctggtgtagggggcatagcccctggcacagaggttctctctggagcctctctgctgctggtgggctgaggatacacccttcagctttggtttctctgtgcttgaggaagggccactttacctccacccttcctgctggagatgctggtaggttggtagattccaggctttgtcttgatttctgtagctggcagggtagatagatcagaggcatgtgcacgtgcgtcacctggcgggggtgacatgatgcaggcttcccctgaggatggcgggtcatgaactcacacttatattctccctcctcactttcacagttgagctgcattttaagtgattgtgtaatcctggctctgatgctggatgacctcggacctcaatcatttggcatctctgggcttcagtttcctaggactgggaagtgggagaactggattaggtggctccccttgttctgtgatctcatgtctcagcagaacccggggggtctaggtgacagtaaatcccaggtatttgcaacatcaggaaccttctgtcatgagaagctgtaaggctgtgatggaagaggcaggcctgtacagggatttaatgagaccatgaacttggttagccaagcctgctctagtacagtaggttaattaatacgagatgccactgggctagatgcatcattcttcctaggggagctcagaacctccctgagggctgctttcctcctcttggacttgcagggacccagaggggaaagtcaactgcctgaagcgtggtaaaagtcctttccctttaggctaaggactgcacttttttctttttttttttaaatatacttgctgcattaaaattttctttttaaaatttttgtgggtacatagtaggggtgcatgagatattttggtacaggcgtgcaatgcgtaataatcgcatcatggaaggtttttctttgttgtttttttttttgaggtggggtctcactatgccgcggtggctggtttcgaattcctgggctcaagtgatcctcccatctcagtctcctaagtagctaggactcaagcacgcaccactatgcccacctagagaactgcacttctaccagctccttttgttcccttaccctttttttttttttttttttttttgagacagggtctcactctgtggcccaagctggagtgcagtggtgcgatcttggctcgccgcaacctctgcctccttggttcaagtgattgtgtgttggtttcccaagaagctgggattacaggtgcatgccaccacgctaatttttttttttttttttttgagatggagtcccgctctgtcacctgggctggagtgcactggcacgatctcggctcactgcaacctctgcctcccgggttcgagcgattctccctgcctcagcctcctgagtagctgggattacaggtgtccaccccaccacacccagctaattgttgtatttttattagagacagcgtttcaccgcgttggccaggctggtcttgaactcttgagctcaagtgatccactggtctcagcctcccaaagtgctgggattacaggcgtgagccaccacacctgacctgcgccttacctcttaagtgcccactggagggtctgtccaagagcactgtcctgagcaggaaagagccacctggtagaagggagaaggacaggaaaaacaggagagcaggttgagggcactggccctgtgtaactagcttgctgctcctgccttgtgcagagccctggccagaaccacagttagcgataaggctgctgtgtcctcagccccggctgcacaaacctcttctttggacctacactgacctagaattcatgctgattcaaaccctgactggagctggttttatgtccagatttacagggtaataagcattgttggaacataagtcctgaacccaccaaaattgggcgagctaagcatttttttccaatgactttaaaaataatttgttaagacctcatttgcatataagctgatgacacaccttgcctgggaaatgaagcaggtcctataggaattatcctgggcatctttgactgtggggcccttctttctccattctttgcagagctacttaccagctagcaggccctcttagcttgatttgctctttctgccaccttcttccagaaaaatcgaggcacctcctccccaagttctcagaattctgtcctcttgacattcctttacggttgtgatgaggcatcaccctgtggacatggggcgtggaggggtctgtcaggcagccctggcccctgcaggtctcctgggggtatgtgttctgggtgcactctctgtgtctttgcccaccaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcacgtgagttaccccatggcgggaaatatctccttcctctgctaagacaaagcttggggctgggcacagtggctcatgcctgtaatcctagcgctttgggaggtcgaggtgggagaactgcttgagcccaggagtttgagaccagccctgggcaacatagggagacccccatctctacagataatttaaaaattagccggatatggtggtgtgcacctgtagtcccagctacttgggagggtgaggcaggaggattgcctgagccttggaggttgaggctgcagtgaactctaattatgccactgcactccagcccgggtgacagagcaagaacctgtctcaaaagaaaaaaaaaaggcaaggcttgaggagtcagtgagctcattccctttgctggggaaggctttgcccatcctagagacagaggcagtcagtattcctgggggatctttgtcccttagatgaaaattctttgagggcacagaccatgccttttctatcttctaggtgaaattcctcccctcagcttccccttccccagtcctgacaggttgaggatatcctaattcttcttttactttctcacagtggggaccacaagcagaagttttactgggggcacaaagagatcctgatccctgtcttcaagaacatggctgatgccatgaggaagcatccggaggtagatgtgctcatcaactttgcctctctccgctctgcctatgacagcaccatggagaccatgaactatgcccaggtagatcactgggctctggagggtggggggtggggaccatgaactatgcgcaggtagatcactgggctctaggggacagagggtggggaagcaggaatggctcctggttgatgtcccgtcactgctgcctgggacaaagggctggggatttgggagtagccagtggtttaggtggaaatggttggagacacatgatcttcagaagtcaggatagtgacttagggcaggtcagtctgggcagaggctgcttatctgggcttacaaagaggctgctcaggcctgggacagtgacttatgcctgtaatcctaggactttggaaggcagaggcaggaagattgcttgaagccaagagttcaagaccagcctaagcaataaagcgagacccattctctacaaaaagcttaaaaattagtcaagccaggcatggtgactcacacctgtagtcccagctactcaggaagctgaggcaggaggatcaattgatcacccaggagttcaaggctgcagttagctatgatcattccatggcactccagcgtgggtggcagagcaagaccctgtctttaaaaaattaaataaagtaaaataaaatatacgctgggcatggtggcttatgcctgttattccagcactttgggaggtcaaggcaagaagattgcttgagcccaggagtttgagaccaacaaagcaagaccctgtccctataaaaaaattaaaaaaaaaaaagaattagctggacatggtggcatgtgctggctgaggtaggatgatcacttgagcctgggaggtcaaggctacagtgagttgtgatcacaccactgcacttcagcctaggcagcagagtgagactctaaataaataaataaataaatgttaaataaataaatgaggtggctcaggctccaccccacccccactatatcctctctgtgctatgcataactggcttgaaaactgggattggctggatgccatggcttgtgtttgttgggcggcagaggcgggggtattgtttgaggctaggggttcgagaccaacttgaacaacacagcaagaccttgtctgtacttaaaaaaggattagccaggcatgatggcactcactagtcccagctagtagggaggctaaggtaggaggatcgcttaagctcaggaggttgaggttgcagtgtgctgttatcatgccattgcactccagcctgggcagcagagtaagtcccagatcctgtctcaaaaacaaacaaaaaaacaaatcaggattaaagcactttattttatgtatgtttgtatttatttattttttttttttgagacagggcctcactctgtcacacagcctccacttcccaggctcaagtgattctcgtgcctcagccttctgagtagctgggattacaagcacatgccaccacacctggcttttttttttttttttttttttgtacagatggggtttcaccatgttggccagactggtctcgaactcctggccttaagtgatccactcaccttggcctcccaaagtgctgggattacaggagtgagccactgcacctggcctattttaattaaaaaaaattttttttttttgagacagagtttcactctttttgcccaggctggagtgcaatggtgcaatctcggctcaccgcaacctccgcctcccgggttcaagtgattcttctgcctcagcctcccaagtagctgggattacaggcgcctgccaccatgcccggctaattttttttttgtatttttagtagagacggagtttcaccatgttggccagggtggtctcgatctctcgacctcgtgatccgcccgcctcggcctcccaaagtgctgggattacaggcgtgagccaccgcgcccggcaaattttttttttttttttcaatcggtcagcttcccaagccagaggaggctcagaaagactccaacatttcattataaaaatattacatatttattatagaacagtttcaaaatactgataaatactgttttgttgaaaataaatacttgaggtcccatttcagaaaaacatgactgctgctatgacggtatgtccttatctacccccttttctagatttgagcaaagggaataatactgtatgccactcatataatctgctttcttcagttgctctttccacatcagtaagcactaactggcagcatcacttttgcttttgcaaatcttgtgatgggcaatctcggattaacatttgcctatatccttaattattccctaagcataaatttctagaagttgaactactgcatcagaaggtgcaggtttgaggctgggtgcggtgactcacatctggaatcccaggactttgggaggccaaggtgggtggatcatttgaggtcaggagttcgagaccagcctggccaccgcctctactaaaaataaaaaaaatagctgggtatggtggcagacacctgtagtgccagctacttgggaggctgaggcaagagaatcacttgaatccgggaggtggaagttgcagtgagccaaggtcgtgctattgtactccagcctgggcgacgagagactccatctcaaaaaaaataaaattaggatattgattattttgttgaaaattatcatctgatcccagactggcttatttcagtttatgactggagaatataaaattgtcttgatacctagaggaagtgaaaaaatacatttgctgaaaatgagctacttcttttttttttttttttttttttttttttttttgtgaaatggagcctttctccatcacccaagctagagtgagtacagcggcgtgatctcagttcactgcaacctccacctcccgggttcaagcaattctcctgtctcagcctcccgagtagctgggactacaggcgcctgccaccacgcccagctaatttttgtattttcaatagagatgggattttacctttttgatcaggctggtcttgaactccaggcctcaggtgatccaaccgcctcggcctcccaaagtgctgatattacaggcgtgagccaccacgtccggctgctgcttctttagtttagggcagaggttggcaaactatggcccaaggcaaaacctagcacatcacctagttttagggctgttttttgtttgtttgtttgtttttgttttttgttttttgagacagagttttgctctcattgcccaggctgtagtgcagttgtgtgatctcggctcaccgcaacctctgccttccaggttcaagtgattctcctgcctcagcctcccaagtagctgggattacaggcatgcatcactatgcctggctaattttgtatttttaggagagatgggttttctccatgttggtcaggctggtctcaaactcccaatctcaaatgatctgcccaccttggccttgcagattgctgggattatagatgtgagccaccgcgcacagccaggggtttttgtttggttttaaagagacacacatactgctctgtagcccaggctggagtgcagtgatgcaatcatgcaactcactgtagcctcaacctcctgggttcaattgatcctcctaccgggtctccctgtgttgcccaggctggccttgaactcttgggctcaagggatccacctgccttagactcccaaagtgctgggattacaggcatgagccactctacctggcccctacaatactatcttgaccctttacagaagtttgctggccctggtttagagccaaagagaagtgattcctggatctgtcccatgcccctcccaccccgcctctgggctgagtgtagaagcagctcatttctcttaaacgctgaccctgtcctgtggggatggtgacaagactcggagggtcccatgaagaaaagccttagatagctgctttatgagcaggcacaggaacaggtagacaacaggagggtgtgagcttttgggtgagagtgaacgtagctgctatgactgtagcagggcttccgaaatacctgcctctcttgggtggatcactgtggtgttagctagtggagatcagtttcggctatccaccacttgtgttttcaggagatggttagagtgattacgagcagaggcctgtgggaagaatgagatgcatattggttttgttttttcgttttgttttgtttttgtttttgagatggagtctcgctctgtcacccaggctggagtgcagtggtgccgtctcagctcactgcaacctccacctcccgggctcaagcagttctcctgcctcagcctccctagtagctgggattataggcgcgcaccaccatacccagctaatttttgtatttttagtagagacggggttttgctacgttggccaggctggtctcgaactcctgaccttagaagatccaccctcctcggcctcccaaagtgctgggattacaagcatgagccaccgcgcccggctgatatgcatattgttaacattactttgttcttggaccctggaagaggacatgtggaatgggaggtgggcccttaaacggtgctgtcttgttgccctttctgaggcagagagttaacaggaagggacttttgtcatcctctagatccggaccatcgccatcatagctgaaggcatccctgaggccctcacgagaaagctgatcaagaaggcggaccagaagggagtgaccatcatcggacctgccactgtgagcttcccctccggaaagccttttacgttcgatgctatcttatgaagttcaatgcccttaggaagtttactttttgactcctctatctccctcctaggttgagaagattcaggaagtatgtgttgaaaatcagtctgtccatttttagctttttttttgagacacagcctcactgcaatgcctaggctggagtgcaatggcgcgatcctggctcactgcaacctccgcttccgggttcaagtgattctcctgtctcagcctcccaagtagctgggattacaggcacccgccaccatgtccggctaatttttgtgtttttagtcgagacgggatttcaccatgttggtcaggctggtctcgaactcctgacatcgggtgatccacccacctcggcctcccaaagtgctggagttacaggtgtgagccaccgtgtttggcctttttttttttttttttttttttttttttctttgagacggagtcttgccctgttacctaggctggagtgcagtggcacgatcttggctcactgcagcctctgcctccttggttcaagcaattctcctgcctcagcctcccgaggagctgggactataggtgtgaaccaccacgcctggctaattttggtatttttagtagagacagggtttcaccatgttagccaggctggtctcaaactcccaacctcaggtagtctgccccctacagcctccaaaagtgttgggattgcaggcgtgagccaccatgcctggctgaaattattctttgaattattttttgtttgtttttttaagaagcagggtcttgctgtgttgctggagtgcagtggcttttcacaggtgcagttataacacacttcagcagccccgaactcctaagctcaagcaatctccctgcctcagcctcctgagtagctgggattccagaagtgttctccacacctggcttatttttacttcttactgtattaaaaaaatggagctagtatttatttccaaagagctgagattacagacctgagccactgtgccgggccaagtatacgtatctgaacctgaattagtgagccatgctttacaaataaggctctcttttgttctgtatgtctcttgagagagagaggagactttcctaagcaggaaacccagtgggcaagtgtgatttctcttggtcattctctccccagcctggccagaaggggctgggcagtaatgcaggggctttgtgattctttgtggtgaatctggaagtcaccttcctccctgattgtggtttctgcccccacaggttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtaatcagctgggaagccaaggaggggcttcctgctttgagagcagtgggctaggagacgatgctgtgtcctgcaggctgcttgctgcccctgagttccaggcccgcaggaatgctgctgaagtctaaacaatggggcatcactgctcttgtctcaggactgacagagcatgaaatcggaaaacacagaacagggcaacaatgtgcaggaggggcgactgggctttggggataattctgtttgttgtgattggccatagggaggcagcagagtacagtggttaggagggccagttctgaaattggactaaagaggttcaaatcccattttccctctttagtagggggtgggtggcaggggccatcctggtccggttacttaacctccctagacctccatcatttttacacatcaaatgggtaaataatacccccacctcatggggctactggaggaataaatgaattgtaatacatataagtgtctgagccagggcctgcgttcagcaggtgctcagtgagtttttattgtagttaataatagtatcctcattatttttggtagtgggaacactgatcagtaggtcatgaatacagtattatatctcagagtaacgtctggcacttagtaggttcataataaatgttagccattattgtttattattcctactattactactgctgtcgggcttagaaaccaaaagctgttgagatagagtcaccttgttcgtctccctggctctaccacatgatttccgataggatgcctgggtgaggaagaactctcaccaaggtctttaggggtgtagcctgggaatccccagtccttgggtactgcctgaccaaaggctcagggaataagtctaggaaatgctgcttgtttagattgtcttcttagatttataatgatcatatcaaaagacatgaagaggccaagaacagtggcttatgcctataatcccagcactttggggggctgagggaggaggattgtttcagcccagaaattcgagactagctgaggcaacacagtctcgaatttggtagagacccccatctctaccaaaaaaaaattagccggatgtggtggcatgtgccagtagtgccagctactttggaggctgaggcaggaggattgcttgaacccgggaggcggaggttgcagtgcaccaacatcgcaccactacactcaagcctgggtgaaagagcaagacttcatctcagaaagaaagaaaatatgtgtgtgttcttaggttttttttgtttgtttgtttgtttttgtttttgagacgatcaaaaaattcaagcgatcctcccgtctcagccacctgagtagctaggactgtacaggcgcccacgaccacacctggctgatttttgtatttttagtagagacggggtttcgccatgttggccaggctggtctggacttcctgacctcaggtgatccaccctcctgggcctcccaaagtgctgggattacaggcgtgagccactgcgcctggccggaatttgtggatatattttaaaacaactgcaccagggcgtactttctaagtcatctcttactgctgagcgaacctctctgggcttattttgtgcccagtcttttcctttgcaagttaaatagctccaactccttccctctttcttctcttctgttccatttgctaccttcccctgtccattattgctggggcatctctggacccttactggccatccacatccccccaaaatccagtgtacccagtacaagtgtgcttcctaaccctgtacacacttccccaggcctcctcctgatcctgtatcctgatactccctgctctcaacaggtacccgggctccacattcatggatcatgtgttacgctatcaggacactccaggagtcaaaatgattgtggttcttggagaggtgagttactttaaaaaaaaaaattatgattttaaaactgtaatgcatgatctcagttttcaaaaaattaaaacattttggttacatgtaacttaaagggacagtccctggtaatcccatcccctagatgctggggcctcaaggttgtcactattagtactgccatttatgtttcagagaagggagttcttaatctcccagcatcccaaactttagcgccaataagagagaagctctgctctggctggccatggtctctacctggtgggcagtggaaagctggagtaaaaaaagtgcatttttttggccaggtatggtggctcacacctgtaatcctcccagcactttgggaggctgaggcaactgggtcacttgagatcaggagttctagaccatcgtggcctacatggtgaaaccccatctctactaaaaatataaaaattagccaggcatggtggtgcacacttgtaatcccaaccactcgggaggctgaggtgggagaatcacttgaacccaggagacagaggttgcagtgaacagagataacgccactgccctccagcctgggagacagatcaagactccgtctcaaaaaaaaaaaaaaaaaaaagcaaaaaaaaagcgctttttaaaaaatgtgatgacttttggatagaacggttaaaaaaaattttctaaatactaaaaaatttgggagtcccataaccccatcccttgtttgcacctctgaaggcaggtctaatcctaaatcatgttatatttctagattaggaagggggagtcccagagattcctctaggagacctgctgtttgttcctttagaaatcttccttgtgtccaggctgaaattaaactccttttatttggccaaagcccgtgtcactccattttctatccagtttttacgtcaggatgggctgcactaacttggctttttctcattccccattccttggcagattgggggcactgaggaatataagatttgccggggcatcaaggagggccgcctcactaagcccatcgtctgctggtgcatcgggacgtgtgccaccatgttctcctctgaggtatggctgagatgggtcacttctgggctgggagtggggattgcaagagggggcatttgaggcgaaccaggtaatcatcttattaattcgcagctagttccttcaagaaacgtttgttacttgcttggttactacaaagtccagccagggccctgctctctgggagcttatatccagttggaggagaccaatttataagcagattaaagctacagtcaggctctgagtccctacttggcgtaggtagcaaccagctgtctggagaagttgagatggcatccctgagaaggtgatgtttgaactgtagtttaggggatgagaagggctttgctgatgaaagggaggccaaggagggagaaggacacagcctgggctcagctgggcggggcttggtgagatgttttgtgtggggagaggtggtagaaggaaaggtttgttcttgatgtgttaaaatgataaaatgtacttgaaagtgtctggcgcacctgatggtgttgaatataaacactccttgggcttctgctgtctgctaagcttctgagctatctgtcttctgctgggggatcatacgccagacttcagcccctgtgcttcggcttagagaaccctttaccaccttgaaggtggctcacgtgatgatgatgaaattgaaggaaaagccgggtacctggtgtgtgtacaagaatactctgcagtatcattaacagcaaaaactggaaacaacttttttttttttttttttttttttttttttggagacagggtctcactctgtcgcccaggctggagtgcaatggtgtgatctcggctcactgcaacctccgcctcctgggttcaaatgattctcctgcctcagcctcctgagtagctgggattatgggcgcatgccaccacacccagctaatttttgtattcttagtagagatggagttttaccatgttggtcaggctggtctcgagctcctgaccttgtgatctgcctgcctcatcctcccaaagcgctgggattacaggcgtgagccaccatgcctggcctggaaacaacttacatgcttatcaggaggggactgtcagcatggcatatccacaaactaatggaaaacagggcaggcatgcaaagaaggaggtggaacttgatatgttgatacagaaagagtttaagatacattacctgtaagaaagggcagagttcagtaaatgcttataatatccattttgtgtaaagtgtgtgtgtatgtgggttttattttttatttttccatgtaagtaaaaggggaggagaggtccagaatcctgcccatccctccagggtgagctctgcttgcacaggctttaaaatcagaccttggtagatctgtgtagccagacgtggtggcaggggcatataatgccagctactcgggaggctgaggcaggagaattgcttgaacctgggaggcggaggatgcagtgagctgagatcagatctttaaaatcagatcttggtagacctgggcaagtcatttagcctcttggtaactgtttcctgagctgtaaaatgaggatgccatgccgcaaggttgttgtatgacttaaatgaggaagtaattgtaaaggtctggcgtgcataggtcttagaaacttcttttttttcccatgccttgtcagtccgcttattccatgaagctgttcctgattctccttttttttttttttttttttttttgagacggagtctctcgcctaggctggagtgcagtggtgcgatctcagctcaccgcagcctctgcctccctggtttaagcaattctcctacttcagtctcccaagtagctgggataacagccaccacgcccggctaatttttgtatttttagtaaagacagggtttcaccatgttggccaggctagtctcgaagtcctgacctcaggtgatccacctgcctcggcctcccaaagtgctgggattacagccgtgagttaccgcacccagccgattctctttcttcttgagtgctctcccccaactccattgctctccccccaactctgtactcgcccaacagccaaaaaccagtcaccctcctccattgtttctcctggcttgctttgcattaccagcccctccccctttccaccccacctccccatccccaccatgatcaggacacttctaagagggtgagcacctcgcatttcagtatctggtggcactcatcgccccatgggtggggtgggtccttgaattattttaggtttttgtgtttttttttttttgagacggagtctcgctctgtcgcccaggctggagtgcagtggtgcagtctcggctcactgcaagctccacctccggggttcacgccattctgctgtttcagcctcccaagtagttgggattacagacgcccaccaccacactcggctaattttttttgtattcttttagtagagatggggtttcaccgttagctaggatggtctcagtctcctgacctcatgatccacccatctcggcctctcaaagtgctgggattacaggcgtgaaccactgcgcccagccctttagttttgttttttaaataattcatctcccttttagaaattttgtttttagttttgagaaatccagagttacaagaaacttaacttctttaaacctagggtttctgagtatagactctcttcttcccacccatctgccgatgcagattaaatcctacaaagaacgcattgggaactcacgctttaaggtgtctttcaacctttgcttacagagcagcagttcctaaccttttcacctttttgttctgtttgcatggtgaagagcacaggctgaggccagattgcctaggttcaagtgctaccacatgctacctgtgtgacctgggataaatcactttacccatctgtgctcccatttccttttttataggaaacgatcatagctactgagattgaatgagtaaaactcttagaaaagtgcctgaacatagtgttatgtaaacaggttagatagtactatgattactctctgcaccccatcctaagacaaggctttgcatcagatgtcttgtgggttaatttcctccatcgcttgattaaagactcagtcacgctgggcgcgctggctcatgcctgtaatcccagcagcttgggaggctgaggtgggtgggttgcttgagtccaggagttggagaccagcctggaccacatggcgaaaccctgtctctactaaaaaactacaaaaaacttttagccaggcatacacctgtggtggcatacgcctgtagtcccagctacacgggaggaggtgggagaatcacccgagcctgggaggttgaggctgcagtgagccaagatagcaccactgcattccagcctggggaactggagcgagaccctgtcttgaaaaaaaaaagaaagaaagaaaagacaccgacaccatttagcacttcttttttttttttttttttttttttttttttttttttttttgagacggagtcttgctcttatcaccctggctggagtgcagtggcgcaatcttggctcactgcaacctcagcctcctgggcacatatctatagtcccagctattgaggaggttgaggtgggaggattacctgagcccaaggaggccaaggtgccagtgaaccgtgactgcatcactttactcctgcctgggtgacagagtgagaccctgtcacttaaaaaaaaaaaaaaaaaaaaggcggggggggcaggcgtggtggctcacacctgtaatcccagcactttgcaaggccgaggctggtggatcacctgaggttaggagttcgagaccagcctggccaacatagtgaaaccccatctctactaaaaatacaaaaattagctgggcgtggtggcaggcacctgtaatcctagctactcgggtggctgaggcaggagaatcgctggaacccaggaggcagaggaaggtgattctggagttgggctgccagtctttgtatcctgacttccatgcaccttagctgcgtgaccctgaggaagctcctgaacttctctgtgctttggtttccttgtctgtaaaatggaaatcatctattgtacctattcagtgagcttgcttgaggcttaaatgaagtgattcatgtaaagtgtttagcacactttacatgggattctatgttcactcttgggggattagcagtaaagctactttcctttgctttccaggtccagtttggccatgctggagcttgtgccaaccaggcttctgaaactgcagtagccaagaaccaggctttgaaggaagcaggagtgtttgtgccccggagctttgatgagcttggagagatcatccagtaagtggaccttggggaggatgccggcctccccctcctttccaaatccctcctgagacagcagcctctcccacacagggacatcatgtattcctggtccctctcggtgtctagcgcagctgtatggatggttcaaaatcctctttctctttggctttccttttgttttatttagtttgtggaggcagtaggtctaggctggtattaaaatgtgttgagtttctgagcctacctatttggctgggaggtggcagccatagatgagagcgccacatgaaaatgtttagagagtgttatctatgattgatagagagttattagatatcctgtgatctcttcccatttctacctcttaaacctgcctggactcccggctgtgtccttccttgccatccagagattgggacatgaggtagtagggagcagagggcaggtgcagtcttggctagaacttcttttcatttagttctcagaattcagcaggtaagagtaaactaagaaacctacagtgtttgggttagatagagcattcttgggatgtcttacaggagcccaaaataagaaaatccacatggatgtcttttttttcctgcctcccaggtctgtatacgaagatctcgtggccaatggagtcattgtacctgcccaggaggtgccgcccccaaccgtgcccatggactactcctgggccagggtaggtgccttaaatgtctctaacagtgtgagcaagggagatctgtgggtctatggtggtgggtttcgcgttgatttgccttgaactcttggaaaccaggccttctgtattagtcggggatctcttagagggacagaactaataggatatatatatataaaggagagtttattaagtattaacttacatgatcacaaggtaccacaataggctgtctataagctgaggagcaaggagagccagtccgagtcccaaaactgaagaacttggagtccgatgtttgagggcaggaagcatccagcacaggagaaagatgtaggctgggaggctaggctggtctctcttcttcacatttttctgcctgctttatatttgctggaagctgattagattatgctcactacactaagggtggatctgccttccccagcccactgactcaaatgataatctcttttagcaacacctacacagacacacccaggattaatactttgtgtccctcaatccagtcaagttgacacttttggaggtcaaggtggaaggactgcttgagaccaggagttgaaggctgaagttagccatgactgtgccactgcactccagcctgggtgacagagtgagaccctgtctgtaatttaaaaaaaaaaaaaaaaaaagggctgggcctggtggctcatgcctgtaatcccagcactttgggaggccagggtgggcggatcacctgaggtcaaaagttcgagaccaggctggccaacatggtgaaaccccatctctactgaaaaaatacaaaaattagccaggcgcggtggtgggctcctgtaatcccagctactcgggaagctgaggcaggagaattgcttgaacctgggaggcagaggttgcagtgagccaagatcgtgccattgcactccagcctgggcaacaagagcgaaactccgtctcaaaaaaaaaaaaggagagagagagatagagaacatattcatgttgtttttgtaataaaaatgtaactgtaaagcattttaaaaattcatagaggataattggagaaataggattggactaaattggctgatttgcctcaactctggaaatgggaaattcaggaattcagtccccgtcccctgggtaaaagacatattgaagggctcccccatttcttttttttttttccttttttattttttatttttttgtattgatcattcttgggtgtttctcgcagagggggatttggcagggtcataggacaatagtggagggaaggtcagcagataagtgaacaaaggtctctggttttcctaggcagaggaccctggggccttccgcagtgtttgtgtccgtgggtacttgagattagggagtggtgatgactcttaaccagcatgctgccttcaagcatctgtttaacaaagcacaccttgcactgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctttctacacagacacggcaaccatccaatttctcaatcttttccccacctttccccctttctattccacacaaccgccattgtcatcatggctcgctcgcaatgagctgttgggtacacctcccagacagggtggtggccgggcagaggggctcctcacttcccagtaggggcggccgggcagaggcgcccctcacctcccggacggggcggctggccgggcggggggctgacccccccacctccctcccggacggggcggctggccgggcggggggctgacccccatctccctcccggacggggtggctgccgggcgaagacgctcctcacttcccagacggggtggctgccgggcggaggggctcctcacttctcagatggggcggctgccgggcggaggggctcctcacttctcagacggggcggttgccaggcagaggatctcctcatccccacatctcagacgatgggcggccgggcagagacgctcctcacctcctagatgggatggcggccgggaagaggcgctcctcacttcctagatgggatagcggccgggcagagacgctcctcactttccagactgggcagccaggcagaggggctcctcacatcccagactatgggcggccaggcagagacgctcctcacttcccagacggggtggcggccgggcagaggctgcaatctcggcactttgggaggccaaggcaggcggccgggaggtggaggttgtagcgagctgagatcacgccactgcactccagcctgggcaccattgagcactgagtgaacgagactccgtctgcaatcccggcacctcaggaggccgaggctggcggatcactcgtggttaggagctggagaccagcccagccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtacagtccagcttcggctcggcatcagagggagaccgtggggagagggagagggagaccgtggggagagggagagggagaccgtggggagagggagagggaggggggctcccccatttctttagccacgtatctcgtcccccctttttttttttttttgagacggagtttcacttttgttgctgaagctggagtgcaatggtgcgatctctgctcactgcaacctcctcctcccagattcaagcgattctcctgccttagcctcccgagtaactggggttacagacacataccaccacgcccagctaatttttgtagtttcaatagataatggggtttcaccatgttggccaggctggtctcgaactcctgacctcaagtgatccgcctgccttggtctcccaaagtgctgagattacaggcataagccactgtgccctgccccattacgttattgttatggttggcagctatatctgaagtgtatgtaagattttccctttggattcattttaccatttcttacccaggtgaccttgggctggttactgagcctctctaagcctcatttttttttttttttttttgctataacacaaggaatgcttctcctttgtgaggttaaaatgaagcaatgggctggatgcagtggctcacgcctgtaatcccagcactttgggaggccgaggcaggcggatcatgaggtcaggagattgagaccatcctggctaaaacggtgaaacctcatctctactaaaattacaaaaaattagctgggcgtggtggcaagcgcctgtagtcccagctacttgggaggctgaggcaggagaatggcatgaacctgggaggcggagcttgcagtgagctgagatcgtaccactgcactccagcctgggcgacagagcaagactgcgtctcaaaaaaaaaaaaaaaaagaagcaatggactgggtctcacgcctgtaatcccagcacttggggaggctgaggtgggagaactgcttgagcacaagagtttaagaccagcctggacagcatagcaagaccctgtctctacaaaaaaattttaaaattagccaggcgtggcggtgcgtgccttgttgccccagctactgggaggcatagctgggcagatcgcttgagcctagctaggagtttgaggctgaagtgagctatggtctcaccagtgtactccagcctgggcaacagagagactctggtccccctccagaaatgaagcaatggatatgaactgcttaggctatttcctagcccagcaaatgctcagggaaggatagaaatagagctgatagtgctgatgccaagtggtgtcatgggtcctcctgttttctatgtccaaaatgatctaatgaaagggcttttgcacttctttcttgggaaaactttgagagttgttacttggctgccagagtttacgacattcctggggtgctttggttctgagagtacacacagcagggcagtcctggaaaaatctgtggtggtcaccagggccctgcttccctcttccccatctctgcccaggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggtgagcatggagggcagaagattacagggccctgcagctcagagttaatgattttcccccaacaaaggggtgggagtggacaggcctggggagtgtgtccaagatcaatctttggggccacaggtcaattgagcggccagaggaaggacacataaactattcctaagtcttccaaggacagaaagtccagtcacatgagccactgcacccaaccaaatgcagatctcttgacagcaagatagaggttaggcaggagagaactggaaagatgtggtggcctaaggagtgtgggcctggtggagctgctgaacagatagaaagtaccttatgggctaggcgcggtggctcacgcctgtcatcccagcactttgggaggccgaggtgagtggatcacctgaggtcaggaattcaagaccagcctggccaacatggtgaaaccccatctctactaaaaatacaaaaaggtagccaggcatagtggtgcacgcctgtaatcccagctaatcaggaggctgaggcaggagaatcacttgaacccgggaggtggagtttgcagtgagccaagatcacaccattgcactccagcctgagcaacaagagcaaaaatattccgtctcaaaaaaaaaaaaaaaaaagtaccttgtgttcactttgcaaatttgtttctcccatcagcttgaatgttagaaaaaattggttttctctgcaactcccaatcttagccctcccgtgggactgacggctgggcaggggagccagtgagtatgtgattcacagagccctgggcttaatgtgatgctgggcagaaggccaggtcaatgtctttggttgtgtcatgccctcacctgcagagagatgggtcttggtcctgctttggacccttcctgggaaaagttcacgggttataacacctgagcaggtctctctctgtctgctcctgcctcccacctctccatactttgttcctgattcttagttgggaggttgaatactacaggaatgaggcatggggcctcctacactgtgaagggacagggttctcacctcctgtcagtctggcacatggagcatagccacaaatacaggtcaaatcctggtacaggcaactcatgctgaaaatcactgatcaaagaatagattcaaaactctggtttcaaactctgttttacaaacagtatttggggccgggcgcggtggctcatgcctgtatgtaatcccagcactttgggaggccgaggtgggcagatcacttgaggccaggagttcgagatagcctggccaacatagcaaaatctcgtctctactaaaaatacaaaaattagcctggcgtggtggtgcgtacctgtagtcccagctacttgggaggttgaggcaggcaaattgcttgaacctaggaggtggaggttgcagtgagccaagatcacactactgcattccagcctaggcgacagaatgagactctgtctaaagaaaagaatcaggaggttttgccttagagttgtgtggtagtattagacttggattggtagttacccttcttggatttgaatgacttgtttagggagatgggggaaagtacgagcatggccttgtcgaccatctcctggcctttgttccccccactccaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcgtaagtactgtcatcatgggaggtgaacagtggggacactgggccttggcctcatgctgctttgccacagcagggccctagaaggagcccctgagtgtaaaacccagtgctcagggccgttcgggacacactgggttggtttgcccagctgaaggaaactcttaaagctcaaggcaacacgcacttgtttctcctccagggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcggtgagttgttactctcctaaaaaagtgggatggaggccaggcgcggtggcccatgcctgtaatcacagcactttgggaggccaaggcaggtggatcacttgaggtcgggagttggagaccagcctgaccaacatggagaaaccccgtctctactaaaaatacaaaaaaattagccaggcgtggtggtgcatgcctgtaatcccagctactcaggaggctgaggtaggagaattgcttgaacccgggaagtggaggttgtggtgagccgagattgtgccatggcactccagtctgggcaacaagagtgaaactccatctcaaaaaaaaaaaaaaaaaagtgggatggatctactgggtgggtggtgatagtgggggcattaatttatttgggagaatacctaagctttcaactccaacatacaaagctttggatgtgttgacagatgccaaatacaaagcagctattttttccatgttataatacagattgcccttaacagtttttctgtcgttcgcttgcagtatggaaatagcagttgaaatgagatggaaaacttggtaactttggtttcccaaatgaatcttatgggtaaaagggccaaggtcaggttgaggggacatattggtcaccttcggctagataatacctcattccgcagtaacagacaactccaaaaatctcagtggcttaccacagcaaaggtttatgtctcattcacactacatccactgagggtttgctgtgcctgttctctgccatctgtgccgaaagaacagccgccgtctgggatgtgctggcctcacgtcagcaggataacagcaatggcaggaccacgtgcaggctcttaaagccttacatgattcaccttcactcacatttcattggccaccgcaagtcaagtggttatttgtgacatcactggggcaggaagagtgacaatatcaaggcatatctgattgggagagaccagtgggaaaggacagtaaatatttgaaacagtttatatagtctcacacagggccggtcatttctatgtccttatattgtgctttggttagaaaccaaagagcaagagatgaggtcactggcagctgctcagggccttatggggacagctccttagcagatccctttaccctgggctccttggctctgtagctccagcaacctcatttatttggtcactccactggcctaggtggggagtattaacatgaaggtcatgcatgtgattcaggacaccaccttctaggcagccaaacacttggccatctcaggtgatacccagaggttgcttgatgagcaaggaccagctcagaaccaagcagggaaggtgggtggctctgagggacattccatccaggacttgcttgactttgctcagccagccccagctcctgagcatataacaacatgcctatgtacagcacagagcctctttctaagataatgctagacttgcactccacactcactcattcactctttgagctccccgctttctagaggatgtactgacccagctatctcttttgctgagggctgaagttgctttggtattcgatttggtatgtccctagatcatcttcctccccaactgacaggtggttaatttcattcacagcaggtctagagttttccctaaaattttgggaatactttgcctccccacactaaacacgtgtttgtttagtgttgaactttgtcacagcttgagtaggcacagagctggcgggggcatggctggaggctggaacctaagactcttgagttggagagtggttaactttcagacctctgctgctcaacactgtaggacctggccagttccctgaacatctcagggctcagtttcttctttgcaacttaaaagtgagaacctaccaaggttgttttgtgtcccaattgagatatgagaggacttcaaaagccagcctcatggcattagcacaattggtgccacatggaatggtacacgtgggccaggttcctgaatcgccgctgggatatgtccagttctacctacctgtaacacaagtatgaacaaacacatcccagcagtgtgtgagtgttcctctgtaccgttgggttcatttctagataaacaacccagacatgcgagtgcagatcctcaaagattacgtcaggcagcacttccctgccactcctctgctcgattatgcactggaagtagagaagattaccacctcgaaggtaacaaagaaaaaacttcctaattccctcacgttggacaagtttattggaggaaacaggagccacgttacattttgattatgcagctaaaagcaaacctagttttctagaaatgttatttttgtttcataactaaatttaacagacatgcactaaatgtcaactaggtgttgggtactttgctagatgctgggaattgaactgagtcagacacagtgtcgaccagtggggctggtagaaggtttttaaatgatggtcacaattcgtagtaatagtagtgacagtggaaaattatgaagaaaaaatgagaaataatgataaatgctttgaatttttttgccttcccagaagccaaatcttatcctgaatgtagatggtctcatcggagtcgcatttgtagacatgcttagaaactgtgggtcctttactcggtgagcattgtagctgttttcttcttcattacgtttgttgatttttgttgtttcctccaaactataaaagtaatgcatactcataatagaatatttgaaaaataaggagaggtataaagaagaaaacaaaaattgcctgtaatgctaccacccagagcaccccttttcttctcattcttgggcagtagtagtactgtctgtggggaggagggcagtcacgtgagccttttaaaactacaagttgatgtgtgttgcagggaggaagctgatgaatatattgacattggagccctcaatggcatctttgtgctgggaaggagtatggggttcattggtgagtccattcgttgttgttttaagtgtttttttttaaaccccacggttcagctacaccacttactcatggggttgagtttctttttctttctttttttttttttttaattttctttttgtggttcagtttctacagaagaaatgtcatatcctcttaatcattgttcttaatctttcctttcttactttaacctttccccttatctttatcattgttcctttgttcttagaaatgattgctagcccaggaaaatttttttttttttttttgagactgagtcttgctctgtcaccaggctggagtgcagtggcgcggtctcagctcactgcaacctctgcctcccgggttcaagcgattctcctgcctcagcctcccaagcagctgggactacaggcgcatgccaccacgcctggctaattttttgtatttttagtagagacggggtttcaccatgttagccaggatggtctcgatctcccaacctcgtgatctgcccacctcggcctcccaaagtgctgggattacaggcgtgaaccaccgtgcccggcctatttttattatttattttattttattttttccctttaaaattttgttttaatttaaaggaaaatagaatcagatccagcagctcccttgtacaaagtccgcctcatctacctatacagtggatttggactaaacttcccactgctttgtgtctactttttttgtgtgttagaaagatttcccttccttagcctcttcctctcaccaggcttatgaagctctaataaaaaagatgtgtttgcttcattttaggacactatcttgatcagaagaggctgaagcaggggctgtatcgtcatccgtgggatgatatttcatatgttcttccggaacacatgagcatgtaacagagccaggaaccctactgcagtaaactgaagacaagatctcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaac

SEQ ID NO: 35784 - DNA, 52092 bp, Homo sapiens; identical to SEQ ID NO: 35783

SEQ ID NO: 35785 - DNA, 98250 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtaccccggatcccctgacttgcgagggacgcattcgggccgcaagctccgcgccccagccctgcgccccttcctctcccgtcgtcaccgcttcccttcttccaagaaagttcgggtcctgaggagcggagcggcctggaagcctcgcgcgctccggaccccccagtgatgggagtggggggtgggtggtgaggggcgagcgcggctttcctgccccctccagcgcagaccgaggcgggggcgtctggccgcggagtccgcggggtgggctcgcgcgggcggtgggggcgtgaagcggggtgtagggggtggggtgtggagaaggggtgccctggtgcaagtcgagggggagccaggagtcgtggggacgatcttcgagggaaggagaggggcatccgtagaaataaaggcacctgccatgccaagaaaggtcgtaaataggagtgagggtcccggggataagaaagtgaggtcggaggaggtgggagcgcccctcgctctgaggagtggtgcattcccggtctaaggaaagtggggtactggagaataaagacatctccaataaaatgagaaaggagactgaaagggaacggtgggctaggtcttgagggggtgactcggcggccccctcccgggagttcctgggggctcggcggccgtaggtttcggggtgggggagggtgacgtcgctgcccgcccgtcccggggctgcgggctggggtcctcccccaatcccgacgccgggagcgagggaggggcggcgctgttggtttcggtgagcaggagggaaccctccgagtcacccggttccatctacctttcccccaccccaggtctcctcttggctctgccaggagccggagccctgccaccctggctttgacgccgagagctacacgttcacggtgccccggcgccacctggagagaggccgcgtcctgggcagaggtgagggcgcgctgccggtgtccctgggcggagtagggaggggttggaaaggggccgagaaattgcactcccacacccctgggttgcaatgggcaagctccctccttggctcaaacgacaccccttggaatttacgcagatttggggatccaaacgtttacgactgaacactgtggtggagggggtaaccctgcctggttgttgactatgttataaagaagaggaggttgagggcacttactagaagccttcgtatttctcttattgccctcagcactgtagagacagtctctcatttcagactgcaaaaacctggtgggtgggaaggcctggcaggagtattcccgttttacagttgagcaaaccgaggctaagagagtgacgtccacttgctcagggtcagcagagcagatatctgaactgggatctgactcccaggccccattaagcaccatctctgggatgactgaagagcagccctctcttggttactgggctgtggcttttgtttacagatataaaagcttttttttttttttttttttttttttttaaagacagggtcttgctctgttgcccaagctggagtgcagtggcacaatcatagcttactgcagcctccatcctctgggctcaagtgatccttcccatctcagcctccctagtagctggttatcatgggcatgtgccaccacacctggataattttaacttttttttaggctgggcgcagtggctaacgcctgtaatcccagcactttgggaggccgaggtgggcggatcacaaggtcaggagttcgagaccagcctggccaacatggtgaaaccccatctctactaaataaaaatataaaaattagccgggcatggtggcgtgtgcctgtaatcctagctactcaggaggctgaggcaggagaattgcttaaacccaggaggcagaggttgcagtgagctgagatagtgccaccgcactccaacctgggtgacagagcaagactccgtctcaaaaaataaataaaaaataaatttttttttagagacaggagtctctccatgttgcccatgctggtgttgaactcttgggctcaaaggatccttctgtctcagcctctcaaagtgctgggattgcaggcctgagagactgtgcctggaccaaaacatcttgatacaggtactgtttcccccaaggaataatgatttttttttttttttttttttttgagatggagttttactcttgttgcccaggctggagtgtaatggcgtgatctcggctcactgccacctctggctcccaggttcaagtgattctcctgcctcagcctcctgagtagctgggattacaggtgccaccaccatgcccagctaattttttgtagttttagcagagaaggggtttcaccatgttggccaggctggtctggatctcctgacctcaggtgacccacctgcctcaatctcccaaagtgctgggattacaggcatgagccagcacgcctggccaggaataatgatctttttttaaaaaaagcatggtagttctgactcaggatgaaaatgcatacacccaatgtacttctaggccttatcgttgtgacaatctagagtttgctttgttccacttgactgttgtccagggagcaagggaaggggctagtttctcttctggtttcactgaatcccaagtgcttcctttatatcaaaccactttctcctctctcatgattttacttgattgggtatcacaataagaggcattttttttttaagagaaatcacccacaattcccctgagggaacacctccactgtgtcattcttccagtctttgaccacatgaatctttagcaatcacgctgttgtctttacattttttttttgaactttggaagtcattcgaagttttttacagagaaactacagctcgactgatgaagtatatttgctctgtgtgctctagagctttctattggatcagaagttatctctaactcctgggctcaagtgattcacccgccttggcctcccagagtgctggggattggatattttgatgtcagtgggcattgaggagtggcttctcggggaaggcaaacttgatccagtcttggagagcaaggcaggggctagaaacaagcttgtatctgagcatgcgtctggggtgtcccagtgctaaggctggtgactttgttttcctgcaccaagatatttggtagcaccaagggtgggttggtctggtttttatttctcccttctaagctcctgtgtttgaccaataatattattacatattaacactaatatgttaataattaatagtgacacgtattcacttttgcctcagactctggggcaagtgcttcacatattttacctcatttagtcttcactagaacgttaggagggtgggcactgttattcttcctactttgcaagtgaggaaactgaggcataaagcaattctgtaatctgaagcatccgcagttggtcttttctcttcctttttctccttgtttttcacctcaataacctgaaaaaacaaaaacaaagaaaaaaggtgtttggggaattagtgtccaatgtgaagtaagctgagaatggaggtgttgacagggtgggacctccgagagggggtggtgatgatggagatgggtcagacccgggggaggtggcgggggaccctgggactggtgatttagtgggaagaggcagccttcacacagaatccgcaggcctctggtgtggttggtttcagttccctttatgttcacagacccccacccccacacaacagatttcctgacatttaatatttgttttggcttttttggactgtggggtctccttgtatcagtccaatgtggagtcgccccaggatggaagtgcccttctggtaaaatcacacgttcaatctgaggaactggcttgtgattttaaaaggccgctaggacttgggatgtggcctgactctctttggacagtgcacggaagtgaagggatggatgtaacattggcaccaggtttagacattggcttcatggagaatttactccatgggaattttgaaacttgaaacctgtcactttttgtgcacaggcagctgtagggtcttaactcaggggactttggagtgtttgctagggtcattcctctgccccatgctgtggctgaccccatgatctcaaccttgtatttattccattggtttatctccagcttctagaatgaagacctttacaaaaaaaaaaaaaaccaaactcaactgtaataaaccagtttttgttttgagacggagttttgctcttgccgcccagcctggagtgcagaggtgcgatctcggctcactgcaacctctgcttcctcagttcaagcaattctcctgtctcagcctcctgagcagctgggattgcaggcacatgccaccatgcctttgtatttttagtagagacaggatttcatcatattggtcaggctggtctcaaactcctgacctcaggtgatccgcctgccttggcctcccaaagtgttgggattacatgtgtgagtcaccatgcctggctaataacccagtcctttagagttgctgcttattttccttcttcatagcacacaccggtctgagaaacccaggctattagacagtttgggatctctgaagtattagcctagtaaccacagctgtaagttgactcaggcgcggaaaaaagaaaagctggcaggctttcccagtgattgttttcttcctttgcttgctctgcaatctggccttggaaacacagggcctatatttcagtgttgaggtttggctgcttgaggggttgacctagttcacaggcacccaaactttgtggattaaatacacccatttcccctccttttttttttttgagacggagtctcgctctgttgcccagactggagtgcagtgacgtgatctcggctcactgcaacctctgcctcccaggttccagtgattctcctgcctcagcctccctagtagctgggactacaggtgtgtgcctccatgcctggctaatttttgtatttttagtagagacagggtttcgactacggccataccaccctgaacgcgcccgatctcgtctgatctcggaagctaagcagggtcgggcctggttagtactagtacttggatgggagacagggtttcaccatgttggttaggctggtctacaatctggagttttgctcttgttgcccaggctgggcaaactcctggcctcaggtgatccgcccaccttggcctcccaaagtgctgggattacaggcgtgagccactgtgcccggccatttcccctcctttctgaaggatgtgctgaacgtttcagaaaacagtatgcagcctccctaatacaattagacttttaaaaagcaaacccagaaaccagctttgggatcaccttacatcatcagatccccaccccctacccctcaaactcataaaagtcacttccccaattactcatgtctgtgacaaaggttgatctgagcttactgggaaagaagaccagtgggccgccctcctggccttgcctttgtgtctctggaggtgcggaggtggaaagtcttgggcccggcaaggccatgtaaagaaggcaggctgctgcttcctcccagtggggccctgcctgcccctctctgccaggtggttatggaaatccctgtttgctctccagggctttttattgggtgaggcttttcttccaaaatgctcaccttgtgtctgttacacattcccttccaaggtagccccagatacgccagaggctgaagctctcgtatctcccagaagctgcccaaaccctaaaatccccgagaggcacctgtcccaatccaatccttgctgggtctctttctttctttctttctttctttctttctttctttctttctttctttctttctttctttctttctttctttctttctttcttttcttttctttcttttgagacggagtgtcactctgtcgctcaggctggagtgtagagaggtaggatctcagctcactgcaacccccgcctgccatgttcaagtgattctccagcctcagcctcctgagtagctgggattataggcacgcagaagcatgcccagctaatttttgtatttttagtagattcggggtttcaccatgatgtcaggctggtcttgaactcctgagctcaaagtggtctacctgcctcagcctccctaagtgctgggattacaggcgtgagccaccgagccgggccccttcctgggtttctatcctgcctcagctctatctcctttgagggcacaaggctttcaaaaaggagaatgaaatcattcagcagtggctgtttaggatccttcagcgaggaagtacaggaaactaggtttgaattttagccactagctatttgactttgaataagtcactttacttctatgagtctcagtttccccacctgtaaaatggggcggtaatacttattgatctattatgagaattaagtatgtacattcatttagttcacaaaagtgagtgcctgttgtgtgttagcaccaggctagaccctgaggttacggcagattggacggaacatacatgccaatgggcaggaatgtaaagagagaaagtagagagaatattttcaacagtagttgatatttcttagggacacagtaaactctcaatgttattttgagcaaatgaatgaacacatgaataaatcgctatcttggccaatatttttccctctcaaactctatggacttggtccagcccttaaggttgattgtaaatgggcggggaagaatttggtgggttagaaccttccattatgctctgtgtgtgctggggatactgtgttcatagcttccctctgaacagctgtgcagggcaggcagggagatctcaaacctgagtctggaaatgggagggcatatagccatttttaagtgttttccacctttggtcaaataaaaagaaatctgtggtgcatgctcactctttctctctctatccccatctctagccatctccctttctttctctcttcctctttgttaatgtaagtttccctaggccagggatctcagtgtcccagcttgttcttgttactcttgggggactggggtttaggcctcctccctttctgcacttttcatcttcctccttccttcctcttacctgcctccaatcctccacttctgcccaagatttgggtggcatcttccccaaattcagaaggttcttgaatcagactgcctagatttcaatccagacaatgtcacttcccagcctagggatgtcagccaaggacttagtttccctctctgtaaaatgagcataatagcatggagacatcataggatggtatgtcaagcgttcagtgaatatgaaatattagagccccaggaggacttggtgctgtctgtttgaaagtctcccatgttttacgtttggttcaaaagatcccctgcgctccctctcacccagcaaaccagccaaaccagtttcttcaccctgcctgcttctgtgttaagcaaacagtgcactgcaaacagtgactaagcctagtgccttgttaggaagaaactggcgtttttttgcttgccactgtgcagggtgctcagggtggaccggaacgggtttgttgtggcttaggaaaggggacctgctcgtggaggttgtgtagaactggagtgggaggagtggggcaaggcgcagctagggccgggggagtcgggatgatcttgaacttgtcagcttctgcttggcttttaaaagttatccaggccagatagatgctgtggctcacacctgtaatcccagtgctttgggaggccaaggccgcaggattacttgagcccaggagtttgagaccagcctgggcaacgtggcgagacccccatctctacaaagattaaaaaaaaaatttagccaggtatggtggcgtgcacctgtggtactagcatcaaaaaaatgcaaaaatttgctgggcgtggtggcatgtgcatgtagtcccaactactcaggaggctgaggtggggggattgcgtgaagcccgggaggtcgaggctgcagtaagccatgattgcaccacggcactccagctgatagagatcctgtctcaaaaaaaaaaaaaaaaatatatatatatatgtatatatatatgtatgtgtaatatatgtgtatatatatgtatgtgtatatatatatatatatgtatatatatttcatgatgcacatgcctaagaatacctgtctgttctcctgctgccaaaaacgctctgtcccagcccctgagatccttgtggctaaaaatcaaatcacctagggcacttcatgcagacttgccctcttgcagattcactgagagccaatctccaagggtggagatctgaacttgacatttacttacttatttattttttgggatgaagtcttgctctgtcacccaggctggagtgcaatgacacgatctcagttcactgcaacctccgcctcctggcttcaagcaattctcatgcctcagcctcccaagtagctgggattacaggcatgcaccactacgcctggcaattttttttgtatttttgtagagacggtttcaccatgttggccagtctggtctcaagctcctgacctcaggtgatctgcctgcctcaacctcccaaagtgctgggatcgcacgcgtgagccaccacacccagccttgaatttgatgtttttaaaagctcctcaggccaggtgcggtggcttacgcctgtaatctgcactttgggaggccaaggcgggcagatcatgaggtcaggagtttgagactagcttgaccaacgtggtgaaaccccatctctactaaaaattcaaaaattcagctgggcgtggtggcatgctcctgtaatccctgctacttgggaggctgaggcagaagaactgcttgaacacgggaggtggaggatgcagtgagccgagattgtgccactgcaccctagcctgggcaacagagcgagactccatctctaaataaataaaataaataagcaagctcctcagatatctgctgccactcaatgcatttccctggacaatcccaggggctagatgtttgatgagtaaataccccagccaggatgtgggcacctggttgtccagcccaaggccagggatcccaggtcacacccttgatcagggagggataggctggtgcttctgccatgcccaggattgagaactctatggatgcaaggaggggtggatgggaggctgggtgcagtggctcatgcctgtaatcccagcactttgggaggccaaggtgggaggatcacttgaggtcaggagtttaaaaccatcctggccaatatggtgaaaccccgtttctgctaaatataaaaaaagctagccgggcgtggtggtgcatgcctgtaatcccagctacttgggaggccgaggcaggagaatcacttgaatctgggtggcggaggttgcaatgagcggagattgtgccattgcactctagcctgggcaacagagcgatactccatctcaacaaacaaacaaacaaacacaccaaagtggggtggatgggtgtgggagtgggggacccagagaagtatccagtgcacccaggcctaagactcaccccctacactcagggagattccagaaaatctccaagagagacctctcagcaggtaattccagtaggctccaagaatgccactggaatgagaatgtgttcaggggatgccaggagtggtcagcttcacctgctgggccttgatgagtaagagggtgtcttccatgcaaggaaagggaaagggcactccaggaggaggaagtggggtacccaaaggtgtggcagggtcatggaggcagaaggctggagctgtgccttcctgggcacagaaagaggagggaggagagggtcccaggatgaggctgcagaggcagctgggccagggtacctctgggccttgggccgtgggtcatggagggttttctctttctgggcttttcataggcaaattattcacccggttaaaaaataagtttaaatatacatcttcatatatatatgaaaaagcttgtatatatgtctgtatggcagacagtgaagtctccttcccaccccaaaccacgcttcacccagttcttccctggggcacagggaacagatttcattagtctcttgtgtatccttttcagtgtttccttatggaaatacaagcatagtcttctttctttatgccagcgtaaattcctaacatatgatccttttacacaaagcatagcatatgatagcactgctctgtaccttgtttttctcccagcaacgtatctgtatgttctctctctctctctccacacatatcttccttagaccgaatcttgctctattgtccaggctggagtgcagaggcgcaatctcagcttgctgcagtctccgcctccctggttcaagtgattctcatacctcagtctcccgagtagctgagactacagacacatgccaacacacccggctaatttttgtatttttagtagagacagggtttcaccatgttggccaggctggtctcaaactcctgggctcaagcaatccacctgcctcggcttcccaaagtgctgggattacaggcgtgagccaccgtgcctggcccatttttattttttttaatttttaaaaaaatttttaaaaattatttacttttttttttttttttttgagacagagtttcgctctcattgcccaggctggagtgcaatggcatgatctcggctcaccgcaacctccgcctcccgggttcaagtgattatcctgcttcagcctccagagtagctaggattacaggcatgctacaccacacctggctaactttgtttctttggtagagacagggtttctccatgttcatcaggttgatctcccaacctcaggtgatctgcccgccttgacctcccaaagtgctgggattagaggcgtgagccaccatgtccggccattttaaaaatgtttaattttaatttctgtgggtacaaagttggtgtgtatatttatggggtacgttcttttattttctttttatagctatgcggtatggatgcaccataggttatttagccagtccctgatagatagacactgggtagtgtcctatcttttaggagacagtatttcagacagtaacctgggatatacattttttttctacacattctggtgtatctggaagatgaatttccataggtgagcctgctgggtccaggtatgtgcatttgtaattttggcagatattgccttccacaaagactgtgatccatttgcacatcagcgtttagagacagtcggttcccactgtcccagtggaggttttgagaaagaggttgggagaggtgttatgtgcctgcctgtctgaagataaaacagttttttttgtttttgtttttgttttgagacggagtctcgctcttgtcgcccaggctggagtgcaatggtgcaattttggctcactgcaacctctgcctcctgggttcaagcgattctcctgcctcaccctcctgagtagctgagtacaggtgcctgcaaccatgactggctaatttttgtgcttttaatagagacgggatttcatcagttggccaggctggtcttgaactcctgacctcaggtgatccacctgccttggcctcccaaagtgctgggattacaggcatgagccaccgtgccctaccaatagacagttttgatttgggggaaggtttccagcaactaagtggttctaaacaagaagtaatgccagcagcttccagaatgttcctttggaccaacactggaaacagaggagaaagaggaacaattcaggggaggaaaattagtttttggtgaggaatatgttgagtttgagtgtctgaaggacacagaggtggagttttcaaaggggtatttgggaatgtcagctctgtgcttggaataatgtgaagtaccagtttaaagaaggatttgtataggatagtgatcttttttccttaatcttgtgtcaatagatacagagagttttcagagacctcacacgctggaggattaaatcatagaaggtgtttgtttggagagtgtttacttgaaggtggccagcagatgaaagacaactatttgtgtccatttgcacagggttagagagtgggtcctgccagtgaccttgcacgcttgacagttaatcctccctgtagtccaaggtgggaattttcatcatcccctactgtggaagaggaatcaggctcagaggttgcactgcttgccaccaagtcaccccgccaggtgatggcagtgctggggctgcaggccaggcctttctccttccaaaaccaggtctctcatcctgttccctctactacactgttgccaaactcagcatctccagtgggacctgattcacctttctaaaggaaacgccaaactcagcatctccagtgggacttgattcatctttctaaaggaaacgaattcccttcttcccttcggagaagctgtcattgtacctttttcatctcacttattttatttattttatgattttttttttaagaaacagagtcttgctctgctgcccaggctggagtgcagtggtttgaactcctgggctcaagcaatcctcccatcttggcctctcgaagtgctgggattacaggtgtgagccaccaggcctggcctgcctctcactaattttgattgtgatgctagaattcagcttttttttttgcctttggaaggcctcttttgtcttttgcttatgggcagtttcagccggtttccctcttgaccttcacttccaaataaatgctagctgaacagcgcttctcttcctttcggtctctttcaactctctgggtcccagaaaatccacttatattggccttcaagacttgggagtgtagggacagggaaaccgccttaaagaaactcttgttccaaatgagacctactcaagccgcttggccaggcaggcatctggggcatggctcttgctgctgaaagagggaaagttactactgggacctaatggggcctgcctagaagggttgaacctgttccacatgagcaagatcataaacggtggccagctcaggaccccgtgggataattggccaagttctagataataattagctggctttgtaattaggagagcttgtaacaagccaaaagcctttcaaatttatttgacctgggcaagttcaagaagaagaagagcacctgattctgtggtttggcattcaggtacgcctgtacaccttctttctccttggttttttttttttttttttaagacagggtctctgtcgctcaggctggagtacagtgaagccatcttggctcacttcagcctcgacctcccgggctcaagcaatcctcccacctcagcctcccaagtagctgggatacagacacacatcaccatgcccggctaatttttaaaattttctttggaaaagggatctcgctatattgcccagactggtctggaactcctgggctcaagggatcttcccaccttggcctcccaaagtgctggatttacaggcatgacgcccagctgtttctctattcccaaaagagaagtttcagcatgtcttcaccttcattgtcgcagcagcttccttcctggtctccccacttattccttccccttcctccaagccagtcttttctccatccatcagtcagagttgatggtttttaaaattaagttagaaaatatcacgcctgctccaaattacccatggttccccatttcaaacaaaataagcgcctaagtcctttctatgacttctgaggcttcactgatctgtcctttgactcatgtacctggggtcctcatctcttcccactcttctgcatgctcactttgcccaacaactttgtttcctggttatacttagaacacactacacactcttctacctcagggcctttgcactggctgtgaccattcccataatatctgcacagctcactcttttctgtcctgaaaagactgcaagcctttgcttaaatgtcactcccgccctcagggaggactttcttgaaccccttatttatttatttatttatttatttagagacggagtctcactctgtcatccagtctgcagtgcagtggcgcaatctcggctcactgcaacctctgcctcctgggttcaagcagttctcctgcctcagcctcctgagtagctggggttagaggcatgggccaccacgcctggctaatttttgtatttttagtagagacagggttttaccatgttggccagactggtctcaaactcctaacctcaggtgatccacctgcctcggcctcccaaagtgctgggattatagggatgagccaccgtgcctggcccaatttatttattttttgagacagagtcttgctctgtcacccaggctggagtgcagtggtttgacctctgctcactgcaacctcagactccagagtagctgggattataggtgcctgccctcacacctggctaatttttgtatttttgtattttttttttttttttgagatggagtctcaactctgtcacccaggctggagtgcagtggcttgatctcggctcactgcaacctccgcctcccgggttcaagcaattctcctgtctcagcctcccaagtagctgggattacaggcatgtgccaccacgcctggctaatttttgtatctttagtagagactgggtttcaccatgttggccaggttggtcttgaactcctgacctcaggtgatccacccgccttggcctcccaaagtgctgcgattacaggcgtgagccaccacacccaatctggaccccctatttatgatagtaaaccctgccctcagccctccccacctcttttacttaattttcttctagtacttttcactgtctaacatgctatgtatttcacttatttctcctgttcactgcgggtctcctcccactagaacagaagcctcaggaggccagggatttttaatgtcttttgttttgtacttgggctgaattgcagttagaatagtgcttggtacataataagggctcagtaagtatccgaaggaatgaatgaatgagaggtttcagagtgtatttaatacagacaggactaaacagatctctctagaggatatttcactgtagttgtttttttctttttttaaagacagggctttatgtattagccacagagaagggaggaggggtgttctcagggcgtgtgcctctggttggcactccccagtttctctgagctctgcacacccctgatgtaaccttacctaattgtcttgtcacaaaacagcttgcagtctggagtctaaaggtcagatgagccatttctaccccacacttctgagtgtaaggaagcaccagatcaaaatctaggcagatatctgagcccgccagagccatctgtttggtttcctattgtgtgggtaacaccttccttgagcaaggctctcagatacacccaacacctgccccctgggtatctcagcatccttcagacccatgaattgttcaagaaccgatgtctgttcttccagtttttggcagtgcagaggagcctggaaagagcttgatgagagacgcaaaaagctcaaagacaaaaatgcaaggccggccaggcgtggtggctcacgcctgtaatcccagcacttcgggaggccgaggcacaaaaatctcttgaacctgggaggtggaggttgcagtaagctgagatcgcgccactgcactccagcctgggcgacaaagcgagactcagtctcaaaaaaaaaaaaaaaaaaaagcaaggcctgcttaatcagatctcggccaagataaaaatctcatggcttcaaaatccatctgatcaataaatattcatgagagagtactgtagggcaacatcttgtaaatcttttttttttcttattttcttgagagggagtctccctctgtcacccaggctggagggcagtggtgcaatcttggctcactgcaacctctgcctcccaggttcaagcgattctcctgcctcagcctcctgagtagctaatttttagccaccatgcccggctaatttttgtatttttaatagacacggggtttcaccgtgttacccaggatggtctcaatatcctgacctcgtgatctgccctcctcggcctcccaaagtgctgggattacaggcgtgagccaccgcgcccggcacatcttacaaatctttatgtaacctagactgtcctgccttcagcagggtaatggcttaatgggtagtgtggctagatttagcaaataacaatacaggactatcagttacatttgactttcagataaacgatggctaatatttagcataagtatgtcccatgcaatatttgagacatacttaaaaaaaaattatttggcaggggcagggcacggtggccgactgtaatcccagtactttgggaggctgaggcaggcggatcatgaggtcagcagatcgagaccatcctggctaacatggtgaaaccccatctctactaaaaatacaaaaaaaaattggccaggcgtagtggcaggcgcctatagtcccagctacttgggaggctgaggcaggagaatggcttgaacctgggaggtggagcttgcagtgagccaagtgagccattgtactccagcctgggtgacagagcgagattctgtctcaaaaaaaaaaaaaaaaaattattcggcagggcacagtggctcatgcctgtaatcccagcactttggaatgttgaggtgggaggatcccttgagaccagcctgggcaacatagggagaccctgtctctacaaaagatttttaaaaattagccaggcctggtggcatgagctggcagacccagctacctgggaggctaaggtgggaggatcacctgagaccacagaggtcaaggctgcagtgagctgtgactgcctccctgcactccagcctgggcgacagagtgagacactgtctcaagaaaaaagaaaagtatttgttgttgtactctgtattgtgatcataagcaacagtgtattgagcggtgctttctgtatgttgaactcttcccgtatgccatctcctgtaaccctcatgcacacaggtgtgtcatgcacacaggaagtgggagagcctggccgtatgtctggtggctgttggactccaaagtctgtgctctttatagcaggaaaaggcaactcacagaacagtctgtgagcagccaggtgaaagggatggatcattccttctctgaaggtctcaggtgacagaggtatttgtctgtccattcacttaatgaatttgtgctgagcacctgccaagccctctgctaggcattggggatgcagcggggcccaaacagagaaaaagccctgtcctcatggaatttctcttctaattggaggggacaggtagatggtgatgtatggaagaaagaataaaactcagcaggaagggtgataaaaactatgcattggggtggagaaatttaggggcagtcatcactaagaaggatggcatttgtgtaaagaagaagaagtgaggtgctcaatagatgttagaactggactgtgtcagctgggtgtggtggtttatgactgtaatcccaagccaaggcaggtagatctcttgagcccaggagttcaagaccagcctgggcatgatagaaccccgcctctacaaaaaatccaaaaattagccaggtgtagtggcatatgcttgtagtcccagctacttgggagctggggtgagaggatcacttgagcctgggaggttgaagctgcctgggaggtttagccatgatcgtaccactgcattccagcctgggtgacagggcaagactctgtctcaaaaaaaaaaaaaaaaaaaaaatagaattggactgtatcttgaggggactggacttctacattcaagtctatattcatgtcattgaaaaagactgttctctagtcaggcatttttcttttaatttttaaattttttgttaaaataaatagagagggtcttgttacgttgcccaggctagtctcgaactcctgagcttaagcaatacccccgccttggcctcccaaagtgctaggattacaggtctgagccaccatgcccggccaggccaggcattttctagagaaggaatcctgagggctcattttcacatctccttcattttttatttatttatctttctcttttgacctgccactttaggaacatctcctttaaagggtatcagattcaaaccaggaaataatgctcattccaagccactccccacccctcagcatgttgcccaagaggaatattgctccagcagagttttctaaattttttttttttttttttttgagacagagtcttgctcttgttgcccaggctagagtgcagtggcctgatctcggctcattgcaacctctgcctcccgggttcaagcgattctcccacctcagcctccggtgtagctgggattacaggcatgtgccaccacacctggctactttttgtatttttcgtagagacggggtttcaccatgttggccaggctggtctccaactcctgaccttaggtgataagccctcctcggcctcccaaagtgctgggattacaggcatgaatgagccactgtgcctagccgagttttctaaagattcttcctgcagagggatgatattttctaaacaggcatcatttagggcatattttttttttttttttgtgcatgtatacgagtgttcctaggacctggtacttactttggaatctcaccttcagtacgaggcttcctccccaacaaattcttcaccacaactatgtgggagtgtttgaaaaagggaacaagatgaccaacttgttggtggggagagttgtggctttcctattggaaaacatcatcccttgaataagcagtgaggcaaacacctgggcacttactttatgaacaggtggggtggggccctgagtcaccgacattgagaggcctctcctggtaaggtttttcaatatcaggttgaatcagcggtgacatcaccctctatagtgacaggtactctaggtgccggctcttactcataagtcccaggagatactagccctagatctcgtctctgttagcttcgtgctaaaaggttttggagaaataacagctgcttggtgacgttcatgtggctggtttcattaccacctaactcccaggcttgtaatcatgactaaattttctggagaaaatagaatttgtggttgtatttcttgtaacttttgccttcttgtctcaagtctgcatttaaaaagaggccgggtgcggtagctcatgcctgtaatccagcacttcgggaggccaaagtgggaggattgcttgagcccagaagttggagaccagattgggcaacaaagggaaaccctgtctctacatacaaaaacaattacccaggcatggtggcgtgtgcctgtgatcccagcttcatgggaggctgaggcaggtagatcccttgagtccaggaggttaaggctgcagtgagctgcgttttgcaccactgcactccagcttgggtgacagagcgagacgctctctcaaaaacaaaaaacaaaacaaaacaaagccctcttctactccttgaggtttttggatgtttcagagctgtattttgagtctctgatttttgttttgttttgttttgagacagagtcttgctctgtcacccaggctggagcgcagtgttggagtctcagctcactgcaacctccacctcccaggttcaagctattctccttcctcagcctcccgagtagctgggattataggccagcgccaccatgcccggctaatttttgtatttttagtagagacagggtttcaccatgttggccaggctggtcctgacctcaagtgatccgcccaccttggcctcccaaagtgctgggattacaggtgtgagccatggcaaccagctgagtttttgattttgaaacttcctgtaagttgtacttatttttctttgggctttgtaatttggttatgatttttcattcttctttctgctaatcctctcacttccaccatgggagtgtttaaatacctgggaagctgttgaacctaggaaaccacattttacttgccagatgtgaggtttcatttctggttttgacagagatttgactcttcagcatttatttctcttttagcctatgagcttctcttagagaagatgaactgggagggtggaatgcagcaggattgcctggattccaatcccaactggacccttacttttcctgtgattttgggcaagtttctttctctttctttctttctctctctctttttctttctctctctctccttccttccttccttccttcctttctttctttcttttttttgagacagggcctttttctgtcacccaggctggagtggagtggtacaattttggctcactgcaacctctgcctcctgggctcaagtcatccccatcctcccacctcagcctcccaagtagctgggactacaggtgcatgccaccactccaggctaatcttttttttttttttttttgtattttttgtagagacgaggttttgccatgttgcccaggctggttttgaactcctgagctcaagccatctgcccgcctcagcctcccaaagtgctgggattacggatgtgagttgctgcactggcctgcaagtttctttcttttttttcaaatttttttgtgtccctcccctctatcccaaccccaccccattttgcctagggtaggcttctttttatttctttttttttttttttttttttttttttgagagagagagagagagagagacccaaatgggaattccctagggccagtttcttaatctttctgtgcctcagtcccctcacctgtacaaaggggataaacatagcccctaccacaaaggattgcaatgaggattcaatgagttagcatgtgcgaagtgcttccagtgcctggtacgtagcaaccactcttcatttagtttttattggctgggctccgtggtacacatctgtagtcctagctacttgggaggttgaggcaggaggatcacttgagcctgggagtttcgaggctgcagtgcatgctgattgtgcccgtgaatagttactgctctccaacctggtcaatgtctcaagaatcgatctctaaaaaaacaaattagtttttctcattagatgtttctgctttagacttgtgtcaagggagtgaaaaagcatggggcggggggcgggtagtgtaagtgtcaaaggagccacagaggattgagtatgaggaagagtgatacccccttatcactttgctcttgacctcctaaagaataagacgctcctttgacccaacatccatttgagtgcaattttttttttttttgagatggagtcttgctctgttgcccagactggtgccatctcggctcactgcaacttccgcctcccgggttcaagcaattctcctgcctcagccttctgagtagctgggattataggcgcctgccaccatgcctggctaattttttctatttttagagagatggggtttcaccatgttggtcaggctggtctcaaactcctgacctcagatgatctgcccctctagccctctcaaagtgttgggattacaggtgtgagccaccgtgcccagctaattacatttaattaatttattttgaaaaatacaaggtctcactgtgttgcccaggttggtctcaaactcctcggctcgggcaatcctcctgcctcagcctccgacaagtggtgggattacagggggcacagtggctcatgcctgttatcccaacactttgggaggccaaggcaggagaatcgcttgagcccaagagttcaagaccagcctgggcaacatagcaagacccccatctctaccaataataatagtattgttatacaatgaccacaatagtcgttgcattcatttattgattgagtactcaactgttcatgtatgatcttgtttttttaatccttgcatcaactttagagttaggtactatggcaattccattttcttttctttcttttttttttttttttggttgagatggaattttgctctgttgcctgggctggagtgcaatggtgcgatcttggctcactgcaacctccgcctcccgagttcaagcgattctcctgcctcagcctcccaagtagctgggattacaggcgcgtaccaccatgcccagataatttttgtattttttaatggagacaaggtttcaccattttggccaggctggtgtcaaactcctcacctcaggtgatctgccttggcctcccaaagtgctaggattatagattataggcgtgagccaccacgccgggcctgacaattccatttccaaatcataaacagaagcttctacagctaggggagctgggaaggaaaagtgtgtaccgccctggctggcttttatccttcctgtgctcagcggctctatttctaagaatgtttccattctagatccatcactttggcctagaaaggagcctcatgccaaggtccacccatgcagcccctaaaatccccttttccaccgtgcccggctgagtttttaaaattctagttttccacagatggaaatgtgaactgtcttgtaaagtattccatatatatatattttttttttttttttaattttttttttttgagatgaaatcttgctcttgtcccccaggctagagtgcaatggtgcgctctcagctcactgcaagctctgcctcccgggttcatgccattctcctgcctcagcctcctgagtagctgggactataggtgcccaacaccacgcccagctaattttttttttttttttttttgcatttttagtagagacggggtttcaccgtgttagccaggatggtctcaatctcctgaccccatgatcctcccccactcagcctcccaaagcactgggattacaggcatgagccaccacgcccagcccttctaaagtattttaaattctagttttccaaagatgggaatgtgaattgtcttgtaaagtataaccgtctcctgcccctcctttataacaggccttggagaattttgcccctcctttataacaggccttggagaatgtttctcccccattctttctctttaatctgggcaaggtgtctttattaataatatcacagaccaccacacacaccttgaggtttagttctcttccgcacagtgtgtgagtgccttctgtgtgctctgtgtcagttaccagccttgtttccaggagtttggagctgacccaggggtgatagaaaacactgggatgccaagtcgtcagacaatgggctcatttagaattcaggtggggtgggactgtgtgggctgggtcagctggtggagcttccccagagtggggaggccagggggagtctgggatgtggggtggtatgtgaacaggaatacggggagactctcagcctctgttgttggctgagagggggatgccccaagcctagagaggtgggggcgggacctcctgtgcagagactgggagacaggaatatgacagatggtatatttggatggtgactcagataggtcaagtgaaactgaacttccggtcctcgagtcacacaggagggtaggggctgtgagaaaactccctcgttggttcttcctacagggcctttgaggcagacagggctcaacagagcctggcaggactgcagaaggacaatagtgtggctggttgggtgaggcccttttggcctgaaggctagcaagctgggagaacttggagaacccggacagcaggtcctctgccctcccgctgcctggggcagcccttggagaggcctgagtggtctaggctgatacatcaggcttggggcagccccgctgggctatcccataccctctcccctgcccccacatgtttatcccaaatccccttctcctcaagcttgcttctaggtgcccatctcacccatcctacccatccatgtgtctatcctccattcgtttgttcagtaatgatggaggggctgttatgcgccaagcactgttgtgaatggcggacacagagacccagacacatatgaatgtcccccatcatggaatttgtattctcaggtattgcagggagcaggcaataaacataatcaatgtgcaaaatatttagagcactgagtggagacaggtgtgtaggaaagatgaatcggaatggagcattgctgggaagtactagggtgatctgagaaggcctcactgaagggggacatttgagcaaagacccaagagaggtgaaggatcaggccatgtgactaggtagggaagggtgttctagacggaggggagggcgttctagatggagggaacagcaaagacacacccctgacactgagcagaagggcaaggtcagtgatcaaggggcaggggctggcagaagggcagagggggtggcagcatgtggagggccttgtacccatcaccaggactttgtctttcacttgggactcctctggtcctttagcccagatccaccggctgcctcctcctgccagttctgcctcccctctccattctgggcagtggagcctgatggttagtagcatgggcactggcctgcctgctcaggttctgagctgagcacagaggtctgggcctcccctgggcttctgctccatttggcccagggtggggccatggactcccatttccaatggcgctgctggctctggcatattctgacccctccactggggacacctcccagtgttccttgcctggctcatttctctctcagggccatcttcgttgttgctacctctaggaagccttctctgatcctcatccccaaggcctgtgtcgggatacgtcctactccttccctttgccagttgggatcccctgggttcctttatgctcccccaccaggctgggtacttgggaagtattcgcagcccccagcattaagcctggcatgtagttgccactcagtgagtagtttgatgaggggctctttgctgtgggaggattaggctgcagggttaccccataacccccagtggaggtgacttatgtccatcttttggggacttttgcagtgagggagtgcattataatggagaggaggaagccagattcctaaaactttcaatcacattttgctcctctcagaaacaaaaacaaaacaaaacaaaaacacaggccgggcatggtggatcacgcctgtattctcagcactttgggaggccaaggccagaggatcacctgaagtcaggagtttgagaccagcctggccgacatggcgaaacccagtctgtactaaaaacataaaaattatccgggcgtgttggtgggcgcctataatcccagctacttgggaggctgaggcaggagaatcgcttgaacccctgggaggcagaggttggagtgagccaagagtgagcaccactgcactccagcctcggcaacagagcaagattccgtctcaaaaaaaaaaaaaaaaaaaaaaaaaaaaaaagccccaaaccagctgagcttagatggatctctctggccatctttttaaacagtaagggacctttaaaaagtttgattcctctcttccccacagcaaggctatttgcttcctgaagataaatcaattgtaaaaagtagcttaatttaaagcgttcaattcccctgctttttacattgaggagaaattatggtgacagctattcctgttttgcgtgcttagtaccagccaggcactgagcccaaaactccaactcactcttggctgttgagccaaccctgtgccagaagaaaatccccactccctacaatgtgtggaattcacattatagttggagacagaaggggagaaacaaacacagcctgccaatcctggagaatgcctggtgggggtgctgggggaagaagtccaatttcagctgggaaaatgggacaggagccttgggagtgggtttacacctcaaattcccttatggccacagtccattggcccctagcctcctccccactttacagatgaagagactgaggtttagagagaggaacagccggcttggcagaggcaactgctgaggcagttgaggaaaggtgaggacctcccagagtgagaggggcaagggaactggaagtcaactgtgggacctggaagtaggggagggaagaataaatctgcggaggggtctccttccctcggccctcctcccccacttctgggaaagtggttaccgttgtcagctccaggatttgaaatgctgattagttcattagcagttgtttataggcctttgcctgtctgacattttaaccctgtgaagtccaaggaaacagttctctgtctttaatgtgcttcaaaacctcctgcaaaactaactacaagtgcagactgcacccctagagattctgatgtttaagtctggggtgagtccaggaatctgcattttaaaataagcccatcctgtgctggaactggtggtccctggatcccactgcaaggacaacctgggcgagagcaggtttccaaacctgggccagagctggttggggggatggcggacacatggagagcttaaaagtggagactttgaggggctttccctcccagaggttttgagtcaagagatttgagatttgatgggtttttttgtttgtttacttgttaaaaaagatgattattggttgggtttggtgggggatgggctatgaagctacccgaagttgtagacaaaggggtgtgtgtgtgatcagttcacagatgtggatcatgtctacatctttcatcagatttctctgaggagtcatcccagatgacatttagggctaactctgagtggaattaccagtctaaaatgggagctggccaggcatggtggctcacgcctgtaatcccagcactttgggaggccaaggcgggtggatcacctgcggtcaggagtttgagaccagcctggccaacatggcgaatccccatctctactaaaaatacaaaaattagccaggtatggtgctgtgcacctgtagtccaagctacttgggaggctgagacaggagaatcgcttgaactgggaggcagaggctgcagcgaactgagatcacgccactgcactccagcctgggcgatagagtgagactccatctcaaaataaaataaaataacatagagccaatctcagggtctatcaagacaggtgaagggaaatgaagttaaggcctgcaaactccctgtgtgttcttggagaaggaaagcaagcaaaatatgcaaggtgtgtaacaagcaccagcaactcagtggtggaggagggattccagtgtatttggagaggagaccttaggtggccagggagccccttccttctgtctgtctgttcatctgttcacccatcattcactcttccattcaggtagtccttggccacctgctgtatccaagatctctggctcctagtgcggtgacggtagactggataatgcagactagtggatgatttgacaagttaacttacatggttttggaaagaggcatcacttttatgactctgcaaacccaactcccttatttctaacttgcccagcccaatattaaaatgcatcaccaaaccctcctgctgtctgcggagaagccagcatgaaactcaagctgagcagaaaacagatccagcatggagataaggcagctgcagtttcacttttaggttgggccaactgagaattttggggactttccttgctgtgaatgtggaattaaattgcttttttatttttattttttatttttcgagatggagtctcgctctgtcgccaggtacagtggcgtgatctcggctcactgcaacctctgcctcctgggttcaagcgatttgcctgcctcagcctcctgagtagctgggactacaggcaactgccaccacacctggctaatttttgtatttttggtagagacagggtttctccatgttggccaggatggtctcgatctcctgacctcatgatccgtccgcctcggcctcccaaagtgctgggattacaggcgtgagccactgcgcctggctgctttttaatttttttggaaaggtaggggggatttggtcaatgattaatccatctggagtttggtaacggatccagcaggtatgtaaggcattttagttatttgattctaaatgaaatcccaaaattgtaggggcaattaatcatgaacctgagggctcctgagttgtctttgcttgtttgcctcaagacaggtgacctgtctccttttttttttttctttaagtatttctagacatgtcatgattttcagatatttaacactttttaaaagatttgttttcctctcatgggaaatttccctgtcacagttggatctagtttctctttctatcttgtgcctggtttttagttaatcttctcctatgtgtcaaataatcgaagacccttcagttatttattgattgggaacccttcacttactggtatgcatttagttttacatatgtgagatcgtttagtgtttcacatcacccctactataattttatatcggccaggcacggtggctcatgcctgtaatcccagcactttgggaggccaaggcaggcgaatcatgaggtcaggagtttgagaccagcctggccaacatggtgaaaccccttctctactaaaaatacagaaaattagccgggtgtggtggtgcgcgcctgtagtcccagctacttgggaggctgaagcaggagaatcgcttgaacccgggaggtagaggttgcagtgagctgagatcacgccactgtgctccagcctgggcgacagagtgagattctgtttacaaaacaaaacaaaaaaatttatattaccccattttatggatgaagacactgtggctctgagacatccccttgactatttcatggcagggcaaagattcacaacttgtccctaactgccggatgcaccgcttcccttccttgagaaaactggcccaggctctcccaaaatccaggggaccagtagcaggatttctttcaagggcatcttgtcttccggtcaatgttttccctctgtaaaatggcattagtagaacctacttcataaggttttgggggagattaaatgagatgaacaatatagaatgtcatgtgtgcactcagaattacaattagttattactgataatgggtaaacataattgctattattattaacactgacatagccttactatatgtggggcattgccctgagcatttgtatagtaacatataattctcccagttactttgtgggagtagtaaggtctagaaccccctttttttttgagacagtctcactctgttgcccaggctggagtgcggtggtgtgatctcggctcactacaacttctgcctcctgggttcaagcaatcctcctgcctcagcctcccgagtagctgggattacaggcacccaccatcacgcccggctgattttttgtatttttagtagagaaggtttcaccacgttggctaggctaacctcgaactcctgacctcaagtgatctgcctgtctcggcctcccaaattgctgggattacaggtgtgagccactgcgccccgcctagaccccatttttggatgaggaaactgagacccagagaagttcatttagctgtggtctgctgtgacagggagatctgccacttagaaagttttagggtcgttttattttcataatagaacacgatgaaccagaccatccctgctccattttagaccattaagtttctttttttttttcttttcccctgagacagtctcgctctgttggccaggctagagtgcagtggcatgatctcaactcactgcaacctctacctcccgggctcaagcacttctcccgcctcagcctcccgagtagctgggattacaggggtgtgccaccatgcccggctaattttttttgtatttttagtgaagacagggtttcaccatgttggccaggctggtcttgaactcctgacctcaggtaattcacccacctcagcctcccaaagtgctgggattataggcctgagccaccgtgcccggcctagaccattaagtttcaataatgagaaagttgggattccccagagatggggattctctttctcatagtaacaagacttcccaaaacaacatttctttttcaagacttcattaagaatctcttgtctgtatcttggtcttttgttgttattgttgtttgtttgtttttttatttactttgttcattcctacctctccaacaaagaattttgaggtttggggcacccagatgcataattgcataatagctatatgtatttctcagatagggttaaggaaatgggcaaaggagaaataagaataaaagataagaggagagccgggtgtggtagtgtgcacttgtattgccagttacttgggaggctgaagcaggaggatcacttgagcctaagtgttccagaccagctggggcaacatagagagacccccatctctaaaaatatgttataaaatattttaattactttttttttttttgagatggagctttgctcttgttgcccaggctggagtgcaatggcacgcttttggctcactgcaacctccgcctcccgggttcaagtgccccagactcccaagtagctgggattacaggcatgcgtcaccacacccagctaattttgcatttttagtagagacaaggtttctccacgttgatcaggctggtctcgaagtcctgacctcaggtgatctgtccgccttggcctcccgaagtgctgggattacaggcgtgagccactgcgcccggcttaattacgatttaagaaaaaagatgagtataggaagaaggttggatagtgatgtgtttgccacagacctagatccctgctaaaagcagaccacagatttgactctgagcaaagaggaaaacaagatcagttgcgtaattaggtttctatgagttaagcataaatctgttccttagagaggatccagtttctccacagagctcttaccttcatgtgattttggcaacagctcttaataccttggactttccattgatatttgtcattttgcagctaatacatgttagttgtggggaaaactttggaaaatatagatagctaaaagaaaaaagctgggtgcagtggtacatgcctatagtcccaggtgttccctggaggctgaggtgagaggatcagttgagcccaagtgttgaagtccagcctccatagggagataccatctcttaataaaaagaacaaaaatatttaaattgtgtgtaaagtcactatctagatatcaccaccggggaacatttttgtatacatcctcctagaagtaaggtctctattattatcttatatgttgtaatataaatgcaagtataagtaatggcattttactaaagtaaatcgttatccaacactctctgcctcagggccatggtgcctgctgttccctgtgcccagagcacccttcccccaggcatcctcatgccactcttgcttatctctttccagtctctgctcaaactgccccagttctcagcagagtctgtcttggataatagctcacatctatacccttgtcactgtaccgcctaccctgccttttttccatggcactgattactattcaatttcatgatctgcttgtctccctctctttgaatatgagctccttgagggtgggtctgttttgttcattgctgtacttctagggcttgggctcagaattctgcccagcatagaggaggtcctcagatatttgaatgactccacacagctatttctgtattcattacaaatacatctatatcaataactactgaaatatgcctatagaaatgtttcatacagttagatttatgtgtatactttttttcaaaatcatgctcttgctcttcctacttcaatgtctgttggctgctttctgattcctttgaggcagcacatggtaagatgcctctaaattgtaccgtggcctatcaggtgttcatagaaaaccctctgcaaatggaatttctttttttttttttcctctttttaattgagacagggtctcactatgttgcccaggctggtcttgagctcctgggatcaagagatcctcccgcttcagtctcccaaagtgtggggattataagcatgagccactgtgcccaacctgcacatgtaatttcataattaaaatattttatccatggctgggagtggtggttcacacctataatcccagcactttgggaggccaaggtgggagtatcgccggagtccaggagttcaagaccagcccgggcaacatagggagaccccatctctacaaaagataaaaacattagctggggcctggcgcggtggctcacgctggggactacaggtttatgccatcacgcctggctaatttttttgtattcttagtagagacggggtttcaccgtgttagccaggatggtctcaatctcctgagctcgtcatgatctgcccacctcggcctcccaaagtgctgggattacaggtgtgagccaccgcagctggcttttttttttttttttttaaagaaaatggtagcctctgatggctgctgtcatgcccccggttgttttcaggtccaagtctatctggagacctttcctccctgtcaattaggggtcctttcttggctactattatgttgctttcttcatctttgcctcagaatcataaagttggaagggcttttggggccacctggcctagccctctctgccaccaccaggtgtgtgctctggggagctctgcctcctgtcctaaaactgtcaccttcctgactgggcctgtcttccacaagacatcgcctggctagaccccctctgactacatcttttcctgtgcctggaaggacctcagaggtaagtatttgggtctcttgtgtcccatccccactcccggagcccaaagctcagtccgcagcacatagagggcccttaggggatgttcatggacagctgaatgactctgcctctgccttcaggtgggtaccagccagttgacatccagattcattcagagcctgctgtgggccaggcaccagcctcgcaccttcagggaacgtggcaataaataaggatttcagagggcagcacattctagaaggatgtaaagcagtgaaacggggtagggagtgcctggggtagtggtgcagggcccctttagctgaggagtggatcaggcaggaggatgtttgtgtggtacctagtggtagaaaggaggacaccatgaagagagcagtaggaagagaattccaagcagaggaacagcaagggctgagagcctgagacaggaaggagcgcagtgtgtggagtgggcaagaggcccagtgtggcagggcctggtgggtagatgggctcacaggcgggagataagctgggaggggaaggcagaggctagagctggtctctagttttttagaccttatcttctgaaggacagataagtgcctctgcctccatcagcttccaccgagacgaagtgatgcaaaccagaccgtgcagccaactcctgcgtcaggttccataggaatcctttccccgccagtggaggaggctctcccgtcttttggaaatgatgtgcaggagacagagctgattctcatttcttccatggacacggctaagtgcgggctggtgtgtgagaaagggttcggggcgcgtggttggtggaagttagctcctggctgttctgccttgcagtcccaggcaactcagaccttccctggctgctactcacacctacgctttcctacgcaggctctgatcttctttttcagccctagaatcccagaatagcagctaatgtgtattgagcccttttttctttttctttttaagacagggtctcactttgtcacccaagctggagtgcagtgcagatcacagctcgctgtagtctcgaactcctagtctcaagcaatcctcccatctgagcctcccgagtagctgggaccataggcacgtgccaccatacctggctaatttaaaaaaattttttgtagccgggcgcggtggctcacgcctgtaatcccagcactttgggaggtggaggcgggtggatcacaaggtcaagagatcgagaccatcctggccaacatggtgaaaccccgtctctattaaaaatacaaaaattagctgggcgtggtggcgcatgcctgtagtcccagctactagggaggctgagacaggagaatcgcttgaacccaggaggtggaggttgcagtgagccgagatcgcaccactacactccagcctggcgacagagcaagactccctctcaaaaaaaaaaaaaaattttttttttgtaaagagatctcactatgttgcccaggctggtctcaaatacctggcctcttgcctctgcctcctaaagtgctgggattacaggcgcgagccaccgtgcctagcccattgagcttttattctgtgtctgacagtgctaaagggctttacgtggattaacttgttgaatcatcccatccccttaggaaatagagaccatcactatttctgttttgcatatgaggaaatcgaggcaggcaggagaggtgaaatcacatgcccaaggtggcatagttgataagtggatctggggcttgaacttgggtcgtctgacctctgacctggggctctcaaccacttaatgctacactgggaccctgacttaaggactcagggtctaggctccttatctcaaaattggccccgtgttgccacacaacggccaatcgcatatgtccttgccttgcttaccacctaatcgggcaggcctagcagacagggacactgcctttcttatcctcttcgtgccatgcatggaagggcggggctccattagaacttggaagcttcctctctaatttatggtttgtccctctccaacatatgggagagatagataagtctctttaattagttcactaagattaataagccatagacccatcaaggaaaattcaataaatgttcactgggcatcttttatgcaccaggctctgtctacattcagagcgagagaacagtcacagctgacatctatggaccacttacaactggcctggctctgggctaacccgcaccgtatacagatcttatatatacttcactccataccctgtgatgtaggtcttcctcaaaatcaccacactatgtcaaattgcccatgaaaaacaccagacttaggctgggcacggtggctcaagcctgtaatcccagtactttgggaggccgaggcaggtggatcgcttgtgcccaggagttcaggaccagcctgggcaacagagtgagaccccatcctaacaaaaaatacaaaaagtacaaaaaaattacctgggggtcccagctacccagaaggctgaggtgggaggatcgcttgagcctgggaggtcaatgctgcagtgagccatgattgtgtcactggattccagcctgggcaacagagtgacacccagtctcaaaaaacaaaaacaaaaaccaaaaccaccaggcttatgggaaagtgggtttaggagctcagcactcaagaacttcatcgtaatacattagacaaaaagaattttgcttgtggaaatgggtctctaaagggttgtggcttgttataagtggtggaaggagaattgtctgaaatgagatggaagttgtaacaccaggtgtggatgggtgaggtttgtaacatgtgaactgaggcagctggagaaggtgggtgttttgtgtgttcccgtgcttcagctagatagagtcttctgcattcacctagtgttggttggagacaaaattgcacatgtgagcaaccttgacattgagttatactcaagttattttcctttttttttttttttttgttgagatggagtcttgctctgtcacccaggctggaatgcagtggcacaatcttggctcactgcaacttctgcctcccaggttcaagtgattctcctgcctcagcctccccagtagctgggattacaggtgtgcaccaccactcccagctaatttttttgtatttttagtacagacggggtttcgccatgttggccaggctggtctcgaactcctgacctcaggtgatctgcccgccctggcctcccaaagtgctgggattacaggcgtgagccagtgcacccagcctgctcaagttatttcctaatacatcattcacattgaaacacatttgcattttcaaaacaaggattattgaagaactgactgtattatctccaatttgcagtaaagtaaactgaggctctgagaggtaaagtgactagtccagggtcccacagatgggaggtggcacagccaagatttaaactcagcttgagcacttaacctgtgtgccacagggctcttcctgttcatatccatgagaaacaagttatgtggacaaagatggccaagacgagagattggtggagtatggccagtagttaagaatatgcaagaataatgttttatttatttatttttaagacagggccacgttctgtcacctaggctagagtgcagtggtgcagtcatagctcactgcagctcaacttcccagcctcaagcgatcttcccacctcagcctcccaagtagctggcagtacaggcacacgccaccacatctggctaattttaaattttttgtagagacagggtcttgctatgttgcccaggctggtcttgattcctggcctcaagcaatcctcctgcttcagcctcctaaagtgctggaattacaggcatgagccaccgtgaatggccagaagcacagttttaaaatgtttgttgatggctgggtgcggtcgctcatgcctgtaatcctagcactttgggaggccgagtcgggcagattacttgaggtcaggagtttgagcctggcccacatggtgaaaccccatctctactaataatacaaaaattagctgggcgtggcggtgggtgcctttaatcccagctgctcaggaggccaagataggataattgcttgaacccgggaggcagagcttgcagtgagccaagattgcaccactgcattccagcctgggcgacacagcaagaccctgtctcaaataaataaataagtttgatgatgaccagtacagcctggaccctttgcattcaacgtggtgcactccatcctgggtgacagagcaataccctgtcataaataaaataagtaaagtttgatgaccagtacagcctggaccctttgcaatgaaagcggatgcctggtgtttagtgctcaagcagtgctggggccctgggcagcagctggagggtgggcactggggaggacaccaggaggctcagagcaaaggctactcaccaactgatgggacttttcaatatttcaaccattggtgtggttgttgtcagtccatactgggtgaatctcagtcctgattttatctgaaataaatccacgtggttagtttggttagttctcattatagaagcccctccccatccccaaaacttctaattatggaaacttaaatacataaaagttgagaaatagtacaatgaagccaagcatggtggtgcgcacctgtggtcccagctactcagaaggctgaggtgggaggaatgcttgagcctgggaggtccagggtgcaatgagctatgattgcaccattgcactccagcctgggtgatagggcaaggccctgtctcaaaaaaaaaaaaaaaagaaaaaagaacaccctcattttacaattaacattgtcatatttgccttctctgtgtgtgcctcttaagtgtgtgcgtccgagcatgcactttatgagccatttgaaagtacgctgcaggcatgtttcacccctaaatactttagtctgcatctcctgaaccacaatgccattatcacaactaagaaaacgtataatgtcatctaacatccaactctgatggcaaatattcccaaccatgccaagaatgtcttgtgtttattacaaactctcacatgcaagtcatttcaaacatcacctcccgagatccttgtgtacccagaagggaacatgagaagagaaggtggtgttcttgcctttggtttgcctaaggccccctttttgttctcccactttggattcggttggattctaggagcagttacacatttctgtttttgtgtttaaaagcatgtaggtttcatgtaagctatatgcatgcacacactagccacacatgggactcaagtttgtaatttaaaaagacatttccttcccctataataaagcatagctggcatttctacatctgaagcgtctaagataaagctgatggtatcagcatgttgctctccaaagaaacaaaaggttatgatttgatagaccctgaaattagacatcaaggtcaagaaagtgtaaacttaggtgtggtcgttttccaaagctgtcactcagatgtttagcaaaatgtccccctttacatttcccctgtcttccacaggtctcccccatccacccaaaaggaggaaagttaggagggaagattgtcaaaagtcctcaaatatggctattttagatttctttttttcttttggtgagacagagtctcagtttatcacccagactggagtgcagtggtgcaatcttggcttactgcaacctctacctcccacccccaggttcaggctactcttgtgcctcagcctcccaagtagctagctgggactgtaggcacgcaccaccatgcctgactaagttttgtatttttagtagagatggggttttaccatcttgaccaggctggtctcaaactcctgacttcaagtgatccacccaccttggcctcccaaagtgttgggattacaggtgtgagccaccgcaccaggcctattttagatttcttttaatgtagtagcaggtaacaagcatagttcatatacttttactatttttaataatgaccaacgtttcctgaacatgaatagtggattaaagtgctgagtggcatgcctggtgcacagcaggagtccaatattagctatggacagtacctgacattcagcggatttgaatcattcagacttgaaactgcactataatattttacttagtaaaatctcattaaaaattttttttaaatagtatgttttgtagagacaggggtctcactatattgcccaggctagtctcgagttcctgggctcaagctatcctcctaccttggctttttcaaagtgctgggattataggcatgagttcctgcacctggcataaagtttcattttatattgcagcttttaaagaatgggagtgcatcacatctacttttaaaggaaagctgagcatgttttgagttatgcacagttttcagcaaaacagcccatgcatgaaatccaacaggcttgtcagattaggctggtcactttacattatatactttctcatgtagttctcacgacagtcctgttatttagagattgccattcggcccatcttatagagaggaaactaaggcttagagagggtaagtgacttaacctcaagtatgtctgagtggtggagctgaaacctcaatcttggtgtggctgacttcagacttgttacttgtaaccaccgtgcagtcccaagcttgtgtttgttgctgttccaaatgcaacattggtgcctctaagcctcatatcatgaactggttcagagagagaaagccacagtccccccaggttcatttagtgtgtgttcaggtgtgttggcatggtgcttccttcagtctttctcaagcctcataggcagaaaacccttcatgaaagcatagtggtcaagagccacgggctctggggccagacggcctgtgcttgctcgaattccaggttcacaccagtaacttgtaagttatgtgaccttgggcaagttactcaaccctcatatgcctcagttttctcatttgtcaaatggagacaataatagtacctaattcatactattattatgaaaataaatgactaatataagcctggcatgcagtgtgctctagagcattagctgctaatattatctctgccaccaaaggctttagccaagactgccttcaaaagcagtgtttgtggggtggtagtgttctagaaaaggtaatgtttcctttttttttttttttttttttttgagaagggggtctgattctgtcacccaagctggagtgcagtggtggtgcaaccacggcttattgcagcctcgacctcccaggctcaagccatcctcccatctcagcctcctgagtggcttgactataggcatgcaccaccacacctggctaatttttgtatttttaaattttttatttttatcattatttttgagatggggtctcactctgttgcccaggctggagtgcagtggcacaatttcagctcactgcaacctttgcctcccaggttcaagcgattctcctgcctcagcctcccaagtagcagggactacaggcgcacaccaccacgcccagctaacttttgtatttttagtagagatggggttttgccatgttggccagactggtctcaaactcctgacctcaggtgatccacctgccttggccttccaaagtgctaggattacaggcatgagccaccatgcctggccagaaattggacactttatttatttatttatttttgagacggaatctcgctctgttgcccaggctggagtgcagtggtgcaatctcagtcccctgcaacctccacctcccgggttcaagcaattctcctgccttagcttcccaagtagttggggctacaggcacctgccaccatgtccagctaatttttgtatttttagtacagacggggtttcaccatattggccaggctggtctcgaattcctgaccttgtgatccgcctgccttggcctcccaaaatgctgggattacaggtgtgagccaccgtgcccgaccaattgtacactttaaattggtgaattttgtgttgtgttaatgatatctcaatattttttgaaatgccaacagggaacaaatcatcattagtgaaacagctcttgttcagattagtaagtagagctccagtcctgagcttttagtaaacaattgtgagccccagtgattccacgtggtcctgccctatgtgtagagccttggtttgcagccttcccagaaacagaaatgcttctgggaaaccacagctccctacctgctgaaggaaatggacacctgagataagctgaatatattgtgtgtgtaatcagaaggcaggcaggcaggccggttttccagatgagcctaagctaatggcttaaaagggtgtttaaaagagaaagcagtagcctgactggtctgaactcctgccctgtcagcagaaacggtgcagtcacaatgagaagggaaagagtatttaacgctggtatgaacggcaagcctctgcctcctgatttagttaataagcagttttcctatggaattgattgagggggagagaggtttttctcttcctggctcccttggtgtgtgccctctcatgtcagaaggcaggaagttctctgggaattcacaccagaggttttgccattatttaagcaaattaaggcctttgggaacagccaggtggcctttcaggttttgtcagggccaaaaagccctatcacctgccaaggtgttgagtcaacttatttacagtgctcagagccagttcctgtgctgctgaaatccctgaaggcctgctctaaatgggcctggtcagacatcaacaccgcctgcctcatcagcacttttagccttccacctgcagtgcgggcttgactgagatgccccagtggcttgtcctgggaaaactgctcccatctgtaagctgccaccctcctttggtgactttgcctctctctgcctctttactccctgcacagaggggcaaagaggcacatcctccagggaggcagggctaggtggaagttaaggtgatgggctttggggtccggcaggcctgagttcaattcccagctctgctgtgtgctgttatagctacgtggccttgggcaaatcccttaccactgtgagtattgctttattcacctgtgaaatgggagtaacacggtacctaccttctaggctgttgtgaagattaactgcaattctgcatggtgcttctgatagggtcagtaactgaggggttggccgggcacgatggctcacacctgtaatcccagcactttgggaggccgagcaggcaggaggatcacaaagtcaagagatcgagaccatcctggccaacatgatgaaacctcgtctctactaaaaatacaaaaattaattgggcatggtggcacatgcctgtagtcccagctactcgggaggctgagaagaattgcgtgaacctgggaggtggaggtgacagtgagccaagatcacaccactgcactccagcctggcaacagatgagtgctgggggtgttggagggaggctggagaatgaaagggaggcaactgaggccacagtgtctggctgtttccaatccccccatccccagctgaaaccctctcatctgcagataactccaagacactccttacttctcccagaataaaagcccggctctctacaatgaggctccagctacgtctgactttgtcactgactacccttgtgtcactcgctctactcagccaccaccctggattggcttccaaccaagttgtgtttgcttttccctctgcctgaaatgtccttccaaaggggaccgtgtggctcccttcctccctccttccctcccttccagcaagtcttaggtctcagctaaaactgcctttgctctaagtcaccttcattgcctttgacatggcacaccactgcctccagcactccctccttatccttcctccctgtttattttattttattattttttgtttatttattttgagacagagtctccctttgtcacccaggttggagtgcagtggcatgattttggctcactgcaacctgtacctcctgggttcaagtgattctctcctgcctcagcctcccaagtagctgggattacaggtgtgcaccaccacacctggctaatttttgtatttttagtagagatagggtttcgccatgttggccaggctgatttcaagtgatctacccatctcgacctcccaaagtgcttgggattacgggcttcggccaccatgcccagcacctgttctattgttttctctacagcgtttactaccttattgtatgtttttggctaaagggccttggagtcaaccccaggagaacagtgctgatgaatcaggagtggcgctcccataacttcatgcgtcttcaaagctggctagtactgcacctcattctcgtgatttcatgcccacagttacctccagggtgttggctgagcagagcaagtgacatgagggtagttggtgacaaagtcagaagtagctgaggcctcactgtagagagctgggcttttattctgggaaaagtgagtctctggagggctctgcatagagcagaggcttgtcatggcctgaccgaggttgtagcaagctcaatgcggctactgtgtagagaagacgccgtagcaacctgggccagaattgggaagattaaggagctactgcaatggtccaggagtccagagatgaattgagtctgtggggaaaaaagtgtcggctgacaagccgttctgtctccatgttctcctctcaccttttgaccaccctgtccccactcctcagctgtgctttgtattttgtaattcgcagcactcaaagcactcacacaggaggcctgacattatttatctgcaggtcagagggtttgagttgagggtgggggtattggaaacaattaggcattgtggcctcagttgcctccgcttcattctccaccctcctccacacacccgcagcactcattttaacccctcagtatgtcttttactttttccttcctttttagagttagggtctcactctgtcatccaggctggtgtgcaatggtgtgatcacggctagttgcagccttgacctcctgggctcaagcaattaactccacctcagcctgcccagtaattgggactacaggagcatgccactacacctggctaattttttctttttttagagatggggtcttgccatgttgcccaggttggtgtcgaactcctgagctcaagcaatccatcccccttggcctcccaaagtgcggggataacaggcatgcaacaccatgcccggccaattttttaattttctttattgacagggtctcactatgttgcccaggctgatctcaaactcctggactcgagtgatctccctgccttagccaaactgctgggattacaggcctgagcaatcatgccgggccccctcagtatatctttaatccctttgggatctgagactctttgagagactgttgaagaccacagagcctcccacaggtgcccatatcttaacccacagttccagggggcccatgccttccttgatgcccttcactagcccaaaccttggctcaaatcctaggcactcactgctaaggcctcaaggagggggtcagaaaaacaaaaccgcagcccaggaaactcctttcatggccacagagatgtttccagatggcctgagaagggagtggttggtgtgggcagctgctgttccccatggtatcaaatctttgatcaagaggggtggaaaaggattgactttctcaagttcagggcttccttctggctccacaggcaccccccacaggcaagggaccaccacacccaaaggcaggagtggccaatcctgagggcgtggacgggggccacagggaggcagtccacaccctcaggatttgaccctacagggaaggccctggggatgttgccctgtcccaggaacctgcacacccaccttgggggcactgcctctccttagggtgacctcagaggcagttgcagaagtttcgagttctgcaaaagccatctgtggcagaacaggagcggcagcttaccacatacaaactcttcaaatgttcccaccaactgtgacaggtgggggccactctgtagttgaagaggaaactaagactcaagcgtttaactttcctgaagttaacacagctagtcagaggcacagtttgcattcaagtccacatctatctagactccaggcctaagcgctgaccgttagtgctctatgaggcagcacctggtaaagccacctgtgctttgagggggcgttcaggaggctacagcctagttctgtgtagggtcagattatcttgttctttcttctctccgctggcccacatcttaccctctggtgccattgtgaccgatccttcgcaaaggagtcagccctagaattgttgacagtgagcccgtttcctgcccctcaccccacacagggttccttcccatccttgcccctccgtccctggaccagctccatgggtcagtgttcctcttagagcatgactcttggaaaaaaaacagcacttatcattgaggtcatcagattgcaaccctgagaatgtacttatcaaaccacaaatagaatcagagaaggactatatagtctcccatatcctaagtgtctcatttctgaaaacacaactgaaatctggttttggaagccacatcacatgttgcctattgagattacggtcaactgaacacccatccctcctttggttcaaccctctcattaaagaaaagaaaaagggccgggagtggtggctcactcctgtaatcctggcactttgggaggccgaggcaggcagatatcctgagctcaggagttcgagaccagcctgggtaacatggcgaaaccccgtctctactaaaaatacaaaaattagccaggcatggtggcacatgcctgtaatcccagctactcaggaggctgaggcacgagaatcgcttgaacccaggaggtgaaggttgcagtgagctaagatgatgccactgcactccagcctaggtgacagagtatctcaaaaaaaaaaaaaaaagaaaaaagaaaaaaagaaaaaaaagtttgtttatgtgaacataggaaaacaaacacaagccaatttaaatggtacctaagagcctaaaagtgtctgcctgtcagcagttcatctgagacaagcagtgttaccgatttcttgtttccttctgaagatattctaagcctattccctatcccatttagctgtgtgctctttaaagacagattcttcccatattattacatatacacttacttgattcttttttaaacagctccctcattctttttattttatttattttttttgagatagagtctcgctctgtcacccaggctggagtgtagtggcatgatctggactcactgcaaccctcacctcccgggttcaagcaattctcaagcctcagcctcccttgtagctgggactacaggcacctaccaccacgcctggctaatttttgtatttttagtagagatggagtttcaccatgttggccaggctggtcctgaactcctgacctcaagcaatctacccacctcggcctcccaaagtgctgggatttaggcatgagccaccgtgcccagcccttcatgatttttaatttttgcatcattttccattgagtggatgcccatcattgatttatccagccctctgtcaatgatgtgtctatcttttgccaccataaacaagattgtagtggccctccgtatatctgccctgatgcaatgtgtgagtccctctgtgagatgaagtcctaaaaatgggctttgctgaaagaaaggatttatgcatgtaaaatctataaacatgatcagaatgttctcttaaaaagccatactgattcctacttgccatgatgtccaaggccttggagccccacatctttgctggtacagttccgcctctgtgcattacagatgataaaacgaacccagaaaaaatgcaggggtcttgcctgacattctccagagagaatctggtcatctgactctggtcaactgacatccagcattttttttttgctagaccagctgaccagcatccgccggcagcacccccttccctctcccatcatgtgtgggtcatcctcctttccaccgcccacatggacccctccctctggtctcctgcatcctgcatggtgttggttatgtgaacaagttctttagtggtgatttctgagattttggtgcacccatgattggagcagtgtacactgtacctgtgtacactgtgtagtcttttatccctcacccccttcccaccctttcccccaaagtccccaaagtccattgtatctttttatgcctttggatcctcatagcttagctcccacttatgagtgagaacatacaatatttggttttccattcctgagttacttcacttagaatactaatctccagttccattctttttttttttttaacagcttataagttcctaggtccagtgtttcctgtctctaatcccagtttctcaggagggtgaggcgggagcaggcccctcctaccctcctgttcggtcattttagcagatgactttcaccctcatgccttttgcactgtgattgcaagaagggattatttttaactttatgaataggttatatgttcacatggacaccattgaaaaaaaaataatctaaaaagtatacaatgaaaagttctactcccaccctgtctccctttgttctaataaggtgcctcccccatacctaaaatctcacttgttagtgtcttttaaagttctatatgtaactataaacaaatatgaacatatattctttgagacagagtcttgttctttttttctttgagatggagtcttgctctgttgcccaggctggagtacagtggcgcgatctcggctcactgcaacctctgcctcccagaatcaagcgattctcctccctcagcctcccaagaagctgagactacaggcatgcactaccatgcccagctaagttttgtatttttagtagagacacggttttaccatgttggccaggctggtctccaactcctgacctcaagcgatccacccacctcagcttcccaaagtgctgggattataggcgtgagccactatgcctgaccaagacagagtcttgttctgtggctcaggctggagtgctgttgtgcagtcgtggctcactgcagactcaaactcctgggtttaagtgatcctcccacctcagcctcccaaaatgctgggattacagggataaacttatttcttatccccttctttttagttacacaaaagatagcactgctttgcacttgcttttatcagcaaacaataatgtgtcttgacgatcattcccctgcagagcataaagagcttttttttttttaataggttcatagtatttcattgtaaggaaattctataattgatttaaactaatcctctattgatggctatttgggctgtcgcccatgttttgctagcacaaacaatgccttagtgaataaccttttacatacgtcatttttgtgtgcaagctttccagtttcacatcggaaaatgggaacagtccaggtaaatggcccatggagcatttctgcaagagcagcaaccaggaaaataaaaggctggagaaccactgctggaacaggtgccccatctccttgtggtggtagcaacagtaccacagcatcttgtgagtgacctgtggctgttctccagtgtatgccagagtcagattctggcacctgtgggtcactcttcttcatgctcttttcttttcttattatttttgcctacttggaattctttttttttcaaatttgagacagagtcttgctctgtcgcccaggccggagtgcagtgatgcgatattggctcactgcaacctcttcatcctgggttcaagcgattctcctgcctcagcctcccaagtagctgggattacaggtgcccgccaccatgcctggcttgtttttgtatttttagtagagacagggtttcaccatgatggtcaggctggtctcgaacccctgatctctggcgatccacatgccttggcctcccaaagtgcggggattacagggttgagcctgcacctgaccctacttggaattcttgaagtgagccccccagtctgagatctttctgctttctttttttttttttctttttttttttttttttttggtattcaggaggatgcagcatgggttgtaggcttcatttctcaggagcctgagccaaggcacacatatagtctgagcagttacctttccaggcagccagagtagattcagcaaatgctcttggaagcagctgcctttcccatcaatgcttatttgttcttgataatgaaaaatgatgctagcatccattaaaagagaaaaggcatcctcttgtgagctctattggacaagtgagcacttgttgtacagtcatctgcaagcacatgtgacctggagactgtgggaaatgcctcacttcgcagtgttggctcccagctgttctcttgggctgtttgagttttgttccaaaggtcagaggcagagggtccgagcctttccagcacagcccacatttgaaagtagtgcaagcctcacattcattctttgtagaaggtttccagatcttgttcttgagttattgaatgattcaaaggttctgaattccacaacggctttcctgtgtttttgcagccagattcagcacattttggtgtcagccagtgcttggaaaatgtggccctagattgatgcgtgtttatatctgggttgtgttttttatagagaataaatctgtggttacttttacccatcccacattgctgttaactacccctggaatttctctccctccgcaagcctagtgctgaagaacagaagctttggtgctggctggttctggggcgaatgttccttcagaggctgacctgctctgtgaccttgacaaggccctgaccttgagcaaatgacttaagcctttcgcctcagttgctcatcagcattaagggggttaaaaacccctacctgcctcacagcaacataggagtcaatgtaaagttcacagtgcccacacgtaatgactgtcatagtgaatatttactctcaaaaagattttttgttttcagtttttagttgttgattttttttttttttaaatagagatgggatcctactatgttgcccaggctggtctcaaactcctggcctcaagtgatcctcccacctcagcctcccaaagtgctgggattacaggtgtgaaccaccatgcccagcctataactattgttttgttttgttttgttttttggagatagagtcttgctttatcatccaggctggagtgcaatggtgcaatctcagctcactgcaacctctgcctcctgggttcaagcagttctcccacttcagcctcccaagtagctgggattatagacacccaccaccacgcccggctaatttttttttttttttttttgagacagtttcactcttgttgcccaggctggagtacaatggcatgatcttggctcaccgcaacctccgcctcctgggttcaagcaattctcctgcctcagcctcctgaatagctgggattataggcatgtgccaccacgccccgctaattttttgtatttttagtagagacgaggtttcaccatgttggccaggcctgtcttaaactcctgacctcaagtgattcgccctccttggcctcccaaagtgctgggattacaggtgtgagccaccgcacccagcctactgttaattaagaattgtttatggcttctcttctctgcactttttcataaccttggcatttttgggtgcctggattctttcatttttgaaccataggactttgactgatggggtattcctcaagagaccctaatagctatatatttcttactggttcattgagatttaatttacataccacacaatttacccactgtaagtgtacagttagataatttttataaacgtacacagctgttgagctgtcatcacaatccagttttagaatacttccaccacctcccaagttcccttgggcctattggtagtcaagcctaactcagctccagacaacccttgatctgctttttgtctctagttttctagatttttcatatgaactgtgtactttggtgaacagcttctttcactcggtgtaatgcttttaaggttcatctatgctactgcgttttgtgatgtttgatcctttttattgctgagtagctataccatattttacccatcctaattactttttgggttgactgtatataagccacatttacacatttttttaaatgggtaaatgtgaaataagaagaaagttggggctgggcatggtggctcacgcctgtaatctcaacacttttggaggccgagacgggtggatcacaagatcaggagttcaagaccagcctgaccaacatggagaaaccccatctctcctaaaaaaaacaaaaaacaaaaattagctgggtatggtggcgggcacctgtaatcccagctgcttgggaggctgaggcaggagagtcacttgaacgcaggaggcggaggttgcggtaatctgaggtcatgccactgcactccagcctgggtgacagagcaagactctgtctcaaaaaatgaatgaataaataaaagaaagttggacaggaagatccgttctcactgtgtcacccaagctggagtgcagtggcccgaacatgattctctgcagccttgacgtccccagctcaagtgatcctcctacctcagccctcccaaataatggggactacaggtgcatgccaccatgcccagctaatttttttttgtattttttgtagagatgggctctccccatgttgcccaggctggtcttgacgggacttggactcaagtgatccgcccacttcagcctccccaaagtgctgggattataggtgtgagccaccgcacctggccaggtgtttaaaaatagaataatgtccagaacctaattttggagaacaggatgtaaagggatgcaggacaagggagtaaatgaattaggaaagggatatagaccaggatctgaaggacacatatcaggtgttagcagtggtctctctgcaaggatgggcttgtgaatactttgtgcgattggctcatcttttttttttttttgtaacagctttatcgaaacataatccacatagcatatattacaccatttaaagtgtagaatttaacagtttcccttatagtcacagacttaagcaagcgtcaccacaatcaatttcataacattttcatcacctccagaagaaatccctcactccttagttgctactgccccagccctggacatctggattcagttagtctgaggcaggggccctggctgagtatttttaaaaagtgccccaggaggctgggcccggtggctcatgcctgtaatcccagcactttgggaggctgaggcgggcggatcacatgatgttgggagttcgagacctgcccgaccaacatggagaaaccccatctctaaaactacaaaattaaccgggcatggtggcgcatgcctgtaatcccatctactcgggaggctgaggcaggagaatcacttgaacccgggaggcagaggttgccgtgagccaagatcacaccattgcactccagcctgggcaacaagagcaaaactccatctcaaaaacaaaaacaaaaacaaaaaacccaggaaagtctctgtgcagcacattagaccctgaatggaaatgatgttaggaggcattttggtgcatgctttatttcaccagtcggaatgtaagccttaccaatgtctgtgagggcccaggacttgttctcccacatctcaggcctgtcagctgccctttcctgcacggggcatcagggagagagaggaggagggatttagtagctttggaattcagtacatggggtctccctaacctcggggaatccaacagaaagaaaaaggaggaagaaaatgtgatgattttctttttaatcagtaagcaaacagttcctagagttgcccaacctgaccacaggaatgtttcctgggttgcagtccatgaaaatgatcagttacggcctctgtttcggcagacaggctgtgttgttacgcatgcagccacagctgggacaagaaagcccctccaatttgctgtgaacccagagggcctccccattctccttattctttttgagaaaatcaaacgcatttccctccctaagacaggtggggaagcagtccccctccagcctccgcctctgcaggaggcctaatgtcgctgccaactccttgctagaatggagatgagttgtttttctcccctcttcttgaaaacaaattgagatgagattccttgccagttggtgttgactctggaaaattgaaaccaagcagttggttttgacttgagcagagaagcaaccccagcttctccagtcaaggcagcagataccaatccaggcaggaatattgagatgaaactgagtgaggctgttaatcaatgggcacactggctgttgctgtcctctctgggagaggcctggaaagaaaaatgatttaaaactaagttcccttctggccttgttgtcaagaagggtatggggtatggggaggcaatgaggcaatctggcccgcaggagcaagagctaacctttctcataggcctgtgctaaaatcatgttaattccacttgaatgttggcccccgggtgggcaggagtggttatctgttgtgattgtggctggatcttcagtactagaacaggctgcccccatgcaggaggtatgcacacagtaggtgtgcaggctttgagtagaccttggaactgttcccccgcactgccgcctgctctctcccttacttcagcacacagctccaagctggggcagtctctttcacttccctttattccctaatatgccctaatattccctaatgtcctttatttagtgagttgtcctgcctgtcacataaagcccttggaaattccttacctgcttatatttctctattacacttttcattcctgatactttttttcgttttctttctttttggagatagcatctcaatctgtcgcccaggctggagtgcagtggcacagttacagctcactgcagcctcgacctcctgtgctcaggtgatcctcctgcctcagcctcctaaatagctgggactatagacacgcgccaccacacccagctaatttttaattttttgtagagttggggtcttgccatgttgctcaggctagtcttgaattcctgggcccaagtgatcctctcacctcggcctcccaaagtgctgggattacaggcatgagccaccatgattacttattgatttacttgttaattatctctttgacattgaaatgaaagccccatgaggtcagggactttgctttgtccattgctgtatttctcaggccttaggatgatgcttgacaaagagagtaagggctcgctaaagatttactggaggaagaatccttgaagcaatccctcaaaggaggtggggacgtctgcctatgtattttgtttgtttatttttttgagatggagtctctctctgttgcccaggctggagtgcagtggcgtgatctcagctcactgcaacctccacctcccaggttcaagcaattctcctgccttactctcccaagtggctgagattacaggtgcccaccaccatgcccagcttaaattttgaatttttgtagagattgggtttcaccatgttggtcaggctggtctcaaactcctgacctcaggtgatccatctgcctcagcctcccaaagtgctgtgattacaggcatgaggcaccacacccggcctaaacactgacttttttttttttttttgagatggagtcttgctctgtcgcccaggctggagggcagtggcgcaatcttgactcactgcaacctccgcctcccaggttcaagcaattctcctgcctcagcctcccgagtagctgggattacaggcatgcgccaccacgcctggctaatttttgtatttttggtagagacagagtttcaccatgtggaccaggctggtcttgaactcctgacctcaagtgttccacccacctcccaaagggctgggattataggcgtgagccagtacgccctgcgacactgacttttaatcaattccagaagcgccattcatgacccttccccccgggctggttctgatcaacacccatggcgtttgccgtcagagaaggaaacagcatttgtccaagcagaaccatggttgggaaagcaaaaagacaccctttgccagtgtgaccaagtcgcttgagtaatcttaaacaaagggaaaaagtcaagggcgatggcttacacctttagccttgtttctcccacttcagaaagtaaagggtaaagggtcctgggctaatttttccttaatcttcaatgtcactgttttctctctccacccccgtctgctttgatggggacagaagccaaggggactttgctccctgcttcccatccaggcagcgttcgttgttgacatctgttttcagggtgtagctcagtgaagacagagacgatacataatttgttctgggcacatatgtttgggggacgttagaaggaacttgataagcttcatgcaaataaacttccagtccctgggaacccatgggggtcgcctgtcaacaggggtgcaggagccgcagctgccaccctgagagcacattgcatggatgttgtgggcacgttaagagtcatgcttgtgcaacgtgatactccaacctgcttatcttccctggaaaaatgttgtggttgacgttggcagtttagaggaactttgacttatttcagcttatgcaaagtggtaacatacagcgagacctttttgaaactggagtatagtgtggctgttggaatatccttaggtttctctgaggcctggaactggatttccaaggctcaattttcatccaagaagagagggagtgtgtataatgatgcttttgccgttattctcattcaagttactctccaactgtcctattcttttgtgagaactaacttctcagatccattcagctagcaggcttgtgaatggctcatcagtactaacagacaggctgcctggtgagtcctggcggctaagtagcatcagactacagcttccgtcacttcatagctatggaacttggttaagttccttctctgtttccccatttataggaaagggatgctggccaggcgcagtggctcatacctgtaatcccagcacttggggaggccaaggcggatggatcacctgaggccaggagtttaggaccagcctgaccaagaggtgaaacctcgtctctagtgaaaaaatacaaaattagctgggcatggtggcgcatgcctgtaatcccaactacttgggaggctgaggcaggagaatccctcgaacccgggaggcaggaggctgaggcagcagaatcccttgaacctgggaggcagaagttgcagtgaactgagattgcaccattgcactccagtgtgggcaacagagcaagactctgtctcaaaaaaaaaaaaaaaaaaaaagtgggaggatgctaaaatccctaccacacaggactgctctatctaataaggacatagactgttgttgttgtccatagttttgtttttgtttttgttttttgatacaaggtctcactctgttgcccaggctgactgcagtggtgccatcacagctcaccgcagcctcgacctcctgggctcaagcaaacctcttgtctcagcctcccgagtagctgggactacaggcacacaccactgctcccagctaatttttgactttttgagttttttatagagacacggtcttgctatattgcctagggtggtctcaaactcctggacacaagcagtcctcttgcctctgcctcccgaagtgttgggttacaggcatgagccaccatacctggccgtgtccattagctcttagtagcaaatggacacacaacattagagacttatcatcaagtgagagtcagtgttcctggtggaacttgaatgtccttttcaacatgccctaagtgtggacaaactggaggcctaattgttctttcctttgcatttttatttttaaaaatttgttattttaatttttattactataattttagagatggggtcttactttgtcacctagggtggagtgtggtggtacaatcatagcacactgcagcctccaactcctgggctcaagcaacccttctgcctcagcctctctaatatctaggactacaggtgcaccaacatgccgggctaactttttttttttttttttttgagatggagtctcgctcagtcgcccaggctggagtgcagtggcacgatcttggctcactgcaagctccgactcccaggttcacaccattctcctgcctcagcctcccgagtagctgggactacaggcgcccaccaccatgcccagctatttttttttttttgtatttttagtagagacggggtttcaccgtgttagccaggatggtctcgatctcctgaccttgtgatccacccgtctcggcctcccatagtgctgggattacaggcgtgagccaccgcacctggccaaccgggctaactttttagattttctttttttggtagaaaatgaggtttcactatgttgctcaggctagtcttgcatttgtaaacataaaattaacattttctgctgagtatgaatgctcaataaacctgtaatgttactgatttcatgaatactcattaaaagaacacatgccagaatccccagtgtcatctaagaaaatagcctggaaggagatcttataggcagcagtatctgtggagatggagttagaaacactgtccctaaccagcaaaaagaaaaatgcctaactagctgaatgaggctgtctccccaggattcctttcatccatcaagttagatttctttttttttatttttattttaagagatggggtcttactatgttgcccaggctagtctcaaactcctgggctcaagtgatcctcctgccttggcttcgcaaaatggtgagattacaggtatgagccaccatgcctggctagttctctgatttttttgtttgtttgtttgtttttgagatggagtcttttttgctctgtcacctacactggagcgcaatggtgcaatctctgctcactgcaacctctgcctcctgtgttcgagcaattctcctgtcctggccttctgagtagctgggattacaggtgcccgccaccatgcctggctaattttttgtattttcagtagagacggggtttcaccatgttgaccaggctggtcttgaactcctgacctcaggtgatccacctggctcggcctcccaaagtgctgggattacaggcatgagccaccatgcccagccagttctctgatcttgtcctccagtttttatgtgtaactgaggctgagctctcaagttcaaatggtctttgaataaagctaaatgcaggccgggtgcggtggcttatgcctgtaatcccagcactttgggcggccaaggcaggcggatcacaaggtcaggagttcgaggttatcctggccaacatagtgaaaccccgtctctactaaaaatacaaaagattagccgggcgtggtggcaggcacctgtaatcccagctactcgggaggctggggcaggagaatggcttgaacccgggaggtggaggttgcagtgagttgagatcctgccatggcactccagcccgggtgacagtgcgagactctgtctttaaaaacaaaaaaaaaagaattgctaaatgcagtattctttggtgttcgctgtgggaaatgtgttctgatgagagggaggcaatccataatgtgcccctttgtatgcagggtgggcaaaacactgcttccaactagttacgtctaagatactaggttatcccactggttaccaaacaactcaactatggtttgctgccttccatagctggccctgtccttaaatcccaacatcgtctgaaaataatatagaagcttttgagactgtcttgtttctacccactcacattccagttatgggaccaggcgggcgtgggagaagaaacgggatcgtcaaagtgggactgttccgtgtggcatgatggcaatttcaagcaaggaatgttgctgaatgctcagagcctgccccaggaccaaaagcttttcatgaacttgggtttcatttgtatttgaacatcagtcatctctcttggggtcctctcttgaaagctacttttgcccagtaggctagaaagtggggcaccgtaggtttaatagcagcatgcagggatgacagagtattaaaaacactttttaaaagtcattcttactagtttttgtcatgaaaaaaaaaagaattcattctaattgtaacaggccaagtaatacaaggatatataaggaaaatatgttgttgttgttttcaaactgcctcctggccaggcacaatacttgtatctgtaatcccagcactttgggaggctgaggttggtggatcgcttgaggccaggagttcaagaccagcctgggcaacgtggcaaaaccccatctagtcctgtaaacataaaattacattttttgctgaaatacaaaaaatacaaaaattagctgggtgtggcagcacatgcttaaaatagagcatggcacattaatattctacacatgtttaaaatactaataaaataggccaagcatgatggctcatgcctgtaatcccagaactttgggaggctgaggcaggtggatcacctgaggtcagaagttcatgaccaggcttggcatcatagcgagaccctgtccctacaaacaataattaaaaatttgctgcggtggagtacacctgtagtctcagctactctggaggatgaggtgggaggatggtttgagcccaggaagctgaggctgcggtgagctagcgtttgtgccactgcactttagcctgggtgacagagtaaaaccctttctcaaaaaattaaaatgaggctgggctcagtcattcacttctgtaatcccagcactttgggaggccaaagcgggaagatggcttgagcccaggagtttgtgagcagcctgggcaacgtagtcagaccccatctctacaataaataaaattagccaggcatggtggcatgtacctgtagccccagctactcaggaggctgaagcaggaggattgcttgagccccgaaagccaaggctgcagtgagcagtgtttgcaccactgcattccaccctaggtgacagagacctgtctcaaaaagcacacaaataaaattaaataaaatctgaataaaatagttcataaaagctaattgaagcttagttgaggctgcagtttttgatgatggtgatgatattgtaatgaaaagactttcccagctgggcacagtggctcacacctataatcccagcagtttgggaggcagaggcgggcagatcacttgaggtcaggagttcgagaccagcctggccaacatggtgaaaccttgtctctactaaaaatacaaaaattagctgggcgtggtggtgtgcacctgtaatccccgctactcgggaggctgaagcaggagaattgcttgaatctgggaggcagaggttgcagtgagcccagattgcaccattgcactccagcctgggtgacagagtgacactctgtctcaaaaaaaaaaaagactttcccacatggagatggccagtagtggggagtggggtcttagcttcttttgttgggatttggtttttacaccaagtcaccaaataagtttatgaaaggtgggcatactgggttaaagaacacttagacccttgttagctttatttttgttagctttttttatgggcatgttgaaatatacccagtccccgtattctgatcctccagtttcaacattttgccattcttctttcctcccacttgctgggctcagagacaacccagcccttgccagcgtgacagtgagcttcccagagcctttctggagctgaagaacctttcaatctttcctacaatttcctataatcagcccaggggatcaggttgcatggggagataatgagtcttatgagcacctggaattcaggttggggctcctcgtcatactgtcacttctcaaagggtagggcttaaccaccattaagatgaggtgccccaaagcaggttaagtgccttggatcaagttatttgcaaaaccattttcattttttcaggccgccacccttggcaagtccaatcatgcttgtctcaactttcactgtctaaatttgggaaggctggagaaaggaattcagtgcagccttcattccctgtttacatgacaagcccctaaagatgacctagttgccccattacttctgctgggggtgggggaggactctttgaagagcatctggttttgctagtttgaaaagaaattcctattttagacttaaaaggatggtatctgcccatcctttaaggacttggcatttcttcttgattctttcatcatcttatggctcagctgttcagttaacaaacacttgtctacccaaatacacaggaataatagtcatctcttctactttcattgctttttaacttagaaaatgtcatcccattcactgtcttggtcttcacaaaaccctaaagaggtagactcaaacagtggtgataacctttatgttatagtagagaaggccaaggcccatagaggtttagcaatttgctaaggccacccagcaagaacatggcagaatctggttttataatccagtcgcagaccctgggtccagccctttttccttgtctctgtcttcccatcatttattacggctccccctgctcaccccatcctttccttcaagttgcggaagtgagttgtagacccagtctaagggctgagaaggtaggggttggggcatggtggtgattttttatttttattttttaaacaaactgggagggagggtcaggtgggcgactctttgaatgacacagctcccttcgtatgaacgagctcttcctggtttcgttgctcagtttatttgccaggtagcagactcctagctattgcatggggtagcctctgatctcagtcttagagatcaagactggagctggagaacctttcaatctttcctataatttcctataatcagcccaggggatcaggttgcatgaggagataatgagtcttatgagcacctggaattcaggttggggctccctctcatactgtcacttctcaaagggtagggctttgaatagatagattataggtataatctatctataaactaatataatcttccttttaaaaataaccaaggttggggccgggtgtggtggctcattcatgtaatcccagcactttgggaggcgaggtggatggatcacctgaggtcaggagtttgagaccagcctggacaacatggtgaaaccctgtctctactaaaattacataaattattcaggtgtgatggcacatgcctgtaatcccagctactcgggaggctgaggcagaattgcttgaacccaggaggcggaggtttcagtgagccgagatcgtgccactgcactccagcctcggcaacagagcgagactgtctcaaaaaaaattaatagtaataataattaaaaaaaaaaaaaaaaccaaggttggctgggcacactggcttatgcctgtcatcctagcactttggaaggccgaggcaggaagactggttgagtccaggagttcaagaccagcctgggcaacataacaagatcccatctctatgaaaatattatttaaaaaaaaaaaaaccaaggccttaatagggtctctccagagagaggaagagccaaccatgagactaacccatgttaaagggctgtctcagctctgccatttaatagttacaggatgtcaggtaaatttcttaacctctgtgagcctcagtttcatcttcaaaatggagaaaatctgttacttcccctctcacccccaaacgtggtcttatttttctctggcaagggcagggctattggcttcagaaatgtttgcaagggtggcccctgatggaagaaatgaaaactgctgcctaggcgtcagggatggcttcaagggctttctggcagaaacctgatcctcctgtctagccttgtaagataggacggcaggaatttttataaaagagaacttggatgaaatagaaattccatcggacaattatttgaaagggaggaaaacaggccaagctgagagtttcctagaatgaatggtcttatcgactgctcccctctgcctggaagcttctttgagccaggcttctgcaaggctggctccttcaggtcccagctcagatgggcctacctcagaaaggcctgccctcaccatgcaatagatgttacatcttcagcaaactcccttctcctctgccactcttatatcaccctcttttattttaatttctttttacctattaccactgcctgaaattttaagtttctgtctttgtccatctcttcctcagtagtgtaaactcaatgagagcagaaaccttaagtatcttcgtcacgattttgtcctcacagtccaacacagtgtctggcatatagcttgatggttacctatttgaatgagtcctttgagattctaatgtatagtgtagatgcttcaaccacagcttctccagttttagagtattaatactttttaaagttttagttacttttatttatttattttttgagatggagtctcgctctgttgcccaggctggagtgcagtggcgcaatctcagctcactgcaacctccaccttacaggttcaagagattctcctgcctcagcctcccaagtggctgcaattacaggcgcctgccactaaacctggctaatttttttttgtatttttagtagagacagggtttcatcatgttggccaggctggtctcaagctcctgacctcaagtgatctgcccaccttggcctcccaaaatgctggggttacaggcatgagacactgtgcccagtcgagaagttactttctagacaagataatattttcaattgacaagaagatgagaaagaaatcagagcacaaggaagtcatcctgtagttgtgaagaacattatggtgatagctttgttgttctgtcaccagattatggtttgttttggttgtgtttggttttgtgggagtcttcccacaagttcgctctttggagaaggaatgctcttgtctttaatctgtccaatttcctaatctctgtgatttctgccctgcagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggtatgttggcatttttctgagaagttcgctgttgttttagtgcgctgtctaatccaggtttctcagccttggtaccgttgacattttgggctggatgattttgtgttgtaggggttgtcctgtgcactgtgtaggatgtttagcaagcatccctggccttaactggttagacaccagtagcacttccaccagttatgacaacccaaagtatctccacatgttgcccatggcccctggggggacaaatcagcccaagttgagggctcttggcctaactgaataattcttgctggagtttttggggtgtggggatcgggtagtgtagaagagtggtaaaggcctgaacaccgtctgggactgaatctcagccgtgctatttactacttgggtaatgttggaggaattacgtcacctgtctatgcttgagcttccttatctgtaaaatggagataacagtgaggatggaattaattaatacatgtgaaatgctaaaaatacgcaaggcatacttagtcattgttagctgtctttaccactcccctcttgggggaagaagaatgaatgagagctggattcttctctctctctctcttttttttttaagacgtagtctcactctgtggctcaggctggagtgcagtggcgtgactcacagcaacctccacctccccagttcaagtgatcctcctgcctccacctcctgagtagctgggattacaggcgcccgccaccatacccggctaatttttgtatttttagtagaggcagggtttcaccatgttggccaggctggtctcgaattcctgacctcaaatgatctgcctgcctcagcctcccaaagtgctggaattacaggagtgagccactgcgcctggccaagagctggattctctgatcattttgctttttgtgcttccagtaagaagagccttggtgaagaaggagaagaaccagtgggcagctcttaccccattagactataacctccacaagacccttccccattgtatttgcagtgcctggccttaggtctggcccataccaggaacagacaaacagatgaattggccatgaatggaaggatggatggatgtctgcctgggttcttggcaggaatgtttctaggggttgttattcgaagccagtttctcaagtgctcccgtggtgcttcctaccgaaatgtctctctgggggatattctggttgtgtcctgcttactgctttggacgtgtggaatatgttgtaagtgccagggccagtaagattggcatcttcttttctcgctgaagactcttgatattcttggaacttaatggtcctcccgatctgatttttctccctggtgtaattagaccagaaaaatgaggaatctaatactataggaccatattaacttagctccttgactcaaagtctccaagggtccccatcattcatgtgaaaaaaactcagcacagtgagtccttgccaggcagctgtgtgtggaagcctcttatgatccagagacagttttatttttttagagacagattcttgctctgtctcccaggctggagggcagtggtgcaatttcggctcacggcaacgtctgcctcctgggttcaaacaattcttctgcctcagcctctcaagtagctgggaatacaggagcccatcaccatgcctggctgatttttggattttagtagagatgggtttcatcatgttggccaggctggtctcgaactcctgacctcaagtgatctgcccacctcagcctcccaaagtgctgggattataggtttgagccactgagcccggctgcagggacagttttgagcttgggtcttcaacttttcttccacatctcttgaactttgtttctgcctccatgtctgctgtatcatgattgggttcaagtgcatgttatataaatctccaattgtcgtggtttatgtcgtggtttattcctcaagttaaggaagccctagggtaagctgtgcccagtatggagacttgatagtcatcaagagcccaggttccccctttcctttttgctccgccatcctcagcacatgacctcatcctcaaggagacctcgtgatcccagatggcggctggagctccagtcatcatgtctttttttatttttttaatcatgtctttattctaagcaataagaaggagaaaggagaagcataaaaattcattacttagttatctgtctgcctttttttttttttttttttttttttttttgagatggagtctcgctctgtcacccaggctggagtgcagtggcgcgatctcagctcactgcaagctccacctcccggattcatgccattctcctgcctcagcctcctgagtagctgagactacaggcatccgccaccacgcctggcttattttttgtatttttagtagagacggggtttcaccgtgttagccaggatggtctcgatctcctgaccttgtgatccacctgcctcggcctcctaaagtgctgggattacaggtgtgagccactgcgcccggccctatctgccttttaagaaacctttgtggaattctccacaagcaacacttgagaaacactggccaaaatttagcctcatgaccacatctagctgcacatgcagtgtagggaatgtagtctttcatatgaatacatttctggaatgtatattccagaattacaaaattgagatatatattggagagataggtttttattttgtttttaatcagaaacaaagagtggatattgggtggtaggtagcagattatgcctcagctggtttgagattcaccttggtttgtctctatagttcaaaggatccttctggaaccaggtggtactgtaattagatggcagtcttacctcgctttcattatatattgattaatttttaacttttttaaaaaacaacatatccaggtaacaaaatctttttttttttttttttttttttggagacagagtcttgctctgtcacccaggctggagtgcagtggtgggaacacagctcactgcagccttgacctcccaggctcaagcaatcctcctgcctcaatcttccatgtagctgggaccacagggtgcaccaccatgcccagctaatttttttttttttttttttttttgtagagatagggtttcactttgttgcgcaggctcaaaatctctaaatttgtgtaagaatagatcttagtctctagtcctttcatcttatttgggtgagttttctcagtctggcatccttcctttcttttctttttacttttcttttcttcttcttccatttcccttccttttgtgtttttagtacagatggggttttaccatgttggccaggctggtcttgaactcctgacctcaagcagtccacctgccttggcctcccaaagtgctgggattataggcgtgagccaccgtgccccacctggtatcctatttttctgagggatcacttccacgtgcagtgttttcaggcatgactccctttcatttaacacatgaaaatgttagtgtgatgttttgccagcacagtgttcatcattattcattctctgaaaatattccacagtcctggtgtcagcaaggcatgcatgttcctttcctttcattgtgataactgggtttgcattcatccatcagtgcccatgtgctcaccatggctgtgcaaggtggccagtttttgttgttgttttgtttgtttgtttttgtttcttttttgagatgcagtttcactcttgtcacccaggctagagtgcaatggcacaatctcagctcactgcaacctccacctcctgggttcaagcaattcttctgcctcagccttctgagtagctgggattacaggtgtgcaccaccacacccagctaatttttgtattattagtagaaacaggatttcaccatgttggccaggctggtcttgagctcacctcaggtgatccacccgcctcagcctcccaaaggaaaaagcctgctgggattacaggcatgagccaccaggcctggccaaggtggctgttttaaggcttaggatacagtggtttttctgggattggtttttgtttttgtttttgagacagagtctcgctctgtttcccaggttggagtgcagtgacacaatctcggctcactacaacttctgcctcccagattcaagctattttcttgcctcagcctcctgagtagcttgaattacaggcacatgccaccatgcctggctaatttttgtatatttatttatttatttatttatttatttatttatttatttatttttgagacagaatctctctctgtcatccaggctggagtgcagtggcatgatctcagctcactgcaacctctgcctcccgggttcaagcaattctcacgcctcagcctcccaagtagttgggaccccgtgtgtgccaccatgcccggctaatttttgtatttttagtagaggcagggttttggcacgttggccaagctgatcccaaactcctgacctcaagtgatctgcctgccttagcctcccaaagtgctgggattacaggtgtgagccaccacgcctggcccaggatacagtgatgatggtcagttttttattttgttcatgtgctggggtcaaatctcaataaaaccataactcagtgttttccaaccagtccaaccatcatctccatcattacctttattgagcacttactatgtttcaggcagtattcacagtgctttaaatgtgcaataccagcatctcatttaatccttccaagaattatatgagataggttctaatattatccccatttcagacattaggaagctgtaatacagagaaattaagtaatatctgcctggggcaaggaggtactgtcatgaggattcaaagccaggcagtctagctccagagcctgcccttggcgcaggctgggctgcctctctaggagacaaacacaggatgtagagggcagagagcataggtgtgtgcgcatgtgtgcacatgtggccagtgtgcagcattggggaagggctctgtgatgatacctggtcatatctcacatgtatctggtgcatcttcaatcttaaagccagaaaatagagctgaactcaaacttggcaagcagtgatcagtgactgtgagtttttatgtggagggtgagagatggaattttcccctggaaactttactgtgttaccagtaatcaccttaaaacacttaaacaatttggcaaatattttccttccattttcaactctcttatttccctgcatgtgcataaagttatctttattgcatatgaaaactgttcaatacaagtctcaaagggtgtttttggcttccatcccaacagcttctgttagaacaaatggaaaccatatagacataatgatacagtgagatgaagagatttatattgatcacaaagtagttcttagtacaagttctcaaaatctacttgttttgggataactccacgttgaggacctgtgtccccaagaaaaatataaaagaggctgggtgcggtgactcacacctgtaatcccagcaaattgggaagccaaagcaggagaatcgcttgagcccaggagttcgagaccagtctgggcaagatggcaagaccctgcctctaaaaaaatttaaaaaatttaaaaaattaggtgcacatggtggtgcatggtggtggatgcctgtagttccagctacttggtaggctgaggtcagaggcttgcctgagctcaggagttcaaggctgcagtgagctttgatcacttcactgcactccagcctgggtgacagagcaagaccctgtctctatttaaaaaaagaaaagaaaagaaatcgaaaacccaaatattcagttgttgagtaagctctgatattaaatcatcagagtataatgttgctgttaaaaattatattatgggctgggtgtggtggctcatgcctgtaatcccagcattttgggaggccacattgcttaagcttacaagttcgagaccagcctgggtaacatggcaaagccctacgtctactaaaaatacaaaaattagtcagccatggtggtgcacacctgtagtcccagctactcaggaggctgagatgggagggatggcttgagcctgggaggcagaggttccagtgagacaagatcttgccgctgtaccccagcctcagtgatagagccagatcttgtctcaaaaaaataaaaatgagattatgtaggcttgaaacagcttgtaaattataatatcaaaccctgaaaccaatacttgtgtatgcatgatgattatttgagctctggacactaagaaggataaaaagagaatgcagtctttacgatatagcaaagggtctcattggtttttgttttgattggtcattttggtggatatatataatttgtcattgataagagaatgtgtcattaaattcaaactgtacactgcccacagaaggctggggacgctgtctggctaggttggactgttagacctgaagtatccgtcttgaattgtcttatcttgttcctcatcttctttccttttaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcaggtagagaaagaagttctctgtttctctgggagggatttggcagagaagtaccaaggagagaaagggaaaagacccagtgttgggatccttctttactaattctttttctttcattttgtcttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactgtaagtatctcttagaagcttgttgacaccggggtaacatccacccaggattttttggtcaacccatgctggatccgcagatcagaggctctgaacacatgaggagcttaacttgacacctcttgacctgttgctaaggagaagtgatgggagaacgtgggacagtttggggttgttaatttttctccttgtcaggaagaaaggaaggagaatccgcatgcatcctcatacaaccaggacaaatttagacccaagatgtcaacctgttcttggggctggaagtccctgacctaaaggaacaggacagtgatgatataagggagcaaaacccatttcttgggcttggcagcagcaagagcttaggaaaaccaagaggtcttttttttttttttttgagatagggtttcactctgtcacccaggctggaaccacaacctccacttcccgggttcaagtgattctcctgcttcaacctcccgagtagctggattataggcagctgccatcatgcccagctaattttttgcgtttttattagagatgaggttttaccatgttggccagagtggtctcaaactcctgacctcaggcgattcaccctacttggcctcccaaagtgctgggattacaggagggagccactgcacccggcctacaagaggtcatttgtttttgttttggatttttgtttttttgagaccgagtctacctgtgtcactcaagctggaatgcagtggtacaatcttagctcactgcagcctggaccttctgggcccaagcgacactcccaccccatcttcctgagtagctgagactaaaggcgcaggccaccacacccagttaatttttgtattttttgtagaaacaagatcttgctatgttgcccaggctggtcttgaaatcttgagctcaagcaatctgcccacctcggcctcccaaagtgctgagattacatgaaccactatgcctggccaggaagtcatatattgatgccaaattcagaaatatctgggggaaatgctagactaaaaggaccagagcaagtttcacccggcatggaataagagtttttcaggcccgcatcttcatctctaggcctgatgccctggtcctcgtgtgggaaatgggaggtctgagccgtggggggtgttctccagcccatggctcttaccttgttataatctcactgaagcagcagcagcacatgtgtgagaaaagtcacccactgggggtctcagagcctaggaaggtgtggcagccaggggggcgcactctgctctggctgggccccttctcccatgttttcttcctcatcagagctcaagtcaccctcacttggttctttcagctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggtatatccactaatgagaatctgaatactcagaaagactcttaggttctttggaccccaaagtgttgtccaagcccaaaggttgtgtaactaaagctgatccttcctacggacagaacttcttggcaagccattgttgtgttatatgcatgtgtgtaacagtctacctgtggaaacatataaaatagggagagtttaagaacaatcttcccttttttattattaattttttttttttttaggctgggcatggtggctcatgcctgtaatcccagcactttgggaggccaaggtggatgggtcacctgtgctcaggagttcaagaccagcctgaccaacatggtgaaacctcgtctctattaaaaatacaaaaaaattagccggtcgtggtggcgggggcctgtaatcccagctacttgggaggctgaggcaggagaattgcttgaacccgggaggcgggggttgcagtaagctgagatcacgccactgcactccagcctgggtgacagatccagactccgtctcaaaaaaaaaaaaatttttttttcagagacagggtcttgctttgttgtccaggctactttcaaactcccgggcccaagcaatcctcccacctcagccccacaagctgctaagattataggcatgagctactatacctggctaagaacaaccttcctaattaaggaacagatctttaccagtaccttaaagccctaaacaatcccccttggtcacattcttttctctcctccataaagataaccacaccctaggctgggtgtggtggttcacacctgtaaccccagcactttgggaggccaaggtgggcaaatcacttgaggtcaggagtttgagaccagcctgaccaacatggagaaaccctgtctctactaaaaatagaaaattagctgggcgtggcgacgcatgcctataattccagatacttgggaggctgaagcaggagaattgcttgaacccgggagacagagattgtggtgagccgaatcacgccattgcattccagcctgggcaacaggagcaaaactccgtctcaaaaaaaaaaaaaaaaaaaaagataaccacaccctgacttttgtggtaatcattccctttcttttctttattaccatttgtgtatttatacctggataataagttgatagtttgagctttctttctcccctagcactttggtaagaattctaggaattagggaactctgacacggtaccacccccatgtcccctcctttatccctcagggcagaattggattaagcagtattgacccagtcccaaagtgcagcttgtctaaaccttcatctccttgaactcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagaggtcaggggtcaggaggatccagagggtgtggaggacaaatgtgtattagctcaatcccgtggacaaagcaaaatcctgctaggccagttgtcagttaatacagtgatggtctaagctttgcatctaagcttgtgcccagaggttccgtgcctagaagacaggcaggctggcatgaagcacatggttaaatattctggttccatgtgttgggctgggctaggccaaaggtggctagtgttcctggtcctgacttggttgtgtcgatctctctgcagagtttccctacgtataccctggtggttcaagctgctgaccttcaaggtgaggggttaagcacaacagcaacagctgtgatcacagtcactgacaccaacgataatcctccgatcttcaatcccaccacggtaattctataactccttagagggtttccaaagaaaggtcttttgttgttcatgaactaagtgtcaccactgctcatgggcgaagtctttgaaaactctctccagactagagaatgttaactttaaacttaaaagcaagcatcttgagatggcagttgtcttttagtatcttttttccacccttggcctggggccaattggtgcaagattgtgaagttgcaaaaagcacctactgatttcatagtctcatggtacatttttatagcaaatattacctggtttcatttctttattgaacaaatattttctaagtttatattaggcactgtgttagacactggagagaccatcacacacaaagattccattctcatggtgtttctggtatagccaggaagacatcttatgagaattattgtatgccaaggatattacatgcattcaaggagaaggtattgagaaccaagtagggtaagtttaaatcatcctgtataatggccaggcgtggtggctcacacctgtaatctagcaagttgagaggccaaggctggtggatcccttgaggatggagtttgagaccagcctggccaacgtggcgaaactccatctccactaaaaatacaaaaattagctgggcgtggtggtgcatgcttgtaatcccagctactcgggcatctgaggcatgagagttgcttgaacccaggaggcggaggctgcagtgagccgagattgtaccattgcaccccagtgcgcccattgcctggcctctccttgtcacatcttctccttgaagcttgctttcagttagccaggtgtggtggtgcatgcctgtggtcccagctactctggaggctgaggtgggaggattgcttgagcccaggaggttgaggctacagtgagccatgatcgctcaaatacactccagcctggtgacagtgagatcttatctcaaaagaacaacaaaaaaagaggaatcctttagccccctgagactcagctctgctagcagtcttggtactttgtaaatgacacatctctttgctctgcagtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaaggtttgtatggtacctggcaagatgcagaaactggcatcctcacagctgttcatacccttgtcccctggtatcttcttagaagtagattcgctttggcagggggacagggtgactttcccagattgtagtggaccatgtgggatttgcagtggctcttcctgctcatgtaagaaatcaagaaactgtgctgtgtgtggtggctcacgcctgtaatcccagcacttagggacgctgaggcaggcagatcacgaggtcaggagtttgagtctctgctaaaaatacaaaaattagccaggcatggtggcacgtgcctgtaatctcagctactagggaggctgaggcaggagaattgcttgaacctgggaggtggaggttgcagtgagccaagatcgtgccattgcactccagctctgggtgacagagcaagactcagtctccaggggtgggcggggaaaaggaggccgggcgtggtggctcacgcctgtaatcatagcactttgggaggccaaggcgggcagatcacaaggtcaagagatcgagatcatcctgaccaacatggtgaaaccccatctctactaaaaatacaaaaattagctgggcatggtggtgtgcacctatagtcccagctactagggaggctgaggcaggagaatcgcttgaacctaggagagggaggttgcagtgagccaggatcgtgccactgcactccagcccggcaacagagtgagacttcgtctcaaaaaaaggaaatcaagaagctaaggcttcttggtggctcatggtggctcatgcctgcaatcccagcactttgggaggccgaggcgggcagatcacctgaggtcgggagtttgggaccagcctggccaacatggtgaaaacctgtctctaccaaaaatacaaaaattaactgggcgtggtggtgcacacttgtaatccctgctgcttgggaggctgaagcaggagaatcgcttgagcctggaagacagaggttgtagtgagccaagatcgtgctactgcaccctggcctgggcaacagagtgagactctgtctgaaaaaaaaaagaaatcaagaagctgttacacaggatcctgaaattgaaaaagaagtactatctgctttaataggctctttcccagaaacattctccttccctcagctctttccattttgcggtgacagagaaaatgatttactggtctctgctcttgtgctggtttattttagaagtggggcagatatggttgtttttgaaaaatgtcctagaaacttgaaaactagccaagcgcagtagtgtatggcggtgggcccaactacttgggaggctgaggtgggagaatcacttgagcccagggggttgaagctgcactcagctatgatcatgccactgtactccaacctgggcaatagaatgagactccatctcttaaaaaaaaaaaaaaaaaaagatggccgggtgcagttgctgatgtctgtaatcccaacactttgggaggccaaggcgggtggatcacctgaggtcaggagttcgagaccagcctggccaacatggtgaaacgtcgtctctactaaaaatacaaaaaattagccaggtgtggtggcgggctcctgtaatcccagctactagggaggctgaggcaggagaattgcttgaacccaggaggtggaggttgcagtgagccattgcattccagcctgggtgacaagagcaaaaattctgtctcagaaaaaaataaaataaggaaagaaacttgaaaactaagaatttgagtgaattgcttgttgaagtgactggatccctagaatagccccagctttgccttcctcttgagtaggtgagcagatttgagaagccatggtaagtaattgtggtttctgccattgaaagtcatggcagaaaccacagttacttttgcaccaacctaatatattaccaaaagcaacagttaaggatttaattttatttttactaacacaaaatgtttcgttttgtttttaacttcattgtttctgctctctagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacgtaagtgtgaggatttttcaactgacttgcagcaactggttattttatatcattttatatgtaaatcaataatatgtacttcatggcattttgtcatttgtctgtacaagaccattctcttaatttattttttattccctttatctgtgctcctttcacctgttcccttcccttcacagacagccgttcttggtctgatgtgctgcctctctttgagctcttgtagtatggtagaaatgcaattttactttgcatacatactattgtgtttttttgagtttggagtctcactttgtcgcccaggctagcgtgcagtggcgtgatctctgcctactgcagcctctgtctcttgggttcaagcaattttcatgcctcagccttccatgtagccaggattacaggtgcctgccaccacgcccggctaatttttgtatttttagtagagacaaggcttcaccacattggccaggctggtctcgaacttctgacctcaagtgatctgcctgcctcctaaagtgctgggattacaggcgtgagccaccgcacccagcccatagtattgtgttctaagtagcttactatcagtatttctcctttcaaacttgaaggtacctctataatgtaaatcacacagatgctgagaactgagaacccacatgccaaccaaccaactacaacacttgctttaaaatactctcattttgggttgggcatagcagctcatgcctgtaatcccaaaacttagggaggcctaggcaggtggatcactttgaggccaggtgttgaagaccagtctggccaacatggtgaaacccctgcctccactaaaaacacaagaaattagctgggcatggtggtacacacctgtaatcccagctactcgggaggctgaggcacgagaatcacttgaacccaaaaagctgaggttgcagtgagctgagatcgagtcactgcactccagcctgggtgacagagtgagactccatctcaaaaacaaaaaacaaaaaaactctcattttctatgtgtagccaatggactcctcataatctagagatatttctacatgctccaaactgtaaggcctggcaagatgggttttaatcgaagtttaaaagaatgatgaaaagtcaaagacaataatgtaggattaggttcagtgatgaaaccctggattgtacagtttccaggctgggttgaaagcttgcagtagtgaaatagatagttcaaagcatctcctggggcagattcagggaccaggtctttagtgtctgtttccagaggcccttacgcctggaacaatgaccacttgatgtaattcattgctttgcacttccaaagaagtgaggccaagcccacagtttcttagagccctttcctcctttgatttcttagtttctctttcagagcctttccatgaccctagtaaataactgagcagtagatctctgttagcctccctgtacctcccattaaatggcaatagtgcagtccacccacaggtcaacagggcaacctgcatctccagatgttcatgacaggagaggaggtggcatgttgccaccatttaggaactactgtattgtttgggggagctggtctgcaggagtctgcttttaaaaataaataaggattatagtaatcattgcttcagcaagaatcatccacagatgccaaatccattgggtgaaaattagttgctgaacaagatattctcaaattatctacctgcagattataggttaatcatgcagtgaaaaaaggcacctttgctgtgaagaaatctggtggcctttcccttatccaagtgatcaaagttatcaatagaagcacagacagacatcatgtgcctcccagtgtcctgcactagggaggccacagcatcacctctgtcctgttcttgcccccaccgacccctgaaatggattacctgaatctaaattttgaggaataatcagacaaacccaagttaaggggcatgctacaaaacaacggccagcacatttcaaaaatgtcagtgacagaaaagaaagacctaaggaagagccatgccaacgaaaggccatattggatcctgaatccagaagggtgcaaggttgctataaaggacatttttggaaaatctgacaattcgaatatgcaccatatattcgacaatagaattctatcaaagttttgtttcctaaaattgaaaatcaagactggtcacggtggctcacacctgcaatcccagtgctttgggaggccgagatgggtggatcatctgaggtcaggagatcgagactatcctggctaacatggtgaaacctcgtctctactaaaaatacaaaaaattagccgggcgtggtggcgggtgcctgtagacccagctattcaggaggctggggcaggagaatggcatgaacctgggaggtggagcttgcagtgagctgagatcacgccactgtactccagcctgggcgacagaacgagactctgtcccaaaaaaaaaaaaaaagaaaagaaaaaaaaagaaaatcaaattggggttatataacagaatgcctttgttcttaggagataacacattgacatatttataagtaaaggaacatgacttctgcaatttatttgcagatggttcagcagaacaagaaattatgtaggcgtgtgtcaatatagacagagcagatgtggcaaagtattaacaatgagtaaactcaggtgaagagttcatggatggtcatcatactattatagtaacttgtctgttgtattgttggttttcttggttttctttttttttttttttttttaaagacggagtttcggccgggcgcggtggctcacgcctgtaatcccagcactttgggaggccgagacgtgcggatcatgaggtcaggagatcgagaccatcctggctaaaacggtgtaaaccgcgtctcaactaacaatacaaaaaaattagccgggcgtgatggcgggcgcctctagtcccagctactccggaggctgaggcagaagaatggtgtgaacccaggaggtggagcttgcagcgagccgacatcgcgccactgcactccagcttgggctacagagcaagactccgtctcaaaaaaaaaaaaaaaaaaaaagaaagaaagggtttcacttttgttgcccaggctggagtgcagtggtgcaatctcggctcactgcaacctccatctcccaggttcaaacgattctcctgcctcaccctccccagtagctgggattacaggcgtgtgccaccacacccagctaatttttgtatttttagtagagacagggtttcaccatgttgaccaggctggtctcaaacccctgacctcaggtgatctgcccacctcagcctcccaaagtgttgggattacaggcatgagccaccgcgaccggcctattgttggttttcaaaataaaaacgttggaagtaaccatataactgaagaagcgcttaagccgttttcagctacatgttgtttgctggtcctattctaaaagccagagcttgtccccgttcagatatcggatttggagagacactgccaactggctggagattaatccggacactggtgccatttccactcgggctgagctggacagggaggattttgagcacgtgaagaacagcacgtacacagccctaatcatagctacagacaatggtaagggggcctcatctgagcctttgctgcctcgacctcctagctagttcagttccttgcccctcccttcttttggagggaagagttcattctttttcttttatcctttttgtttgctggattgatttgtataaatgtatggagtacaagggtaattttgttacatgcatagatgtgtagtggtaaagtcagggcttttagggtatccgtcacccaaataacatgcattgtacccattaagtaattgttcatcatctaccccctcccaccccttggacccttcccagctgccattgtctatcattccacaatctacatccatgtgtacacattatcgaactccgacttctaagtgagaacatgcagtatttctccttatatgtctgattcgtttcacttgagacaatggcctccagtttcatccatgttgctgcaaaagatttctcttttattcttaaacaaaggcattcttattatcaaaaattcaagtgggctgggcacggtgactcacacctgtaatcccagcacttagagaggctgaggtgggaggatcacttgagcccaggagttcaagaccagcctgggtaacatggcaaaaccctgtctctacaaaaagtacataaattagctgagtgtgttggtgagcacctgtaggcccagctactcagaaggctgaagtggtaggattgcttgagtctgaaaggtggaggctgcagtgagccaagattgcgccactgctctccatcctgggcaacagagcaagactctgtctccaaaaaaaaaattgttttttcaagtaattttggtcaaacagaacttacttttcactactcactctttattccttccctaagggaaccaggtaatgatggtttacaatccatttccaaagcttaatacttgtgtgaccttggatttgctgtttaattttttttttttttttgagacagagtcttgctctgtcacccaggctggagtgcagtggtgcaatcttggctcactgcagcttccgcctcccaggttcaagcaattgtcctacctcagcctcccaagtagctgggattacaggtgtgcaccaccacgcccagctaattttttgtatttttagtagaaacggggtttcaccatattggccaagctggtcttgaactcctgaccttgtgatctgcccaccttggcctcccagagtgctgggattacaggtgtgagccaccgtgcctggcctgctgtttaatttttatgtccctcaattcctttacctgaaaaatgttaatacccatgtgggtgaaattagttaggtgttaaatcagttaggtgtgggtccttccagactgcttctgtgtatttaaatacatttataggctgggtgctagggtcacacctgtaatcccaacactttgggggtctgaggtgggagatggcttgaggccaggagttcaagactagcctgggcaacatactgcccataatctcaaaatgctgggattacaggcatgagttatcatgcttggcctccttgagttaattttaaatgacgtgtgctcattgttaaaaaataaaatttacatgagaaaaaagttttaaaaatttacagtcatgccatctagacatatctatttataggtttgagatggattcttctgttgttttgtatccgtatcgtatactaatattgatgatagttccctgggtaccaatttttcctactaccatatgctccgtgttgtgtcaagatataaaagaaatgcaaacagaagtgtggatgggctgggcgcagtggctcacgcctataatcccaacactttcagaggctaagatgcgaggatcacttgagctcaagagttcaagaccagcctgagcaacatgataagaccccctctctacaaaaaaaatttaaaaactagccaagcatggtggcatgcgcctgtagtctcagctactagggaggcagaggtgggagattaagcccaggaggtagaggctgcagtgaactgtgttcatgccactgcattcccgcctgggtgacagagtgagactctgcctcaaaaaaaaaaaaaaaagcgtatgtgaactccccaatctattttgaaaaccaatttgcagagacttcaaaagacccaactcatcccctttgattttaagcttctagtcaggcttaaaattaaaataaataaaaagactcaatgctttgttaatgacctcaaatggcaggaaagtgcagaaaaaggagaactagggaaacaacaggcaggcaataggacttcttggagtagttaaaattcagtgaatgaataacgatatgtgaagaaggaggagtgtgttcttggtgtgaggaataacttgaataattgttatcaaggtgggaataagttgtctgtgtaaaacggccagagacctgcccacctgggagtggaggtcctttgggattggtgggacaggaggttctgcgggtggagtggggcctggtgagggaccactgaagagccaggacaagatctagacttggtctggtggaaggcaatggggattcattactgttgccaagctgccacattttctgtgtattttctcttaggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaagtgggtacctgagttttattttggcaactttgctccaactgccatgcttcccttcccccagatccccacctttcaatttcccttctcaacttctagatgtcaccccttccattgatacttgcttccttgtcccttctgtctttgaggccttgctccaaaggtctttttcctttcctggtatctaactttgtagcatgctacccagtaatctaaaacccaagcagggctccctctcccagcctctagccaccctccactcccctctccacttgcaaccaggaccatcttctctgctacctcctgctcctgggaccaaacaacaccatttttgtggttagctccttcttgccaaccaatcgtgagctcccagattcatcagaactattctaccgaggtggaggcagctgtcaactgcctggtcaatttgcatatatgggcttcctacacctacttctctctgggcttctatttccaccatgacgatgtggatctggaaggtgtgcaccacttcttccacaaattggccaaggagaagcacaagggcgctgagtgtcccttgaaaatgcaaaaccagtgtggcggccgcactgtcttcccggacatccagaagccatgtaaagatgaatggggtaaaaccctgggtgcgatggaagtcactctggccctggagaagaacctgaactggacccttttggatcttcatgccttgggttccacctgcacagacccccatatctgtgacttcctggagagccacttcctagatgaaaaagtaaaactcatcaagaagataggtgaccacctgaccaaccttcacaggccagccggcctccaggccgggctgggcaaaaaggttcaccctcaggcacacgggagcctaccgaacccagcgacatctgaagagccccgctctgcctaagcctctccctccagccactaggcagcttttttaaaccaactctagagccctctcccaagccttagaccaaatggaaataaagctttttacagcaaaaaaaaaaaaaaaaaagtacatacctaaataaaacccaagcagctctgctctcttcactcggcttgcgggtgtctttagttcactagcaattttattctggaatgagctttttattttcctcccctggtctcatcatttctttttattgctttctccagcccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaagtaagtccagctggcaagtgactcagcctttgacttaaaaaaatggaggaggtttatttcctggaaatgatttttgttcttatattaataaggatataggttagctgatgtgggaaagagactcccaagttatgccagcctccataaaatagaagtttgtctcttactgaacatttcagaggtaaatggtctaagatgggaaggccatgaagtcaacaggggacccaggtttcttctaccttgtctcttttcattcttcaagacagtgcatcccaagcttgagagcatacaaatcatctgggcctctttttgaactgggaaatctgatccaggaggtctggcatagggccacagattctgcatttcttttttttttttttttttttttgagatggagtttcgctcttgttgccgaggctggagtgcaatggtgtgatctcagctcactgcaccctctgcttaacaggttcaagcgattctcccgcctcagcctcctgagtagctgggactatgggcatgtgccaccacgcccagctaattttgtattttcagtagagacggtgtttctccattttggttaggctggtctcagactcccgacctcaggtgatccacccgcctcagcctcccaaagtgctgggattacaggcttgagccaccgcacccggccagattctacatttctaaccagctcccaggcggtactgatgttgcagttccttagaccataggcagagtagcaagaccttgggggctgccctcatcagcgtggtctaagctagccagctcaccaccaccacctctacattccatcctagattggggaaggggataacagaggaagtggaggccaaacgactggaagttgcatatatcacctccacttatataccattggcccaaacacagccacatctagctgcaagggaacctggaagcttctacttacaattgaaaattgacatggagtaggggtggagtgtagggtgagcagtgagtgtcaatgactaaaaggataaaggagaaaaaggatgctgaggaaaattggcagtttctgccatagtccttaaacctgtttccattggagcccacctggagtgagccctaggggtgacacaggagctgttatggtcaaggtaaatacttttatcatttacacacagggagaaagtactgaatctattaaaggaataaattagcgatgaaaacagactatgtgcatcaaaagacaaagtatccatatggaggagtgcactacatcagaactctggtagggctttaaacatgtgaatgatggaagagcaagcaaatgattatcacagcaaatgagagcaagtcaattagaaacctttgacctggtatggtggctcactctttgggagaccagggtgggaggattgcttgaagccaggagtttgacaccagcctgggcaacaaagcaagactgtctctacaaaataaaaataaaaaatacatttttttattaaaaaaaattttttaaaagaaatgtttaaagatcatatataattagtgactgcaaggggtggtccagctcatgaatgcctttgtagtcagggtagtcagaaaaggctgttaattgagtctcaaggacagttttgtggaagatgtaagtggttaggccacaggggctggtagaattccaacaggcagatgggtatttaggaaggttcccctcctagcaaagcacagcagaggcttgaggagactcctagaagagcagagaccaggccaagctggtgggaatggaaaaagaattttggagggagcagtgggaccaaatctagggttttcaatttagattgagcatgggtgccattgatcctgctgctgctgcctcagtggactccaggagagggtgcctttcaaccttccagaaatgtctgctgggcatcccatttgcttctgccccctcctggtgtcctcccaaagttgaagaaaaggatagtgctgttgagaattgagcaagccttctggactttcatcctgccaggctttacatggctttattgtgccatgagattaggttaattcatcattgccttgggcagggtaacacaagccctgcctgcccacttcctagtcaaattacatttcagtggcctggtctgcttttggtatagtggttactgaccagtacattcattctaaagggaatctttttttttttttttttttttttttaggcaagttctcattctgtgggcccggctggagtgcagtggagtgatctcagatctcaggtcactgcagccttgacttccggggctcaggcaatcctcccacctcagacccctgggtggctgggaccacaggcatgagccaccacacccagctaattttttaatatttttttgtagaaacagtgtttccttatgttgcccaggctggtctcaaactcctggtctcaaccagtcctcccaccttggccttccaaagtgttgggattataggcatgagccactgtgcccagccagggaatcttaaagattgtagttatacttgaaatattttttttttaaataggattacctaaatttgctatgggtatgtatttttttagacactgggggtggggattcccatgtagagcaacatttaaaacagaggcaatgccagagttcagatgttcaatttcaatttcttgtatttttaacttctatgattattttttctttctttattagagatgggttctcactatgttactcacattggtctcaaactcttgagctcaagtgatcctcccaccttggcctcccaaagtgctgggattacaggtgtgagccactcctccggccaatttcttgtttcttaagggcacaaatgtgctagaggctgggcacggtggctcacatctataatctcaacactttgggaggctgaggtggcaggattgcttgaacctaggtttcaagatcagcctaggcaacatagcaagatcccatctctattaaaaaaaattactagagagacaccaggagatctgaagcttttcatgttttccgccaatgtttgattgcttactctgtgccaggctttttctcagagcctgcggatactgggcttctggcacagctgataagaggggtcattttggaaacggtaaactgcctcttgctttgcatggatggggactgtgtagctcctatagtcttgttcagtgctgtctccctgtgcagccaattcagtgttcttgttgatgaatcatggacaagggagttatgctgtttatctggataaggtttctggcatttttctggttttagaaataggtagttgaggtacatctgagaaatcttttccccaagtttatgcaacctcctgtttaaagattatgcttcggccgggcgtggtggctcacgcctgtaatctcagcactttgggaggcccaggtgggtggatcacttgaggtcaggagtttgagaccagcctgggcaacatagtgaaaccctgtctctactaaaaatacaaaaattagctgggcatggtggcaggtgcttgtagtcctacctacttgggaggctgaggcaggagaatcacttgaacccaggatgtggtggtttcagtgagctgagattgcgccactacactccagcctgggcaacagagtgagactctgtctcaaaataataataaataaataaataaataaagattatgcttcatagggtacagtatataggtacttgggcacccatggatagaaaacacatggaatctttttttttttcattcacagtgaataatatatgtattttctaagttaagtggtttctttctggctgctttagagattttttttttaaagttaaatgttaattgtgtatatcctagaaataatcccaagatcaaatgtaacccttgtgttaagccttggaagttaaatagattttaaagcttgcttacatgattctatcttaagagaaaataagaacataccaggcaattttatagtctctgtcccactccccatagctggttatgtatcaatcacatttgggctaacctaggagccctgctcacaaaccttcaatggctccaactcagaatcaaagccaaagtcctcacagtggcccatatgtccctcccgccctgcttgcccctctgagctcttctccatgtctcttcccctcatgcaccctgctacagccatgctggcctcctcaccttccctccatcacaccaaacatgctcctcctgcctcaggacctctgtccttactgtttcctctgcctggaacactttcccccagatttgggaaaatgacagtgattgagtttaaaacccatctgaaagttaaggaccatgcttgagttcacatatcactgtctactatgttgtactgtacataccgacttcagggatgtgagtgtcacgtggattgacatcttcaagtgtattgaaggcagctagtggctgtctaactgccccctgtctggtatgaggggtgctctgtgatagctgctgcttctggccttctttatctttggctctcaacacttgctctgtctcccccaccatcccagttctgattctgctgctcttgctgtttcttcggaggagagcggtggtcaaagagcccttactgcccccagaggatgacacccgggacaacgtttattactatgatgaagaaggaggcggagaagaggaccaggtgggttttgaaaaccttggtagctcagtggtgatctctttattcggaagaagcaatgattagtaagaggtaggcatttgaaacagctctgaatcactttggatattatctttttaaggccttacccaagaaagtagacattgtcattgaccatcatcatcatcacatcatcaccaacacagctaacatttattgatcgcatactgttctgcacctcagtgagcgagctgaggcacagagaagctcagtaacttggctaaggtcacacagctaggaagcgacagggctaaatggtctgtctcagagcctgccttcctcattgccattctctggacgtgaacttcagccagattctctttgacatagaacaactggtctgctttgtttcttttgagtttttagctagaccaaactccttttctgtcatggttataccttcagtccctctgtatttcctgattttggagatgatcttaacatcttaccctggagttgtccagggaactgttcagtgtcttggagagcctacttattatagaaagggatccatgggggtctattacagagtcctgtttttgactgaggccacagagtgaggcacaatttactgagctccatacaacatagggaggtgggtgtacagagaaaaatattgttctagatttcagggacttgtaagtctagtttggggataccacgtatattgtatcagtgagcaatagagcaaccaatcgtggaatctcagcggcacacaacatgcgtatctttctcatgtaccgtggggtagctggagcaactgctggtctcatctaagctcatgagaatctgtaggatggctggggctcagcagatttaggcagagtttagctgaatggctctaacctgtgaattgtgtccaggtctgttccatgcaagtctcatctttgtaccagaagctggtgcctttcagacctttgcctgtgtcatatgttactgtcccattggctaagcaagtcacacaacaaagccccagatcgatggatgtatacttttctcacaagctggggttgggagggagtgaatatttgccaaacagtgatctaatcatcatgtcctatgaaaattagtaaggcacacagcctatatctggatccacacatgctactcacaatcctttgggccatgtttttttccagtgctatttgggagacttttagcttgaaaactgtcattttgcattaaactggtaaagatcatacagttggcagtgaaggcatcatccaaccataatctataaactgaacatagccctgtgtgtatgactatttctttcctactcttcattgtacttcaaccttttttctccaaaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaagtaagtaatccacgtggaaagccaaagcatggctcatctctaagctcaggaggagttgtgtcaaaaatgagaaaaagagtctttagattctttcctttactatgttttcagcttgcctgagccctggagccctgttttcctttttctttttttttctttttctttttttttttttttgagacgaagtttcactcttgttgcccaggctggagtgcaatggcgcaatctttgctcaccacaacctctgcccgggttcaagcgattctcctgcctcagcctcccaagtagctgggattacaggcatgcaccaccacactcagctaattttgtatttttaatagaggcagggtttctccatgttggtcaggctggtctctaactcctgactcaggtgatccacctgccttggcctcccaaagtgctgggattacaggtgtgagccaccgcacctggcagcctgtttttcttaatctgtgtctcatctgaattttggatctaatcgtgcttcaaattgcaaagtccatgtggcaaaaccaacaattgcctgaaaggatttagtagatctagaaatgaaactaggaagattctaagtaaatttcattttagtttcactaatggaatttacttcccttgcctcccactgctggttgggatataatgataaatgtacatgacaagcctacctgaggattagaaaaatagaatctgtattgtatatgtcagaaatgcattcagctctaaatacaagatgctgaaacagatgggagtagatttatcttatacaaatagaaagttggggtgagcagtctaggccagtgcatcaggctgttccatgtttctgctccatcatcttagcacgtagacccttcttctcaggcttgttgtctcatgatcacaagatggctgccacacttccagatcttaagtctgtattccagtcaggaaaaagtatgaagaacaaagcagagggcaaaagtctttcttctagcaaactgtcttcttattcaacaagggagttgtccaaccagttattggccagaactatcagaaggttgtgcctgtctgcaagggagaataacaaggcattaaattaattagcttaggataagatgagaaagaacccagtaaagaaatggtccagcaggatctgtttccttaagttatgttctctagtaacttgcttggttactggaatgattttctgggcttgtctgatggtccagtggccctcggtgagtcttcatggtgaggtctgtgtttgctttagctttctttttttttttttttttttttttttttgagacagagtcttgctctgtcgcccaggctggagtgcagtggtgcaatctcagctcactgcaagctctacctcccaggttcacaccattctcctggctcagcctcccgagtagctgtgcctacaggcacctgccatcaagcctggcttttttttttttttttaattttatttttagtagagacagggtttcaccatgttaaccagatggtctcgatctcctgacctcaggtgatctgcctgccttggcctcccaaagtgttgggattacaggcgtgagccaccacgcccggactgctttagctttctatgggagctgtcactgaggactgtgaggcactgcagtgttagaagtgatcaagccacattcattttagccactggaaaaaacaagaaacagaaagaaaccagtttaaccatgccttttatttatttatttatttttatttttattttcattttttgagacagtttcactcttgtcgcccaggctggagtgcagtggcgtaatcttggctcactgcaacctctgcctcctagattcaagcgattctcctgcctcagcctcccaagtagctgggattacaggcaccactaccacgcccagctactttttctatttttagtacagatggggtttcatcatattggctagtctggtctcaaactcctgacctcgggtgatctccctgcctcggcctcccaaagtactgggattatgggtgtgagccaccgctcctgactacagaccccttttagatacatctggattcaggcctttcctccattcatactcatttgcaagtcatcacttgtatttgcagtttttatttaaactataaaaatagtatgctaaaaaagaacaagatcatgtcttttgaggaagcaagatcatgggtggagctggaggccattatccttagcaaactaatgcaggaacagaaaaccaaataccacgtgttctcactcatatgtgggagctgaatgatgagaactcatggacacaaagaagagaacaacagacactggggttcgcttaagggaggagagagagaggagcagaaaagataactactgggtactgggctaaatacctgggtgatgaaataatctgtacaacaaatccccatgacatgagtttacgatttgttacctatataacaaaccttcacatgtactcccaaacctaaaagtttttttttttttaagtatgcttgctattttaaaaatataaattatggtgtgggggtacacacctgtaatcccagctactcaggaggctgaggccagagaatcgcttgaacccaggaggtggaggatgcagtgagccgagatcatgccattgcactctagccttggtgacagagcaagactctgagactccatctcaaaataaataaatatactttatttatttcataaaatgaaaatatataaagaaaaggccgggtgcagtggctcacgcctgtaatcccagcactttgggaggccgaggcaggtggatcacctgagatcaggagttagagaccagcctggccaacatggtgaaaccccgtttttactaaaaatacaaaaattagccgggcatggtggcgcatgcctgtagacccagctacttgggaggctgaggcaggagaatcgcttgaacctgggaggcagatgttgcagtgagccaaaatcacaccattgcactccagcctgtgtgacaagagtgaaaccctgtctctaaaaaaaaagaaaaagaaaaaaaatacaagtccttccttagttcccacacccccactccccagatttaactgttaagcatttggcatttatccttccaggcctttctgggtggaaatgcagcctgcatgcaccagtatgcaaagcttccagctctgcccatcccagctggtggtgtggcagccccactctgatctatggggactccatcctgactggttggtgcttgcatctctcctgcctacatataactcaccatttcactttctctttccatcaacaacatatcctgtgcttctgcatccttccatgacagtgtgtataaatgtacgttgttggtgttcactgctccgtggtgtgccacaagtctgggtgcattgtcgtaccttacatattgctagacttcttgccccagatgacaggtgtgcccttcctttcactaaaagatgcttttgtcccttcttctttagaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccat

SEQ ID NO: 35786 - DNA, 10919 bp, Homo sapiens
gcggagcgagccctgaaaggctataggcgagggggcggctccgcggggccgggcgaggagtccagagagccatggccgccctgcgtgtcctgctgtcctgcgtccgcggcccgctgaggcccccggttcgctgtcccgcctggcgtcccttcgcctcgggtgagtgcgcggtgagagctggcggcccgaatctcctcctgactccgacctgcacgcccagaccagatcccagaccgcacccccctcccacctgaccccgcatcccccacctgaccccaacccacacccctcttccgcctgaccccgcaccctcacctgacccctacccgcaccccactccgcctgaccccgcacccccccgcctgaccccgcacccccccacctgaccccgcaccctccggcctgacccctacccgcaccccactccgcctgaccccgcacccccccacctgaccccgcaccccccggcctgaccccgcacccctcttccgtccgatcccgcatccccagggcctgactccgcactctcctgcctgaccccgcacctaccacctgaccccgacccgcagcccctgcctggctcaggcctgcaacacccccctcgcctagtgctgcaccccccacctgacccgcacccacagcctgacccaggcttaacacccccccaccacccgccaccccgcaccgacaccacccacctgaccctggcccgcacccccaccccctgcctggctctgcaggaggccactctcaccaggccacgtcctgcgggaggcccggcggctggctggtactgccccagtgccaagacctctggccaactgggcgcagggtgggggttgtaaaaatccggggtgttccctcggctctaagagcaggcgtagctcctgtgcagccggccagcccgagaacaggagatgcaggtgcattttgtcctgggtgcctcctgaccagggccacccctcagagggtcctaagggaaaagctgacacctcctccccagccacagggggctgccctcttcctccctcgtggctcacccggggccccactcatgagcggccatcaccggctctagtatctgaggaatcttgggccatgccttgggctggggaagaactcttgcttcctcttcctccctcaccctgtgtagcagtggaccactgagttgtgttggtttcatctccatgctctccttggccttcggcttctccaccctgacagcagccctttcctggatcttgcatggcgggcactgctgccagacacttcacctgtgatcttccagttacccctagaaacccacaggatacggcggggcacagtggctaatgcctataatcccagcactttgggaggctgaggcaggtggatcacctgaggtcatcaagaccaccttggccaacatggtgaaaccccatgtctactaaaaatacaaaaattagccaggtgtggtggtgtgtgaccgtagtcccagctactcgggaggctgaggcaggagaatcacctgaaccctgtaggcagaggtcgcagtgagccaagattgcgccactgcactccagcctgggcaatagagtgagactcggtctccaaaaaaaagaaacccatagcacagggactatgatccctgctctgccactaacggaggcaagcatccaacacacaggctacctttgtcttttcaggttcaccttctcacccctggaacgccattgtcctttgtctccttcccaccttgctgtccacccagcaggcgcaggtcctgtgcagcaggccaaccgagaagcgcctgcgtctcccattttcgggctggcctgctgctccggacctgtgcctgatcttaatgctgcaggaacacccaggattttcacatcccccaccctgcgtccagttggccagaggtcttggcactggggcggtaccaagtgcaaggagctgccttacaccccctcacctgttggcatttgttgaaagaaggtgtttcctggtgccttgtctcagcagagtccagggctgtctccagagtggtgtcctgggaagagctgaccaaggcatattaggagaaggaaagcggctgtgggctgtgttctgtgctggggatttttctttttttcttttctttttttttgagacggagtctcactctgtcacccaggctggagtgcagtggcatgatctcagctcactgcaagctccacctcctgggttcatgccactctcctgcctcagcctccccagtagctgggactacaggcgcccgccacaacacccgactaattttttgtattttaggtagagacggcgtttcaccgtgttagccaggatggtctcgatctcctgaccttgtgattcgaccgcttcggcctcccaaattgctgggattacaggcgtgagccaccgcgcccggcccggggattttctttaggacatgttcaaacacatgtgaaagcagagagaatggtaccaaggctaccatctatccttgtggctgagagctacacctggagccactgaggactcggcagggagccctcagagggcctcttggggtcacactgtatccaccgatggggccacatcccttcccccactctccccagtttgatacctgtgtgaatagatacccctttttgccttcttgctccaggtgctaactttgagtacatcatcgcagaaaaaagagggaagaataacaccgtggggttgatccaactgaaccgccccaaggccctcaatgcactttgcgatggcctgattgacgagctcaaccaggccctgaagaccttcgaggaggacccggccgtgggggccattgtcctcaccggcggggataaggcctttgcaggtacgcgcggcagcagaggcctttgtgtctgggcagatgtgggaggcacgtatggccttgggagaagcctccagacagatttgcgcctctgtgatggcagaggcatgcgactggggacttcctcaaatatcgagtgaagacggtcatgggaacggcttgcatgagcagctttgtgtatgccagagagctgcatgtgctccaccagcaaaacagcttcttcaaaggggtttaggtccttggcagtcaggctttgtgtgtgtcaagggcttatgccctgacaaatatgcctagcctctgtgggcgcctcccttgcacctgctgcctgcctcagggcccctctgcgtgacttctgttctagctggcattacagcgtccctacagctgtccacgtggcctggtgtcagccgtgcccagcaaccccactgcctgtgtctggtgtgctctgaagttccttgttggtctgagagatataggatgggtgggctctctgctctctggtaactggaacctcctttccactcctgctagctggagctgatatcaaggaaatgcagaacctgagtttccaggactgttactccagcaagttcttgaagcactgggaccacctcacccaggtcaagaagccagtcatcgctgctgtcaatggctatgccgtgagtgttgctgccaagagtctcctcctctcgtggttgaaggaaccgtgctgtgcatacacagcataacagatttttattttgaagaggcctttagttcccaggccagcagcctcctttcctgcctcatggtgctaaagagccaggaactgtgtggagaggacacctcctggcatctgcttttttcgtggctgttcacctgacagcttctccccagcaagcctctcttccagggtgggggaagagaggtgttggctttggctacatctataaactagcttcttttgctccccttgaaagctctgtgtcctgggactatttgaagtgctgagactgatcttggcctatagggaaggcaatgtgatcatttcatgacgctccctgccgtgtaagccaggggtctgcggattgtgatcatttcatgacgctccctgccgtgtaagccaggggtctgcggattgtgatcatttcatgacgctccctgccgtgtaaaccaggggtctgcggattgtgatcatttcatgacactccctgccgtgtaagccaggggtctgcggatggagttttcccggcacagccacacccacctgtgcacctagtctctgtggctgcatttcggccacagcagcagagttgagtcgtggcagcagagcctgtaagaccctcatggtcctttacaggatgtttgccagcccctggtaaacagcatcaaccatctgtagttaacttatcataacaattatctagtttggtgccaccatgttagtctttgtcatacccccaacactgtttcttttaaatggaaaatttgaataagcaagcagagtgatttctgactgggttcccctggtaagactctcctgatgccgaatgttttacagtttggcgggggctgtgagcttgccatgatgtgtgatatcatctatgccggtgagaaggcccagtttgcacagccggagatcttaataggaaccatcccaggtaaagagtgacactgtctctggcatagatgccttaggtaattactcaaaatctgcctgtgtctcagggcccacagctcatatctgaccagaggccctggatggacagccccatggctggtcagtggtccctctgtggacagccacggaggctagagtggttgtgacagagcttggggggggccttagagtcccgggactgtgactgtgcccacatctgatggtgttgggagaggctggtcctgggtaacgctggcttctaaccatgacagttcttgcttgtgattcgtgtccatggcagagagggaacatggtgaccctgggtggcactgggagctctgcacactgccatctcactggccatggaggtcacatggcctgggttcagggtggggagtcagaccccccacccaggcccgtgagaagggcctgggctcttggcaaaaagcaacaccctctaaccccagggttctcctggtaggaagggtgggcccaggccgagcagccaggagggagctgagaccctgaggggagcagctgcactcagggtgcccttcgctgccctctgagttggacgaggccgattctgaggcctggagctgtgagctcggtgcatttgtttcgggtctgatccctagaacagctgctactataagggaccagtgcctggggtcagggaggcctataagcttctaatatgttgaccacagaggctggggagggccctacagagtcatcaccttgatctaatgtcagggtgttgggggagtgtagtgtccagccctacggggcttagcaggtgttctccccatgtgcggagacgagagattgtaagaaataaagacacaagacaaagagataaagagaaaacagctgggcctgggggaccaataccatcaagaggcggagaccggtagtggccccgaatggctgggcgcactgatatttattgcatacaggacgagggggcagggtgaggacggtgaatcctctaagtgattgacaaggtgaagcaagtcacgtgatcatgggacagggggcccttccctcttaggtagccgaagcagagagggaaggcagcatatgtcagcattttcttctatgcacttacaagaaagatcaaagactttaagactttcactctttcttcttccactatctgctacgaacttcaaagaggaaccaggagtacgggaggagcatgaaagtggacaaggagtgtgatcgttgaagcaccacagggagggggttaggcctccggatgactgcgggcaggcctggagaatatccagcctctcacaagaagctggtggagcagtgttccctgactcctccaaggaaaggagactccctttcatggtctgctaagtaatggttgccttcccagacactggcgttactgcttgaccaaggagccctcaagcggcccttatgcaggtgtgacagaaggctcacctcttgccttctaggtctcttctcacaatgtgccttcagcacctgaccctatacccgccagttatttcttggttatattagtaatacaacaaagagtaatattaagagctaatgattaataatgtttatactaatgattgataatgtccatgatcatctctatatctaatttgtattataactattgttattctaactattttctttattataccgaaacagtttgtgccttcagtctcttgcctcggcacctaggtaatcctttgcccacaggggagcaccagatgtggggcctgagcttgaaaaggggctgctgcccctgatgttcccgggctcttgtgctgcctggcctctgacccctggacctagtctcagggcctatcttaagccccttggaatttgctggctgcacagctgtgatgtcttcttgggttcactcatcacagtgccagccatgaccagcccctccctgcaggtgcgggcggcacccagagactcacccgtgctgttgggaagtcgctggcgatggagatggtcctcactggtgaccggatctcagcccaggacgccaagcaagcaggtatgggttggggctgcccgcaagagccacctggaaacccggggtgggagccccacagaaacccagggcggcatccaggtgtccccctcgggggagccccacagaaacccggggcagcatccaggtgtccccctcatgggtgccccacagaaaccctgagctgcatccagttgtctccctcgtgggagccccacagaaacccagagctgcatccaggtgtcccccatgggggagccccacagaaacccagggcggcatccaggtgtccccctcgtgggagccccacagaaaccccgggcagcatccaagtgcccccacggtggttgcatgagcttttgggtcctgaggacctgggagaagactgactgccttttgtttctacattttgaagtactgtatgtacggaagtgaaccacacgtaagtatctggtacagaataacagcccagcaattgcgtccccaaaatgcagtgtaagcaatgggcatctccaggcctcagtggccggtcctcccactgccctgttggtgatcacagtccccgtgtctggccgcctctgccgtcggagctgtggccagcctggcccacatgtctgagagcacagtgaccgcagtgccgagatcactcagcactcaggaaggggcacgtgcggcacttcccgtgtggaagccgcccttgcttagcgtccagaggctggggtgctccagccacgctgctccccagcggccactcactcgagaagggatagacaagtgctgtttctgcacatcactcactgactttcttgtgtttcaggtcttgtcagcaagatttgtcctgttgagacactggtggaagaagccatccagtgtgcagaaaaaattgccagcaattctaaaattgtagtagcgatggccaaagaatcagtgaatgcaggtaggggatctgccaggaagacactggagaggtctccgtggctgtcaggagcattcctcagcagcaggctttctggctccaaatgaatatgccttaagccctcctgggcagaaatgcttctcagtgtctcagttctgctgtctgtagagtcgtggtttctggtcacgcactcaggaactccgctgagatgttcccagctcccctttgtaccagggcccaagaactgagccaggcctgggaggtgagggcagtacagagctggcagtggcagggaaaggctgagaagggagcagaggtcccaaatgtaaaatggtctctgccatggggaggctcggttcacctcccgagacctggggttggcggctgcgtgtgcgcctggcaggtggctacgcaggcttgcagcccagcaccacgctgttcgttcttggcctggatcccttttagttctccctctgccagggaagtggatctgaacctccccctcctcagaaatgctcaagttttaatgtcacaatttattctcagcatgtggaatgagatggttattagctggttgagtccggacaggtgtgggtggccccaggcaggtcccctaacctctctgagtgcatttatctcgagggtgtggccgtcccccgggcttgccgttggcttgaggcaggatacagtgaggagagcattttgaaagaacggaggctgctgtcgcccgaggtgtttggcaaggtcgtgctcccctgggagaggatgctggcaccagccctggagccacagcgcctgcctccatctgcgcacctggatctgctctgcttggcctcgtgcaaagaacgggcctggaatgagcagagccaaaggcgttcttggtgccggccgcgcccagctctggctctcgtgctgtccttcctggttttcatccttggttatttttctctgtttgcagccccgttgccgcctcacagcctctcctcaagggcacagtttgccatctcacctttcatccagttcctctcccttcttggggccgtgggctaccggagtgtgacgtttgggggccatagcagagctgttggttctgccaggtctccgctggggcagtgcctttgagaagggcggcaccatggaagcctgtgcagggctgggccacgtcgaaagcacagttgtgcatgggtcagtgaggagggcttcctgtcaccgtgcaggaaaagttctgcatgtaatatctccgttcataactctgggactttgtttttcagcttttgaaatgacattaacagaaggaagtaagttggagaagaaactcttttattcaacctttgccactgtgagtaaacagtgttcaaccggagaatcaagcaaattccagtcacacaagttgctgggaatttccttttaaattttatcattaagtatcgtttctttctggtcagaactgccagcctcacctttaacgggatcagattggttccatcagtgggtcttgatgttaggaaaaaagtagagcatgtacaagttcaaaagtacagaaaccttacaggggcttttcttgtttttcctgttatgtgaggtctgtgaattgcaccctcaagcagctcctttattgaaaatgcagtttcagccgggtgggtgtcgagcatccgtagccccagcttcctgggaggctgaggcgggtcgttcgagtccaactgggcagcaaagcaagaccccgtctcaaaaaaaagacttttttaaaaaatgaggccgggcgcggtggctcaccctgtaatcccagcactttgggaggctgaggcgggtggattgcctgagctcaggagtttgaaaccagcctgggcaacatgacgaaacccgtctctactaaaaatccaaaaaattagccgggcgtggtggcaggtgcctgtaatcccagctactctggaagttgaggcaggagaatcgcttgaacccagaggcggagattacagtgagccgagatcacgccactgcactccagcctgggagacagagtgagactctgtctgaaaaaaaaaatgtaactcattttacccatgtttttttagatcattccaattatttggaataggctcaaatgtattctaataagataagctgaagctttagagcaatattttataagatttctgccagtaacttaaagtaattcctctaattaccatcataattttaattttcttccctttgaggcagagtcttgctcggtcgtccaggctggaatgcagtggtgagatctcagctcactgcaacctccacctcctgggttcaagtgattctcctgcttcagcctcccgagtagctgggattacaggtgcccaccaccacacctggctaatttttgtatttttagtagagacagagtttcaccatgttggccaggctggtcttgaactcctgacctcaagtgatctgcctgcctcggcctcccacagtgctgggattataggcgtgagccactgcacccggccagattaccattttaattcatgtctttcactgggagaaagtcatacttcggtgttttaattgttctataaaataaaaattaaaagtggtttgggcacctgaggaaggggtacagatgcgtgtgtgtgtgtgtgtgtgtgtgtgtgtgcgcgcgcgcacacctggggacacacgtgcacacagtgtaagaaaagcagatgcagagttgagttctcacgtcctactccaacacagagtagcccctgatacaggccacccatcatccagttgatgacatggtgagtgaccaagatgggtgcatctgaggctctttagatgtgagcttgttggacatacacagtggctcctgaatgaccgtcacctagactggtagagagaggccgtgaaaatccccgcgcccaggcccagctctgattgggcaggtgttcctgccgctgagtcccctccccggccccctgggcccctgtgagcatgagtgaggcagagccagggagagacgggcggacattggcatcaggctctgtgaggatactgcgcgtccagctctgtttctgttccttttcctgccaggatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgcgggtccttgtgtccctgccgctgaagaatggggctgctctgagggaaacgctgtctgctgccttcatacagatgctgattaaagtgatagcgattcagatt

SEQ ID NO: 35787 - DNA, 3165 bp, Homo sapiens
ctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattgtgagcgttctggggcaggcgcgtgggcaaaagcgggatggggtggctggaccatgcggaactggatggtccgggtgaggcaggcacttggccggggcgctcggcagtggggtgcaggtgggtgggttcacggtggaggcccgaaacccggggcgcagggcgagtcggtggggtttgacgaaggttgttgagatctggtggtccccggggtgaagcaaggagcctataacgcatacggagggctacgtggggacagcctgcgtgaactcatcagtggacgcatcgaaggggtcccagggtgctgggaagtgggggcctcctgtggcagggcgtggcgcggcctgggcacaggagggcgggctggcagcgcgcccaggggcagggcctgttggggtggggcccccccgccccgcgctagtcccgcggtgtagagcgccccgcccttcgccagttcttcctcgcccttcagaggccgggcgggatgtccttagcttttcggggtttccacccttctcaaagtgggcgccgcctttgagtcacttgtaaaaggggtgcggcgcctttaacggagtcctgcctctctggtgtcactctcaccgcttcccaaaggggttgctgggggaaccgcgtgttccgccccggtcaaggccacaaagctggcgtcagcggggctcacaaaacacctggcagcgccactcccctcaggctgcccgtaacctagaagggaaaagaggaaactgaggcacccaactctactccttacttgttgggtgaccctggccaagccattaaacctctctgtgcctcagttttctcgtctataaattagaaagagtaataatagtacccagagcattagattgtcgtgatgattgaatttggaacacagtgagcacataaaaagtgtttagctattattgtatgtcatttccccagccctcgtaggcatcttagtatgggacccccaatttaaaccaatcttctcagccctggttgctgattgaggtcccctttcccatgtcacccttccagatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgtgagaaggggtccacaatggcaagaccagggaggggtctgggcagttaggattgtcggggaactgtggttgctgacttccctcttctcctccctacacctcacaggatttcttccgaaccctcatagcggcaatcctctacctgatcacctccattgttgtccttgttgagagaggaaaccactccaaaatcgtcgcaggggtaaaggccatgggagcagctctgaagcacagagcgaagggtttgaggagccagggaccatttctgcctttgcttctggcagaaatcgtgtgacccacagcaagtcacacttgtcctcagacatggaggaaagtctggcccaggacttggttttgcctcccaaggtcttcatttgctgtgaagggaagtcccttgtcagacacaaggaccttggtgagaggtacaaacaggcggcccctttgtcaacgcactagactaccatctgcaagaactttgtcccaaatgtagtagaaattggggccgggcgcagtggctcatgcctgtattcccagcactttgggaggctgaggccgaggcaggcagatcacttgaggtcaggagttcaagaccagcctggccaacatggcgaaaccccatctccactaaaaatacaaaaatcagccgggcatggtggtgggcgcctatagtcccagctactcaggaggctgaggcaggagaatcacttgaacccagaagacaaaggttgcagtgagccaagatcatgccactcactccagccccagtgacagatgggtgacagagtgatactgtgtctcaaaaaaaaaaaaagtatgacttgaattgtgccccctacgggtagggccacagtgtggcctccctgtgttgagaggtataggaggagggagagtggggtaggatgcactctcttggcctttccctggcttaccaacccggtgcttgagtcccatcctgcgtggggcaggtgctggaggtggtggatacaagaagataagagactgagtaacctgaccagctaatctaaaccccctcactcctatcctgtcccccaggtactgggcctaatcgctacgtgcctctttggctatgatgcctatgtcaccttccccgttcggcagccaagacatacagcagcccccactggtaagtgtgtgtgtgtgtgttggttgggggtaagggggttgctgagagggcagagggaaaaaggaaagggatctcttaaaggcacgaatgccaactctggtctcgtattggtacttagggcttttgtaccaataggtaccataagcttcggtattcttgtgtgtaaaatgttcatggactttggatcttgttttaaaaaatgggcatatagattcagccaatgctttctctcttttcctcacctgcagaccccgcagatggcccggtgtaggcgaacttccctcatttctctctgcaatctgcaaataactcctccattgaaataactcctccccaccccaacaacaacattcccagcagaccaactcccaccccctctttgaggtaaaagtgcctttattgggagacttttgtcttccagcctgccaatcaaccctcctgggtgtggccaccatatgtgtgtgcctaggtcctccttctgcacgatccaataggagacaccagttctgactgaaccatgcccccacctaagtcacaaaatgagggaagtggggagttagatttcagagtccaggccctaggttgggacccactccaaataatctcctcggtgtgggtggtggttctatagagggataaatgaataataaacattgttaaaatat

SEQ ID NO: 35788 - DNA, 25072 bp, Homo sapiens
ggcggccggtgagggggaagcaagtctggtctctgtgattgaagaagtcggctctgggctccagtgcgggaatcacacacatacctcaggtgactaatcccaagctcggtttctccaggaactcactttggtttgtgtccagtgacatgggtgttcgagagcgggtaggccccgggctaatacctccctttcccgtccctgcgcgggaagtggctggacagcaccgccaccacccgcgctgtcgtgggcctcctcgccggctccgtgtaggtcatcctgtgttccagaggcatcgttgttcgagcagaggaatctcgtgaaggaaagtgggccgagtggattgtacagcctctacaatatgccgaaagtgagaatgccatgacgatggggcggtctcaggagaacgctgtgacaccgtaactcttaaccccggctcaggacgctgagcactttgctttttccaggcttgagaattccatcttttcttccgccccaacagctctaccaaaaatttcccctgcgtctcagtggaaaccaaactggcctcttacctgagaaacctgtgggacgggcaccgtgttggaaagagcggggtccgagtagtttttcatctgataattgaatgagtcaccccttgaaccaaaactaaatgagacttgagtttattactgttactatcagtttgtcgtattttggcgacaatgagaatagaactgtgttaagcatatgttaggttaactatgttagttaagcataactaaaacctaagataaggatatattttcgggttaaatacacagtcatgctgaggtctctttatcctcaaaacttaggctttttaaatttttattaagcaaaaaacatggtttcttcgagaaaaagtatagcagagaagtctttatttcccctcaattgagttgttattcaaggaacaatctctgtcaatagtttgggggtgacttgtacagaactttgctacctattcttagttcatctggtgccaaaagatgtagttgtctcatgcacagtaatgtttgtagagattcggtgataactttctttttcaactataatgatgaaataaaagctttacttatgtagcactcctataccaagaactagcattcagagagcattcctaatacgtgttagatccaaattagaattatcacgagagttgtccccatcacataatatattttggaaaggaatgtgaacttctatatccattatagcagtttgaccatgcactgttttgagaaagaagtcctacctaccatttgtcatgcaaaataactgactatgcagggtatttgaaattagcctggagtttggttgatatattttgaaaggtggctgatactttttacatcagaacacataagagtattatagcatgttgtgatattgaggttctgtgggttaaagacattctggatttgatgtcggattacttgagtttagctcctacgctagtacttattaagcatttgttcttaaggaagtattataatttagtatttctgttccacctttcctgttcattgcttcactgtgccctttcatagtactttgtattgtaattatttgcttgctagtttgtttcccactctatacttaattacttaggtaagagtcttttttttttttcttttttcttttttctttttttttttgagacagagtctctgttgcccaggctggagtgtagtggcacgatctcagctcactgtagcctctgcccctgggttcaagggattctcctgcctcagccactatagtagtgggattacaggtgcctgccaccacacccagctaattttggtatttttagtagaaatggggtttcaccatgttgaccaggctggcctcgaactcctggtttcaagtgatccacccgcctcggcctcccaaagtgctgggattacaggtgtgagccactgcgcctggcctggtaagagtctttcttgttgtatcattagtgcttagtacatagtagctactgaaaaaaaaattaacaaattattatattacaaaatggaaataccttctttttctttcaatattttatgtttgactagcacataatggttttcaaaatgtttttacgtatacatgtgataccctcagtaaacctgtgatgtacatggcacagatgagaaactacagttcaaaggatgttatctttcccaagcagccacttctagtaagtagcagagcaaggactggaacacaaggctagagttgttccccgagtttactatgttaattgcctgatttgacacttcttgaggaccaaataaaataagaatgctgtgaaaaagataaagaggtgaagtcacctagtgtgacttcgatattgcggaatgatttttttaagttaaaaaaaaaatttaagttattagcatttcattaggcaatatgttcaaaaattgtcaaccaatatgcaggtttttgtggtatggattctttttgtacttaactactatctatctttactatgaataacataccatcaacagtattcctttacttaccctttatgttgcaaagagacttgtgcctcctgaagaaatagtattcatagtcatatcccttcaggattctcttacatgattgcccatgttttttaaccatcaaattaagccttgcttcccctaaaagcatcacctttactgtttggagaagcttggtaagtaaatgtggttttcactggtcaaatgtcttgcaactgttccatacatttctgtaacatagtttatttttatgcccaatttgaaactttttagctctcaaatttgagagctttacatacacatattcaacaacagtttccccacccccaccctcgaaaagccctgtttaaaaacgaaacaaacagtcagctgtttcttggtgggtaaggccattgaatgtctacttctctttatttgctaaatccctattttgtagggattttgtattccctacaaagaaatacatctctgctactgtcattaatatgctgctctttgttgtcaaacagatgagtactaatagtttgcacttattggtgttatgtactctggcactgaatatatattaatgttgctttttaagtaaaatgtttctaattataatatatttatgaatagttttgagagaatatagtcttactgataagaggacagactctggatccagacttcatggattcaaatcctgactcatcacctgttagcagtatgtgaaagaacaagtaacttaacctgtgcttcagttttttaatctataaaatggggagaactagggagaaagttgtaccacaaggagataggcaatggccagatcatataggattctgtaggtagtggaaagatacataagtcagtgggaagccactgagaagatataggcaggtgccaattaataagttattatatgaattttcacaaggttttcttaggcctttaagttctgttactacctacgttttgagcagtgacaacagtgaaggttaacagaaaaacatgaaaatcatcagccatgattagtttgagagcttccttttttaaatatgcttctacccaggctatgatttcaggcttgtggatcataaaaggagtagtgctgaaagtaggttgggtggatcaaagggaataattgtaaatatctttaatgcttggaggttaagagaaacttgaactttgtagtaatggagattaaagctattctcaagattaggtatacctattcaataaaagaaaggaatatttgggagtattggggataagagaagctagacattgtgaattcaaggaaaaagaattatgagaggaggatgcattttagtttattttgtgattaaaatttttttagtttttgttgttttgacatgtgacactgtaattttggctataataaatgacagaatgtatcatttggtatattggttagggtttaggtagaaaattttttcctttatatagtgagtggtagcgtatacaatgtttgctcacttcggcaaagagtagctttagttttctgattagttataatagtgatgcttcccatcatttgatatgccttaaagtagtattttactcttgaggtattcctttaatccttaggtcttggagtactttatagatggtcattattttttatgattcctctgaaactaaaggcagagaatcacccaagcattacaaaaatgttgagcaaaataaaaattaaagcttggttcctgaacattatctgttttctggtaccacttaagaagtttcaaaggatgagaagactaagactaataactatttttttcttcatcttttctttcagtggcaggatgtggaaattgattttttttttattttcaccttaactgaatacttacttaattcttttgtttaaattgcagaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggtaagtgagaaaaatatctgtaatataaatttcagatttaaaatggtttatttaaaaatacattttttgtaaattgcaagctgcagcttaaaaaaaaaagctccttttatacttaaaccttttacatacaaagttgttagaaaaggatgccaattagctatctaagcaagatctcttaatagtagtttaattagtacatcctaggattttatggatcagataacttgaattttatttctagtgtttatcaggatcttgataattgactcatggtaaccaaacttagagacaggtaagtcagagtactagttcatttacattggtaggcctgaatatgttggatgcctttttcttgatttaaagctaaaatagtaatgagatcactgggtaagcatgaaaatggggcaaatggattttagggatcttttatataagctttgaaaaagcaatatactatgcgtgtatatacacacctgaaatccaacattgtatatcttgctggtaattagaatgtttgcatctaccagatctcgtggtatctttcagacagttttggatgagcattcattttttacttattggatgccttttctgggccccatgtaaatcatcacctttgtgaatactctttttttaaacatggtgtacaataccattacgtaggttttagtttcagccatcttactataatttgttaggtgttagttttaggtcattagttaccatcatgtccgaaaggcttcatatcagtcaccttgattcaacttacccttctgaatctcctcagccgtctggtttactgatactttctcacttctgcaagtgattaattttatacatactgacattttaattttttttattatagccttagatgatacatagattttgaggatgtcttatgccttaggtagtgactgctacttagcacatggattgttttaaatgttttgctatgacttagctatagccccgcccaaaattattaaactactttgagactatttgttaaacttaggtaagtcttcacatcactgtcctagtagtacctaaagtagtgtctaatcttgtactttttttttttttttttaagaattggggtcttgctctgtcacccaggctgcagtgtagtggtatgatcataggtcgctgcagccttgaactcctgtgttcaagtgttcctcaagcagtcctcccaagtagctggaactacaggcatgtgccaccctgcccagctaactttctttgtagagatggggtcttgctgtgttgcccaggctagtcttgaactgggctcaagcgattctcctgccttggcctcacaaagtactgggattacaggtgtgagccactgtgctcagccttctttttctattgtataaaatatacacaaaaggaggaatcaaatatgtttttagttgcaatcagaaaaaatatggaatggcatacttgcttacgtacagtagatacatgtaaagatatttccatagcatttgtttgtatggcattaactaaaaccaggaaatgaccaaaatggggactggttaaataaatcagtacaaatgcgtgcaatgcaattttatgcagaatgagatctgaatattttgatatggaagatctccaggataggatgagaaaaagcaaagtgcaaaagagcctgtagagaggattcattttgatactagagaattatgtcctcctagacaagcctttcaacgtaaatgccataaaccctgaacaagtatgaaaaataactacctaaagacaatgagaagcagccaaaagcaggccaaaattgaaaatttgaaggtgagtcgacacttataagaaagggtatgttttctgttttacacctttttttttgacctaagtacatgctgaagacagcttcaagccaggcagctaaggttctagcagaaaatttatggtcttattggctttagaactggaggcgagagttgtagacaaccatagtagatggaaactggtggtgatagtggtgagggttagagaaaggaggcggcaggcacaaagggagatcccctaagtctatataaattcttcccaaatctctggtttgtccctgaactactgaaacacagggtggactccaggtagcctaataggggaaaaatctgaacagatttcagttgcttaccatctggggagacagagcttatagttttgagttcagattctgactgcctgctaaaacaaaaaatctatattctctttttttgggggatggagtctcactctgtcgccaggctggagtgcagtggcacgatcttggctcactgcaacctccgactccctggttcaagcaattctcctgtctcagcctccagagtagctgggattacaggcacacaccaccatgcccagctaatttttgtatttttggtagagacagggtttcaccatgttggccagaatggtcttgatctcctgaccttgtgatccacccgccttggcctcccaaagtgctgggattacaggcgtgagccaccacgccccaccccatccaggtcactttgtgctaagtgttctacacttggtcagcattctcataaatacggtgcatggaatggaacacggtgggcacgttgcgtgaactcacaaattcaagaccagctggggcaacatggcaaaacctcatctctacaaaaaatacaaaaattagctgggcgtggtggtgcaccctgtagtcccagcttctcgggcggctgaggtagggggatggtttgagcccaggaggcggaggctgcagtgagccaagattgcaccgctgcactccaacctgggtgatagaaccagaccttgtctcaaaaaaaaaaaagagagaggtgaaggaagttctttaagctgaagagatgtgatgacctgacatggaaaatatataggtaaatgtaaaagactatttttgcccttcttagtttctttaaaaatatatttaactatttgtctcatttgtgcctgtgggattgtaatctatagaggtgactgagtgatgacacagtccaatgcccttgaaagaaaacttttactacttatattgcctgagagaagggggcttgatgtgccatgcagggccacatggggaagcaccagttttagtcaggagtcacaaggaactaggggaaaaagtaggtcagagcttttgttggagtttctgcaggaaaagcaaggcagagcagcgtaaacggcttgcagttggctagtttgaatgcttttggcgggccttggggcataaagactgccctgcttgtctaatacctggcccttgacttacagcagggagaattttggcttggtgtatgagtttatgggctccagattggctgctctgcataagaaaggcatgctaccaagcaagccctttgctgactcctccccacctgacggaggggcagtctctccacaaatgtcagagcctcaagaatacagaaaataagaaaatatttagttactactaataatattaataataaaatatatagttaatacagttggctctgtgattaatggatgccaagtagttaaatatagaagctaagaaaacagaatactgtttaaagcaggcttagtacacttgacaacttaatcacaaaggccaggaggtgtggggtaaatagatctatatgattcttaacgattcttacattttatgtgcagtagtaaaattaaaaggttaaggatgtatattgtaaattctagaacaaccattaaataagccagttgcagtggtctgtgcttgtagtcacagctgttcgggaggctgaggtgggagagtcacttgaggtcagtagttcaagaccagcctgggcaacatagtgaaactatctctagaaataagtaagtaaaatacaaaatacactattgtaaaagccaaagatatattaaaatggaattctagaaaacattaacctaaaagaaaactcaaaagaaaaaaacaaaaaccagaaagaacaaatagaaaacaaatacctaaaatgtaggtattcaattattcagttattgatacaactgaattcatttatatcagtaattaaatgtaaatcaagtaaatattccagctaaaaggcagagattgttaggatgaattaaaaagcaagactcgacgataatcctgtctacaagagatatacttggttgaaaataaatggatataaaaagatatgctatgcagacaataccttaaggagacagtgtctattaatattagataaagtagatttaaagacatagtattttcagatttaaacagggacattttgtaatgataaagggtcaatttgttagaaggaaaacaacagtcatcactgtgtatgtgcctaataatagagttcaaaatataaagcagaaattgaattcaagagagaaatagacaaatctataatcatagttggaagtttgaacaagctctgaacaattggagaaacaattagatcaatgaagaccttgacttgtttgatacctagaacactgcacccagaaaaggcaaaatacacattattttcaagtgtgcatgacattcaccaagatagacaataaggtgagctataatattaatacaactctaaataaatttctaagggttggaatacaaatatgttctctgatcacactggaagtaattttgaaatcagtgtcatatcttgggagggaagagtttgcagtattaaataagcccttccaaataattcatatattaaagccttaagggaaaatttatagctttaattacttatattagaaaagaataaagatctaaaacagttatctaggcttttgttttagaagataaaagaaaggaaaggtaaactcaaagttgctgagaccagctctgttggggagaccctaacccagaggcgctagaggaattaaagacacacacacacaaatataggggtgtgaagtgggaaatcaggggtctcacagccttcagagctgagagccccgaacagagatttacccacatatttattaacagcaaaccagtcattagcattgtttctatagatactaaattaactaaaagtatcccttatgggaaatgaagggatgggccgaattaattgcagcaggaacacgtccttaagacacagatcactcatgcttttgtttgtggcttaagaatgcctttaagcagttttctgccctgggcgggccaggtgttccttgccctcattcctgtaaacccacaaccttccagcttgggcgttaggaccattatggacatgtcgcagtgctgcagagattttgtttatggccagtcttggggccagtttatggctagattttagggggctttctcccaacacaaagtaagtagaagaaaagaaataataaggataagataatcggtgaaaatagagtaccagaaaatcagagaacagtatcaaagttaaaaacttgttttttgtttttttaaaaaagagcaaaattgataaacccctagttaggctgatgaagaaaaggaaataacacaaattaccaatctggaatgagaatggggctatcactgcagatgctacagacattaaaaggctaataagggaatatcattaccaattttatgccaatcatctcaacaaatcaggtgaaattagtgaattccttgcaaaattttacttactgaaactgaccaatataaaatagaaattttgagtgtcctatatgttagagaaattgaatttattgtaaaaaatcttttcatcaagaaaattcggtcctgaccagcacagtggttcatgtctgtaattccagcactttgggaggttgaggtgggcagattgcttgagcccaggagttcaagaccagcctggaaacatgacgaaacctcatctctacagaaagtagaaaaattacccaggcatggtgttgtgcacctctagtcagttccagctactagagaagctgaggttggaggattgcttgaggccaggagaacaagtctgcagtaagccgaggtcatgccactacactccagcctgggtgactaagaccctgtctcaaaaaaaaggaaaactctaggccagatggttaaattgatgagttgtatcagacatttaaggcagaaataagatgagtcataataaaatttcagaaagttaaggaggtaggccaggcacggtggctcacacttataattccagcaatttcggatgctgagacaggaggatcgcttgaggtcaggatttcaagaccagcctggcaatatagggagaccccatctctataaaaattttaaaaaattagctgggtgtggtggtgtgtacctgtaaagtagttccagctacttgggaggctgaggtgggaggacggcttgagcccaggagtttgaggctgtagtgagctgtgatcacactgctgtattacagcctgagcaacagagcaagactgtctcccaccaaaaaaaaaaaagttaaggaggcgggaacactttcgaaatacagtcatgtggtgcttaatgacaaagatacattctgaaaaatgtcttatcatgcaaatttcatagagtgtgctgcttacatagaccttatagcctatacacacataggttgtttagtatactctattattcctaggctacaaacctgtacagcatgttactatactgattaggtagttgtaacacaatggtaaatatttgtgtacctaaacacagaaaagatacagtaaaaatacagtattataatcttaacagcactgctgctatatatgcaatctattgtttactgaaatgttatgcagtgcatgactaattttatgaggccatcataaccctgataagaaaacccaacaaagacatgtttttgtaaaaaagcaaattactgaccaaatatgtgattagcatagataaaacaattaatatgtttttcaaatccaacaatgtataaaaaggataataaagcatgaccaagtggagtgtatggaatgccagtttggtttaacagtcataactttatgttggctgggcatggtggctgaggcctgtaatctcagcactttgggaggcctaggtggggggatcacttgagcccaggagttcgagaccagcctgggcaacatagcaggacctcacctcttttgttatctctcacttctttttatttaaaaaaaaaattaaaaaatttatgtgtgcttttatatgatcagttaattaacaaaagtacaaaggcagctgatcaaagaaaaaattatctttttaacaaatggtgctgggacaactggatgtccatatgcaaaaaagaacctcaattcaaacacctcaccttatacaaaagttagcttaaaatgaatcatagatgtaaacttctaagtacctctagaagaaaacaggaatctttctgaccttggattaggcaaagatttcttagatagcacactaaaagcgttatccatgaaaggaaaaattgattaattggaccttatcaaaattaagaacttatgttctttaaagacactataaagagaataaaaagacaaaccagcatattttaaaaactcttgaacaacctaaaaaatcctgtatctaggctgggagcggtggctcacgcctgttatcccagcactttgggaggccaaggtgggcagatcatgaggtcaggagattgagactatcctggccaacatggtgaaaccccgtctctactaaaatataaaaaattagcgggcatagtggtgcgtgcctgtagtcccagctactcaagaggctgaggcaggagaatcacttgaacccaggaggcagaggttgcagtgagcggagattgccccactgcactccagcctggcgacagagcaagactccatctcaaaaaaaaaaacaaaaaacaaacaaaaaaaccctgtatctaaaccatcaatttttaaaggagcgaaagttttgaatagacactttgccagagaagataattggatagcaaatatgcacatgaaaagatgttgaacatcattagtcattaggaaaatgcaaataaaaaccacagtgagatgccactgcacaatcaatagattgactttttaaaaatcaattgagagacatggagcagttctaactgctccacattgctcatgggaatgcagagtgccacattcactttgggaaagtttggcagataaaattaacatgtacttaatatataacccagctgtgccatttctaggaaaatttatgttcacagagaaacttgtgtccagtttttagtggcttcaggggtgatggaacttgattttggtggtggttaaatgactgttcttttttttaaacacaaagaacttaacactaaaagtggtgaattttactatatgtaagtcatacaatttttaatgaaaaagaatgctcagaatctgaaataaaatcagtgtatatgaacagaatataggaggaaaactacaaccaatttaatagatgtgaaagggcatttgacaaaatttgtcacccattcataataagtcagcaaacaagaactaaaagggaatttcctaatctgataaagagtgtctagaaaaacaccacagacatgctgtcctccagtattgagaacaagacattcactctcaccactgttactcagcattgtactggaagtcattgccaggcacaggtttgtaggtttcagccatttttggctatttgacgttgacaagttacttaacctttcatgggttttagtttcttcaggttaaaaagactggggggcgctgtgggaaagagagtgataatctaccatgcaggattgttgtgagggttcaagaagatgtttaagcacctaacatagttacttgtatatggtagtcatacagtagattagatagttttaatttgttcagtgtgtgtgtgtgtgtgtgtgtgtgtgtgtgtcttctgtgacgatagcctctttccttaaactaaatgaacatcttagtgaattttcctattctggagaaggaaaaggaagaaataggggaaagataggcatttgactacctttcatttggataattgaaaattattagttctctccagtaaggtaatggaatatatataattacctgataataaaaatttatttctgaaaacaattcagaatctctcatcttgtacagattgagtatcccttatccccaaatccaaaatgctccaaaatctgaaacttttgagcaccaacatgacactcaaaggaaatgttcattggagcatttcagattttggattttcagattcgggatgctctaactagtaaatacattgcaaatattccaaaatctgaaatccaaaacacttttggtcccaagcatttctgatgagggatactcagccttgtaatacttatgcagtattttgttgataggattttagtaggaaataattataagtatgccaatcaaacacttaatttggtcttcaaagctggttacaatagtacagtggcatctggacagagatgattttttcacaatttttttgtacaggatatattgatttgtcaaaaagaagagtttctccagaggaagcaatcaaatgtgaagacaaattcacaaaatccaaaactgtaagttgatctttgagtcaaattagtccactatctgtgtgtttaataaataatttgaaatcttaatttcatactgctactaccttaaagtattgcttatgatctaatattctcaaattagtactagaagtgttttgaagccgttttaggttaaattaactgtgggtgacttcaactgctttaacttgtttacagttggaatgcctcataaaatacggggtttttttgtttgtttaaatagaaatgaggtctttctattttgtccaggttggtctcagaccctgagcttcaagtgatccttgagcctcagccctccaaagtgctgggattacagaagtgagccaatgcacttggccaaaatacagttcttgattttcaaccctgttctgggatgagggtaacggagacaaccagctgttatatgttaagaatgaacaggggtttataaaatgtctgtgaatccaggaaagcaaggcagaggcctgttactagttttggtttttttccccctccactagcgtgttaggattatttctttttgcattcttatttttgctattacttcctgcttgtcatccacagtaagcagcagcaaagcaaagatagccatttaatttcttctgtcagtatttctcttttctcaggtcctgtttaagttatccttcatcctctacatcctcagttctgtgtgtgtgtgtgtgtgtgtgtgtgtgtgtgtgtgtgtgtgtgtgtgtgtcacaaagtctttcccagactggagtgtagtggcgcaatctcaacttactgcaaccacctcctcctgggctcaagcgatcctctcgcctctgcctcccggaatgtttgagattacaggcgtaagccagtgtgcccagcctatcctcagttcttagtggtactgtttgtattgcttctgttttctttgcccttctctggtgtctgttcttttctgccatgagtgtttctgtcctcaagataaaatatcaaaaaaaaaaaaaagtttcaatgaagagattttaaaaaatcttgcttaatcccagtaagagagaaaataaaggtctaaaagccatcagttacccaaatcatttcctttgttttactgatgtatttacagttatgcagtgtggtttacacatttgaaaacactgtcagtaaaatatcttcttaataaactctaggaccttaccacttagaatgtagtctctaaactagcagcattgacatcacctgtttttttagaaatacagactctcaggtcctactaacttttgagaagcacttttctgggaaaatttcatatttttttgtctccttaggatattgttaaaatgagtgtgttaatagatcttattgagatgttaaaatggaagagttattcagtgtcagtaccttttctcactcaatttttatgtgtaactatgatgaagaccttaatactttttgtctacaccctgttaattttaggaggtaagaaaaagtttggcaggtgggtaagatgacagaaaaaaaattttttttatcgtgattctctcctcagggagtaataataacaacttgtatttgtatagccgttttccatttatagtgtgtggtttctatatatttgatctatgcgagcactctgtagtaaggagagatgctagtttcttctttttccagaggaggaaacaagttcagagatactgtgttactgtcaagacttgatccaggtcttaggaccctaaattgtatactatctctactttttatacccacttaaagtgagtatttccctatggagatcttttattgttaaggaattattgtagccaaattatgttatttactaaaatgtaaaaacattttttataaatctcttatctttgaattgttgagcttttcattttatttctaggtttatagcattcttcgtcatgttgctgaggtgttagaatacaccaaggatgagcagctggaaagcctattccagaggactgcctgggtctttgatgacaagtacaagagacctggatatggtgcctatgatgcatttaagcatgcagtctcgtaagaataccttcttgactctccttctaccttgatatcacaactcttggcctgatatttaacagcatagcatccatgtataaaatacttgccaaatttagattaaaatattttgtattggccagtaaatgggccaatcctatatggtcaagtctgtgtagttttatgtatcatagttatgtagattcataaaccatatggtttatctcacacattttcctttcctagttattgtcctaagtggctatgggactaaagagcatgtctcaccaaaaactataacctcttgttttctctacctcttttgactctcctttgactttcagcccacaccactttagccagtcttccatgtagccttagcctgggccttactatcaccgggatttgctctgccactaaaatctttaattcacactttctgttcttttgcccctgcctcctattcatctagctcccagttggtcctattatttgtcatcttaattctgtatgttaggatctgattccaaaccttttttctccctgtcttttcgccatttcctgccttttctctcttatccaacataggcacaccatgatacatcattttaacgactttgttgccattattgtgagcttttgccttgtttttccttccatccatccagccttggatcaatgttcctgccttctctgtacttgtagactgctgggtgctactaggaaaaatcagtcttgcaggttggtccactgcatattcatggtctccagcctcagctgttccacattctctctgctcctggtcagttcttcagtagtggctattttagagcttttccacgttcttcctcagaaaaccactctatccctgctccctgcctcttggctggtatgctcactacctattttattttataaagaaaatagaaaccattgcacaagaactacttttccactgtctcaacaaacttacatatctctgtcccacctgtcatttcttcctatgctgctgtcactggaatttgtgtcctaattgctctcaaactagtcttgccacctatgcccagctgctgctcagagatctctattagttactttttctcttgggtcacctttccctttattgcttttactccatcagcataaaaatatctctagtttcttccatttatactataaaacccacttctcaacttttcctttactttctcttggagcaaacactgcgtcctctgcttttaacagccacacttggctatgtgtggtagctcatgcctgtaatcccagcactatgtaaggctgaggtgggaggattgcttgaggccaggagttggagaccatcctgggcagcatagcaagactgccatctctaaaaaaaaaaaaaattaaaagtagccaggtgtggtagcatttgcctgtagtagtcccagcaacttgggaggctgaggcaggaggatcacttgagtccagtggtttgaggtttctgtgagctgtgatttgtgattgcaccactgcactctagtctggatgacagagtgagaccttgtctcttaaaaaaaaaaaaaaagccagactctttcagttctctatacttgctgtctctttacctcccactccttcctaaatgttaagagttagaggggggaaaaaagagaatgagtaggacccaagaccattaagagtcccccagaaagccaactcatctggggttccaaatcccttcaagtttattctcatgtgactttttttttttttttttttttttggtatatcacgtggtagaaaaggtgggaatagtaataatgataactaacatttatataattctaacaacaacctgtggtataaatgctattattatccttttcttacagttgaagaaactgaagctgagattaaataatttgttcaaggtcacacagctaacaaatcatagagccaggcagtattcaaacgcgtgcattctggctccatccagagtttgcactattagccattaaacacaactttatatttctgtcctgcagtcctcagtacatttcttaacttgtctcaactgtcatcatctggcttctttagttacctctttaacttctagttccagcaaccccttgttaccactaaaccttggcgtgtgttattcccttttccttagcactcttttcttgcttcattcatgtagggactgtccagatttaactaatgctagttctttgcatttttcttttaattacataaaatttctgacatagttggaaacaatgttttacctttccagacctattttcctcacttatcagtgataaccactattctgaaattatgtatcaatatcatttgtttttattgttttactacatatgtgtctattatcattttttatttaaaatgtaacctattgtatctttttgtagcttgcatttttacatataagcctattattaagcaggattcccccacaatgatagatgtatacttgatccatattaatctctatatagtatttcattgtgagaatatgctttatctgttcctctattaagagttgtttaggtaattttcccttctgtgccatttgtcaaacagggctgtgatgaatagtgtatgtgtctctatatgtagttgtttgagagtttctaatatatatgcctaggagtggaattgttgggtcataggattgattatatatctttaaactgacttggtttcaccaaatccttgccacaatttggtatatatctgattttttctcctttttctagtctaatgaattcacagtagtatcttttgatttgcatactcctgattgttggagaggtcaacagtttttcatgtttcttaaccatttgtatttcttctgtgaaacatctgttcacctcatttgcccattttctgtttatcatcttgtttcttatacatttatgttggttgtcttctcgttactttatgttagctgagtaaaagttccctccacccaaattctcttgccttttattcccaataagaccccttgcttattaagcctgatgcttgctcatgctattccttttttacatgacataactttctttttttctttttcttttttttttttttttttgagacggagtctcgctctgtcgcccaggctggagtgcagtggcgggatctcggctcactgcaagctccgcctcccgggttcacaccattctcctgcctcagcctcccaaatagctgggactacaggcgcccgccactacgcccggctaattttttgtatttttagtagagacgaggtttcaccgttttagccgggatggtctcgatctcctgacctcgtgatccgcccgcctcggcctcccaaagtgtctttttttctttttaatagagatggaggtcttgctatgttgcctagactggtctatgaactcctggtctccagtgatccccctgcctcagcctcccaaagtgctgggattacaggcatgagtcactggtgcccagccttatgtatcataacttttttacaatagttctacctttactttttacagtgctactcctcttttagtctttatttcatattttcatttgctcactcattcaacaaacatgccagttaataagaccctggtccctgtcctgtggcacttaggagggtcagatgaaatgctactttttgcatgaagcccttcctgacctcattaactggaagtaatacctttctgtcctgatgcccacagatgtactgttacatttaaaagtttttccatgttttttttttctattcaagatagattataaactccttgaggcagggacagctaattgcatggaagtaatcaattatagtagaatatcagatgtgttaggcattaaattgcttgttttagtcagatcactaaaattttgatttcactaataatcagttggggtgtaagtgcaaagctaagatttgaattctaattgtgacactaaagccttaactattatatgcattaactattatatgcttaactattatatgcattgttccatagtgtttggtttcacatttatcagtaatataaccttgaccttttgttatttatttatgtttttgaccagagacccatctattttggatagtttagatttgaatgaagatgaacgggaagtactcattaataatattaataggcgcttgaccccacaggctgtcaaaattcgagcaggtaaatgattttttaaatgatttttacagtattttgcatgcatcaaaaaagctattaaataatgagacttaccaaagaatatgttgctacatcaacatctataaatttttctaaatggttgttttttataacaaaagcttaagaaattattttggcttctgaatcataaaatttatatattgacacaagtagaaacagtcttgtgagttcagctaacctaaaggtagccctttttttaaaaagaggggtttgattgttttgttttagtgcatactttaaaatattccaaatttttacaaagatgagacataccatgcggaattttctccaactagccttttccacccagtgtatcataggtacccttccattgcagaacataggaatctttctcattcttttttatgctgggtaatgtttcatagaacagataaaccttaacataaacccgtcccctcctgatgaacatttaggttgtgccagttttctcacagttacaaaaaaatgctacaaattagcacccttatattatacatacttaaccatttacacaaatgttcttcaagacaaattcctaaaagtagaatttctgagtcaaagggtaatgcaatttctaaaccgttttagataagttgcagttattgttatattccatctttaccacactcctccttgcctcccttttataaataaggaactgcagtatagagaggttggattcagtataagtatttgaatactaatatatctgccacgtgtttgatttcctttaaacttttaaatattttttgcattttttatcaacttttgaatttttgtaattgtagatattgaagtggcttgttatggttatgaaggcattgatgctgtaaaagaagccctaagagcaggtttgaattgttctacagaaaacatgcccattaaggtgagtcatgagttgtctccctccctgctgaaatgctcacctaaaccaaataggatctttgatctttgtttctttttttttttttaatcacatttcataacaaaagtgggttttttactcttaaaattgagcagtggttcttggtaatatttctagatgtttgtgatttatgtttaggctttgttggtttctactgttactatcacagtggatggagattcctattggtagaaagccagcgatgccaaacctcctttacaataaagagttgctgtgcccaaaatactgagagcactttaaaaaagagtaacactttcttctatctgtacacatacaagttttatgaggtttgatcagaatctttcattagtgataaaattaactggatggctgtaactcagaaggattcttccatcagtttagttcagagacaaattatccattatactgatgataattgcagttagtttagccaccaaagatacacggaaatgataattctttctattcagtatcgcagtgaactgtttatactattgcattagatccctgtgttgatttgcttttgctacattaacaaatcaccccaaaacgtaattgccaattctgtaggaccctaaattactgtcctgtagaattggcaattacgttttggggtgatttgttaatacagcagattaataaaatctcaagcatcctaatagttgtgggttctgtaggtacattcataaatgaatttttgtctttctcttttagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatggaggtgagatcaatagattcatttttaataatgactcaggaggttcctaaaaggagttcttgtaggtaaataagagctgtcggccttggaatgtcatattgtaggatggtcattcaggcctttgatcactaatggtgttagggtcaccccccgtccccagccagggggaagggaataaacaatataaatgagaagtttttttatggtttgaatttgcatgtggcatgtctaaaatttgatctcagaattggagaaaaaaaaagttgtctcctgtcttttccttgtccaacaagaaagaagtgtgtgtacgtgcgtgcgtgcgtgtgtgtgtgtgtgtgtgttatggttccttctatggaaaggactagtaagctagtaagtagtagtttgagcctggaagacaggtttttttaacaggatatctatttgtggtcttgaaagatacagccattggggttatttcatgttttcagttttagcttataaaaatgacagaaaataattttccattttaatacatacatcctttttctatactattctcataagtttcacctcttatttatgtaatggaatttattgctgataagtcactcaaaagtgaacagatatgacagagttgttagaaaagtgttaaagagagaaaacattaggcagtaatagtattgaaattaaatttgtatagtatttactacttcagtttgaaattatacctctgcttccacagcccaaagtggtcacagatacagatgagactgaacttgcgaggcagatggagaggcttgaaagagaaaatgccgaagtggatggagatgatgatgcagaagaaatggaagccaaagctgaagattaactttgtgggaaacagagtccaatttaaggaacacagagcagcgcttcctggctgtaaatcctagacttgaaagttttccagtattgaaaacttcaaagctgaatattttttatttctaagtatttaaatgttctaacagatcagaacatgaaatgccctcctaaatgtcagctgttgtcacacagtagctccaacactttgagcatttttaagggagtggcctcatttcactagagacaaatctttaagaatagttctaaaattgggcttgtgatttccatttctgatgtctccagattggcacccctttctagttcaatgcctcacgagatttgccaggggcatccaaggcaaacaatcccaatctttctatataaaatgtattcaagcaaacatcaaataaatttctgggatatttaactataggcttcttccttcttgtcaccagttaaaagcattttaatactaagaccctaattcttttatctttattttagtcttgatgtggaactgtaggagcaggtgaataaaggatctctataacagatcctttcaaaagaagagttttagagaaaataaatttaactttaaccacagtgaaagttgacccttagcgggacaaagccttaaaatgcattgaaagaattagatcggttctgtgccttttatctatttgagattgatgacaacctgtgtgagagaatttatcacaccacgtccttattggaataataagctacttgccttgagtttataattcagggtggtaaagtatgtttttaaattttaaaaagcagctgcattttttatttagttggaatatcacccaattttttatttttattgctattaaaatatccactagatgccacctagagctccagttctttataacaaaacagggatctgtttgaacacttactgttgtttttttttttttacatgtttccatcatttctgtctttaagaactaattcgtacataataagtttcataggtaacacattatttgaagttacagctacagtagtcaggtgtagaaaatcttgagttgctttggtctgcttgtcttcataaatttattctcttatgatacttgaggtaccagttgtatttaattttattcattatccctagatagctattaagatacttagattagacctaacccaccatagtcaatccaagactagactactcaatattaaagggtctggaaaatagaagagtgtgttgggcaggtagtttgtaccatttatgaaggtttgttcctttgttaaatttagcagcctgtactagcttttgaaatccagaagttttaacttccagtggctggtttctgagagagtgccatgattgctagccagcattccatattgggaatatgtagaggagaacctggatgtacttaagagtggcatataattttcacttctgtctgttgaggcatcaaaaaaacaagtttagaaagctggcaacatgaagaatgcattcaaaatataacaggtgcttctttgttgtacgcagaggaattttttcttttgattttgtttactgaaatttgttatacttcaaaagccataacttgaaaaatactggtggcgtcgatggtgagtgatttttatcccacgtgggccttttgctcagttccatggcaattttgtaaattgaccctagccagagaatagatcagtatttcactgataccacgaggaaaagaacaaacaaaacttaaaagtattcatacaccttgctaacctaaaagacagcagggacaagatacatatgaggacaaggtatacacccagttctgaataacttgaagaacaggcttggcaaagaagtaagtttatccaaatcttgaatttctgccaggcatggtagctcatgcctgtaaccctggcacttaaggggccaaggcaggaggatcacttgaggccagtgagctgtgatcactccagtgcactcgagcctgggtgacagggcaagaccctgtctc

SEQ ID NO: 35789 - DNA, 25072 bp, Homo sapiens; identical to SEQ ID NO: 35788

SEQ ID NO: 35790 - DNA, 162390 bp, Homo sapiens
cccggcagccaccgcggcgacttggcggcgggtgccatgcgtctggagcttcacattctctgccccccacccaccgcgccggcgctcccttgtcacgcctcgggaagcgcgcacctgccaagcaggtgagttcgagctgactcccggttggcccagcccggtccagctggaccgagagccaaaccacgtccgccctcgaggtgtcctagaaccctgggtggtgtcctcgggtgtggcctgggggctttcgagggcagatgccttggagcaggagaaatgggcagtgctactggacctgatggatccagcggcatccttttcctgaaagagattctaatgttccacctgtgctcttcctccctgcggggtcaccaaagtaactcaaagctgaccatcattgcctctaaccattagagcaaatagctctatcattttcttatttctcaccacctatttcgtgcctggcactgtgtttaatgctagatcacaagtaagtacagaaactgagttgcaacttaagttctcatttcattcattactggatcctaaccccttcctaactttaatagagataaagtttcttattgctacagacaaaaattacccaagagctgtgaagacatctcagttatttacagattgaattcatttctggaagatagcacgtgaaaagtgctcctcacctgtttcagccggtgtcttgcataagaattagcttagacaaaaactcacatacactggccattgtcattctccatcctgtcaccactttcacatcatgctttcctaacaagaaaaatattggcagaggaatctgaagaacaccacatccatgggactagagactaacaattgctctcttgggtgttgccagcttctaaaattgagattatgcctttagagtgaacttccaaagaggcccagactggttaaaaactctcaattaagggctaagcaaattgctgttggagggccagctctagtctgtggcctgtttttacacagccctcatgctaatggtttttgtatttgagaagggttgttaaaagaaaacaagaaattttttaaaagaatatgcaacagagaccttatgtggtcccagaagccccaaaatatgtattacctggcctttacaggaggtccgaatgtcttctgaaatttatatacgaagagataccaaaccattgaaaacagtccaaatgtctagcaacagagaaatggttagtcaatatgttaaaatacttttgcagctattaaaataatttagtacagttgtagaaacaagaaagaattaggaatttgttaaatataaaaaatggccataacctaggcatcttatacgtatctatttaatcaatctttgcagtaacacaatgacacagttttattatccttattttatagatgaaggctcaaggagagtaagaagcttttcttaaatagctatattttatctcaaatatcatatacttcatgttattgtccttattccaccattagagtttggggccattaacattttacgttaaaattacttacgtaggcttggggtttttgttttttattttatagattctaaaattgaactttctaaaataaattttcactttaattataaactatactcctggttcttaaggattgagttctgggaagaatttcagagattgccaccacagctatcacgacctcattcatgaggtgcaagaacatgaaacacatatagcactttcctaggtatttatgactgaaaaaagagaatctttagttgatcttgtaaaattaaatatcaaagcctgcaagccactagtttctggcttttgcatactttgttgcctaccctcacaacaaagaagttgcacctgattgacattttcagtattcaactgatgaccagaaaagtggctatatgctcctacatgtttgataacagaagaaaaatcctagcttcctttcctttacttgattttgttgtcaattagaggaattgtctcttattttaaaattttaaaacccactttgccttccagtgtcatgtacataattctaatggtgttctttttgtcttgcacaatctgaagaaagtcacactcatctcctctgacctgataaagcagtctccaaaacagatagatggaggtggctcaatccaataattaatgagccaagaattattcctgtatactatcccctcagttcatctaggcattacctccatttcctcatgttttacttcctcctgtatctttagaatccaatctcagatgtcactgatgaagttgttgcagagaaatatgataacagctgtctagacctatcagttattgaattgagatgtcctgtagcctttgatacagtaggtcattttttgtttttgcaagaatgtaatcccgtgattctccatgtgcttccttgaatggggtagaaactgagctcattttcccctcccttttatgcttccctatagtccaccaaagtgccactgtcatcctgttccatcaacctcagggttattttcagccttttcctcttttgctttttatattaagtacatcaacagtacattatcctctgtgtctcttaaatctattctttccctgagaatttatcctcttgcttatcatttatcatatactgcctttatatgttaattaacttttcatttactcatgtctgttactcccagtaggccataaactccatgaagacagagttcatatcccacataagaatctgagacttatacttaatttataagtgactcgtcactttgaatctggggagagacactgagccacagtccccataggaactgttttcctcttttcgcccatgtgaaaatgcctagctaatggaggttccagtgagccgagactgtgccactgcactccatcctgggcaacagagtgagaccttgtcaaaaaaaaaaaaaaaaaaaaaaaatgcaaagaaaagggaaagaaagaaggaaggaaggaagggaaaatgcctagctaatatttaatgtagaaagttacctcatagaagagcactttccaagatgatgggaatgttctgtatctgtactgtcactgctagttatatgtgactatgagcacttgaaatgtggctaggataactgagaaactgaatttttaattttaattaattaatttaaacttaaatggccttatgtggatcatggtgactatatttgatagcacagttgtagagtttaagttactggtgcctggagatatcaaccttacttttcccatactactgttataacccacactggggtatggagaagaaaaatatgcgagaagtatttgtcccttgcatactgacctagggctgtaaatgtatttttgtcagaaaaaaaaatgctataaatgattaggtgtggtcaaaataataccatttccagtacattatggattagataggcttttacaagccatcttgcagatccaaccatcagaaataagtttatttctatgtaatgtgcaagtcaaaggtaagttttgggaatggtaagaaaaagggtttctgtaaggtttccaagcctatgcagttacctcctttctgattcaccacctcctttgtaacacaggctctgtaaaaaagttaagacattctaagagttgtttgactaatgtaaaataactatttaatggttctgagaaaaggcagacaatgaggaggacttgatttttgtgctagatctccagatcttaagcgattgttcgagcactatccagtcaagctcggaaggatctgttaatttttgcctgactccctggagtgctcaatctgacactactaaaatactttaaatgtaaatgtagttaactgcttccttgtccaaattaagttatagatatgcttcttgccaactctcagaaggcaaaaatttataaattttgcagatattaacagagtaacaaaaagctttcttctgggtgatgaaaagcttaatgtaaaccaaaattatgtaccagtaggaaaactactgattgtatatattttaaatatgtgtacaataatgaaaacatatagacggtaaaagcatttgttgaaagcctatcatgtacctaattcactactaggtgctatgagatgcaaaagtgtttaagccaatgcctcatttacatggtataatcaggctagttagaagtcagtccgtaagtgggaaaaaaattatgtaatactattagtgggaataaggatgaaggtgaccttgatgaagagtttcctaccacctctccatacaaaagtagaacccaagcaggataccctgaattcatgctaccagaggaacagatatttcatatgaagccaagtccatcgagattcttgtgatttccacaaaaattaaaacctcagtgaatatcacttttaggtgggccatctcaacaaacctgtcctttctgagtcctgggacacttggctcttaattgagaacagaccacatgcacagaaacaagcagtgaatgtatgacctgtaattttcaatggagtggatttatttgcattcatgacatcttctaacttgaggcacaaaaaaaagtctaaataggatagattaactcctggaatcatgcaccaaatttctttattgctctgattttcattacttgtcttctgagcttctgagtgatccctaaatataggaattcttggatttttatacccttttttgtgaaatataacacagagaaaagtgaaccaaagcataaattatcacaaatcaagcacctttaatctaccatctaggtcaggaaatagaacattacagaatccagaagtcccccttatgctctctcccaatcactttatgcactctccctgccaccaaaggtaaccattgtcctagatgtatgataagcacttccttgtttgttttttatggttttatcaactaagcatatatcttttacctgctcctgttttttgcatttatataaatagaagattatgatatgttcttttgtgtctggtttctttcattcaacattatctttatgagttttaataacgttgtagttgtgcatttattttatttgctgtatagtattctattaaatccatatatcagagtttatcttttcgacaattaatagacatggacattcgaagtgtttccagtttcatactactatggataggcgttactatgcacattgttgtagatgtctctaggtgtacaggcatgtgaatttctgttgagtatccatctaagagtggaattcctaggtcagaaagtgtacatatgtttaactgtgcttaactgtaatagataatgaaacaccaatctattttccaaagggattttacaaaatttgctgccctagcagtatatgaaagttcccattgctctaatatgtgttattgtcaatctagttagtttcagtcactctggtagatgtgtactattatcttattgtggttttaatttgcagttccctgattactaatgagatcaagcacctttttatgtgtttgttgactatttggatgtcgttatttgtgaaactcctgttcaaggctcttattcatctttcagttggttacctgtcatcgtcttattgatttgtaagaattatttatatatttcagatatgagcctttttcagatagatgtattgcaaatttctaatttcattatgtgatttgcctttttatttgcctaatagtgatatttgaagagcaatagatctaactttcattgtgaccaaatttaccaaccttttcctttatttgacattttttgtgttctgtttaagatatctttttctgctttgaggtagtgaaggtaattctcctgtattatcttctagaagccttatttttataaggcttttttgactttcatatctatatcgatttgcctttcatatttatatctatagttcacctggaattgattttggtgtttatggagtagaggtcaagttttttttttttcccccacattggtatggggggttgtctcagcaccacttgttgaaaagctcttgtttgacattgccacctctgtcatagatcgagtgtccatataagcactgatgtattgctgggctctctattctgttccattggtttatctatcaactttgtatcagtatcacactatcttaactattatatattcttctagatcttttacatagaattatatcatttgtgaataatgacagttgatttcttccatttcaattgttatatcttgtgctttttcttgccttacccagctggctaggacctccagtacaatgttgaatagaagtttagatgatggcaaccttataatgttcctgatttccaagggaaatctctccacattttgccattgtttgaagtagggttctgatgttttgcttttttaataaaccttttagcagattaaggaactccacttttgatcatagtttgccaacagtttttatcatgaatggatattgaattttagcaaatgttttttcttgccgggcatggtggctcacgctcgtaatcccagcactttgggaggcggaggcaggcagataacttgaggccaggagttcaagaccagccttgccaatatggcgaaaccccatctctactaaaaatacaaaaattagccaggcttggtggcacacacctataatcccagctactcaggaggctgaggcaggagaatcacttgaacccaggaggcggaggttgcagtgagctaagattgtgctattattgcactccagactgggtgacagagcaagactctgtcttaaaaaaaaaagcatgggctggtggcaggggtggcttctgtatctgttgagataatcatatgatttttctcttttactctgttagtaaggtaaattataaggattggccttctactgttaaggaaaccttgtaatcctggcataaacccaacctggtcatgagatattgacctttttatatattactaaatacagtatattaaaatgttgtttagggatttttgtatttatatttaaaagtatatttatatttaaaagtaatttaaaagaaatttttctttctgtaatattcatgtcaggttttgctgacctcatgaaacaagctaatgagtactcctttgttttctagtgtcaagaagagtttgtataagattgatcattatttcttccttaaatgtctggtagaattcaccaaagaaacaatctgaacctagagttttctttatgggaaggtttttattcatagattaaataacataatgctatttggattttctatttatacttgtttgttgtttctttactttttttttttttttttttgagacaaggtcactctgtcgccggagggcagtggcatgatcataggtcactgtaacctggaactcctgggttcaggcaatcttcccacttcagcttcctgagtagctagaattacaggtgtgtgctaccattctggcagttttttttttttagagactatatctctatggggtataaatttctctctaagcaacacactttattccttcaagttttaataactgtattttcactattattcacttataaataattcacttttgtatttaaaaagaataagtattctttcttgtttgggagtatagagttccatataatgcctgttcaaatttgctgattatattgtttaaatcttttaaatcaaaggtattttatctacttattctattagttattgatagtatgttgaaatattccactgttatagatttattcatttttccttgtaggtctgctaatttttattttctctattttgaagctatgtattagatatatcaaaattgttatatttctctggcaaactgaaccttttataattatcaagtgtccctctttgtttctaataatggtttttgttttagagtttaactacaccagctttgtgagtgtgtttataattccatcctataacttttcatctttttgtatccatatattttagatgtgtctcttgtaaatgcatttagatgttttcttttaaccaatctgagcatacaatcgtgggtcatttagcccattttaatgtaattgaattactaatatagttggtataatagctaagagcagtggcttcagtgctacacacacctaggtttgaatattggctctaccatggccaaatatgttgtcttgatcctgggcttggttcgcaggagcattaaaggattaatgagcaaaaacagaaattctaagtgctattattgaaggggaagtgaagctagtataaggaagacagtcttcctggaaaaaattaattattggtagagggaagagaaataaaattaaatgggtaaggtgagaccaaccgtgggagcattgaaaacttagcaaaagagtaaaaacttttgctggtgggagcttttagaagctcttgagcatggaattagcatgacaagcctgaagagatcactactttggaattttctcccaagtggaagtcaacctgttgggtatacccgagaacctgttggccattgtaaaaagttgtactgagaaaggatgaagacctaaacaactacagaaagaagattacagtgtttgaatgacaggaaagcattgaactatggttagctgtctgttgcagtaaagggaagtgagttagctcaggaggtgaagacgtttaatgtgaaagtggctgcaggtagttccatgttgtgtcacaatgccattcactgtgctcctggatgtcacaattacactgaagtgtacagggcaaaaggctaattttaaaattagccaaataactgggagagagttgaaagtaccttatgtataatttctcttctgctaacttagtatgcaatctaaaattcttgatttcttgatttttttcatattttaagtaggaataatttctgacttgcctacatctcagatttattgtaaaatgatagatgcacaagtattttgggaacccaagtcaaaaatcactttaaaataattatttttattggaatatatataatcaagatttgatatttaccaatatcaatactcaaacaggcggggcgcagtggctcacacctgtaatcccagcactttgggaggctgagctgcaccgatggctcgatcccaaggagttcaagaccagcctgagcaaaatgacgaaaccacacctctacagaaaatacagaaagttatccagggataatggcacatgcctgtagtcccagctactaggggtgggtggggggtttgaagcgggaagattgcttagtcctgggaggttcaggctgcaataagccattatcacaccactgcactccagcctgggcgacagagcgagaccttgtctcaaaaacaaaacaaaacaacaatgacaacaacaaaacacctctaaagcagcaattcttaaactttttagtctctaggatccctttataatattaaaaattgagacccagccaggtgtggtggctcacacctataccccaacactttgggaggctgaggtgggaggatcacttgaaccttggagtttgaggtcagcctgggcaacatagggagacctgcacctctacaaaaaattaagaaattagccagtcatggtagagcctgcctatggtcccagctacttgagaggctgaggtagtgaggtacgaggtcgaggctgcagtaagccatgatcacgccactgcactccagcctgggcaacagagcaagacccttttgcaaaaaaaaaaaaaattgagatcaccatgccccacaaagagcttctgtttatatttacatctatccaactataacatattagaaattaaaattgaaaaatatttaaagtcttgatttatcaatttacttagaaagaatgataaaccaatgcatattataataacatgctttatttttttaaaaaaaaacatattttccagaaaaaaaacatgagaagaatgatattcctttacattttcagaaatatctttgatgcctggcttctgacttagtagaagacagccgggttctcatatctgcttttgaatttcatcttttgagatatcacacgctgtgtaacctctggaaaactccactctacgctcatgagagaatgggagtgaaaaagacaaataacattttagtcttattatgaaaatagttttgaccttgctgacccactgaaagggtctcaaggacccacgggggtttccagatgacatcttgagaactgcagctctgaaatatttctaaaaacatctgctaaaacatgcattgaggaagctctagacaaccaattgccagaagtaatatataatgccactattaataaaacaaagttgcaaaaactatttaaggaataatttcacatattgatatgtatgaaatatatgtatatttcaatttcatataatcacattttgaaagtcataagcaatcacatattgaaagtcattcctacacttcaaaatcaaatttccaaatccaatccagatatgaacacaaacatgatgattcctataaacgggatagctgaatttagtgtgacttttgtgatatagcatgatttaagttactttgtaagatctgattcacttccattttagggtcacaaagttatttttatcattgcatttagatcagtggtaaatagttaaaagatgttctgggtaagttgttcccaagatgatttttttaatgctatggagagcatagcttggaaattgtttattcataaatcctagcacttggccttttcatacctccaagtttcttagttcttttcatctgaccacctttatcctttgtagacaataactaccaagcacccaaaaggaagtgatattctcaaaggcaagtcttttctatcttaattcagatatgataggaattgcttttttccattgactgaaagtattcttctggggcaaagagatgaaccaagtctctgcatgcgctaagactcccccagagccccagagaaagctgggtctgaggatgtggcaaaagtcagtggtcttcagaggcttataatcatctcttactaattctgcctttgactatttcaggactatagactctcttaggactccctattctctattcaggagaatttacagagagagtatcctgcctgcttaatcctcccaagtggcccttagctctctctctagtcaccatttcccattattttcttttctgaaaggggaagctgactttgctccccactgcttagcttagctgtaagaaagctactgtgagtatattaggagtacacatacctctaatggtcatcccatccttattttttcacagtcaaataagttttctctctagtctaactgaaccatggcaccacctcctaccacaagcaataataatcctgaagcctgaaaaagcatgaaagctactttgaatcaaatgtttaaaatgacctgttaatcacccatgcagtgttcccactgcgtccctaaatctgctactgaaagaagcaatatctgtttttgaaatctatttttttaatgttgatatatttgatgactagatttttaagcaaagaaatatggtagcttcttcacgctcttaatttctttcatttttttaacatcctcactttcttgtttttcctttcttttaggctcatcttttttcctgttttttcaacctgggtcagtatgatgcaggactagagagaaatgagaagagaaaaatgagggtcagtctatgagccaagagacaaagtcatgggaagacagctgaggctaattccagaaggtcctcctaggagaagccaaagcaggggacacacctcaaaatagagccatgcatagaaccactcatagccagactgcaaggcaggaacatgaggatggtcactaggaggccaacaaattctgctaaaggggattctttttataaaatacactctttcaggacattgtcagatcctctgcatatagtcctcaaaatacgtccttgatccagcttgttttaagtgtttatgcaaaataatggtatgtttgaaagtgttagatattaattttttatttctgttttgaaggcattcaagtatcacggactatcagcaccttcgtttcttttttttttttttttaagccaaagctactggatcaaaagtaatatactgctttgtttgtatgtgatgtttggggagaagaaaagtcgaaattcacataactgaaattttaatcaatcctaacactctttttttatgatgagccatatgtatgatccataaacagcttctaaacctatccatgtaatcacagctcaggttagaaaggttgcctgtgtagagcagggtcataggatgagctccctcgagggggcaggaggctgctggaggagtgaacatcaagaagcctacagggaagcagtacaccagctggaaaaacatgacaccagatgcaataataatcatgaagagatgtaggccccacaacagccaaggattttgtaaaaaggaaaggaagatacttgggtgaatgagccactttatatgccagttctgggtgacacttaaacaccagcgtcaggaaaatcaatcctcagtagttagctacccactgacctacccttttgcacctaagctacaagtacatttgtagtcatgagaagcacaatcccaagttctaaccatgctcttcaaaagaccactcatcattgagggagtttgtttattaaaaccaatctgtggaacttccagctccctggtggatcttaaaatttcaggaaaaaaagttatatttaccttcaaacccaaaattcagaatgtgaatttataatatcaccataaaactctgtgaaaattgagttttaccttggaagaaataatataggttgatgatcagtcatgtaacgtgcctgaaatacaaacatatttatgggaactcacactttccttagaacccatcagtgagaacaacaggtgagctcctgcttcccagctttgtactaagaatattggttaccttgtcttatggaaaacgaggatgtcttggatttgcatccaaataatccaatgcaggtagttagcaaggaacacagcaagtggattagaggataaacaagacaagaatggccatgtgaaagccgggatatggatacatgagggttcgggtatgctctacttgggtgtgttttcaagttttccataataaaaaatgtaaaagtgtatttaaatgtttcacttaggctgggtgtggtggctcactctgtaatctcagcactttgggaggccaagcaggcagatcacttgaggtcaggagtttgagagcagcctggccaacatggtaaaaccctgtctctactaaaactacgaaaaattagccaggtgcagtagcatgcacctgtaatcccagctgcttgggaggctgaggcaggagaattgtttgaacctgggaggtggatgttgcagtgagccaagatagtgccactatactccagcctgggtgacagagcgagaccctgtctcaaaaataaaaattaaattaaaataattttttaacttagcctgtccttttattactatttcaaaaaccatcagtgaatattgtaaaaaaaatttagagaggatagtagagtataaagaaagagcaaaaattttagcatgcatgacctgtcccatcactcagatatcaaatatgctaaccatgccactccataaatgtaaattgatcagtcatcctagtggcctcagctagtcagtaactttaatgtcatgatttctccagtattcactgatactaatactaccccacatttgtgaaagtgagagatgaggaaaacagctataaaacacattatactatttaatcacctagcagttttgataattgcagggacaagccaatggtaaaccaatgtaagtaaatagatatcttagagtaatgtgttcatcctctatgaattgaatgaactctttcagagaatcaagatatgatcaggtcaattactgtgttcagtagttttgcaaaaagcaaagtggcaaagtactttgacaaagcactggtgagcaattaacggccacctgcagaaaagagcaagagatgtcatttcttcaacctaaccataaagccagtatgttacatttcaatgcagttatgttatattggttaactattgctgggtaataaattaccccaaaacttagcagcttaaaacaacaaacatttattatcttacatcatttctaagactcaagaacccaggaacaactttggtgggtggttctggctcacagtctctcaaaaagttgcaatcaagctgttatccagggctacagttatctcaaggattaactggggctggataatccacttccaagttcactcacaaggctgttaaccagcctcggttacttaccccaagggtctttcataggctgttcgagtgtccttatgaaatggcagctggtttcccacagagtaagccatcagacagagagaagtgagagaaaaaagataattaagacagcaagtaaatgagagagggtccataatagaagcttcggtcatttggaatctagtcttagaagtgacataccatcatttctgtcttatcctgttggtcattacacatcaaccttagtcggttgtgggaggggacaatagaaggatgtgaatttcaagaggcagaaatcattggggaccttttgaagactggctactacaggtggaataaaagaaaagaaataacttctaaatactagagataagatatatgaaaatagatttgcaaggattgtctttaaaagaattatagttggaccccaatctatctgagatggctttgttactaaagtcaaaagatagggagctaaacaatgacttccaattatgtaaaactttcaaaatgctttaatactataaatatctgaatgtaagagcggagtactgccatcaagcactcaaaccaggggcttgctgagtttatctgtattcatagatgtagagaagaacaatagcaatggctgctaaattttgtattatccccaccattcccagatggggttatgtgtgcaaagctcagctcctagcttctagtcccactcctggtaggcttcaatctgacatggcacaaatactctagcctgccttgtttattcttaaccttgaccacctcaaccaaggaatcatggtagaagagaaaagaaatacaacatatggtttctgccttcagcaatcttaaaatctcaactcaagaagaaaatgatctcccataccctcaactggaggccttgggaaaaaacagaaactttaaacactgaagaccctagctatccctaggcctcagtttatacagaatatattaaaagttatgtttcaatctctttctctgtattcatctctaaaactacacttaggtagtgatttctagcacaagtggttttgaaaatattttggatttcctaccatactttcagaatgcaggtcatcagtgcagaacaaaatgtgactttgctcacaacctcaatccaataacttcattgtaattgatatgggtaaaccactgaagtagtagataaatttcagtccaccaggagaatcatatttgttcaactatgatgttgatcagattataatagtaaatcatgcactctattggcaagtagatatcatctcatcaaaaatagagaacagcttgaggtagtctgcaatactgctttggtataattaaacagcttcttactgcctaaattggcaaagcacttcatcaatcagtgatctggtccctcggagattgcttttattgtttgacacaaaccttttgtaagacttcttggatgctgctctccctcaggttacaataatagtaactgctgtttctgggttaccttactgtaattttcatgtccagtgatgtctcattatagttgttcttgagggggaatgagtgatggagagtctccaattatgaataaaacacattaaataaaaagagagtaatagcatactcaaaagtagccctaaaaatggttaactatgcaaactaaaggatgattatttaggtagaagaagggaaaggaaaagataagtgacatcttttcactttcataacagttgtgaaagaaatcatctttctaataattttacttattggtaaaagagaaatataatcactcatttttatagtcagtaagataataaattaactctctttaatggaaaaagtttgatgcatatgaccattcattctgagtctaatagtcgtcactatcaatctttatctcctcccaactcaatagtactctcaatatcctacaattctgaggtgcagattcctttttgagctctctcttgatgttaccagaacatatggaattatagtgttgtcaggtgttttcttgttaagataattcattgatatatcttcaaaggagttttttttttttttggtacttttctaggataaagcccctaaacaacatcacccaaaaaattaaaatctttgttatcctttaacagagaattaaatagtttaggatcaagatattgagccccttgggctcacactttgaattattatatttacctggtgaattatgtgggtcttctttttagtttcactttagcagacacttttccccccagggaaagacattgttgatcatagcagtaggtctaattcctttctcatatatttatttttgaggaactccgacagactggcttggccttaaccatagaaagaagtttgttctgtatgatttgtgtatgtgtgtgtgaggtagggggcagtgatgggagagtaggaaatcttgttttatacaaacatgtaagagaaacctcaaatactctagtccagagaataaatgattgatgtcacattttttcctaagagcgagttttgataggtcagaatggagataccatcagaacactaggcacctaaaagggggttatgagaggtcagacagagcaaacctatatccaggatcagtcatgtgttcctctatccaaattctgcctaagggtacacctcccccaataacttacagagaaatttaaaatgaatatttgcaaatactttgtcatcttattacttcaaaactgttatcaactaagtaaaactctttttcatattttttaattaaaaaactctaatttgaaaactaccccccataatcagggcactgtctctaatacctagacaaggcttctatttgtttttcactttccacttcatcctgtaaattcttgccacgctgacagctctgctgaaaacattcaatactaccgttattgtcttctggcatataaggctgttcaaaatttgcccccaaattaccttccaagatttttcatgcactattcccctaacaaaaagggtttcttgccaaccattttattatgtagaaaacacctccccgacaaccgccattcataatgcctcctcgtttatctagaagttacccccctacccctgcactcttctgtcatactttgtttggttcatatgtttgattcaaatccaaatggcctgtatggattttatattttcttatattgtagatgtttatgtatacatctatatctaccatatactatagtaactactagaggacaacaaccgtatcataggcaactcttttatgtgcataatctctgcaggatacctttaccattactaatacttagcaaatgttcgtggaaggaaagcgttgcaagaggtagggaggcaggcatgctggctttttaaaatctaattttcatcaacctctaggtcagtggttcccaatactggttgtttatttgaatcactagggaattatttttaaagagcagtgccacacctaacacctatttgattcaaatctctgggaggtaggatcacagcatctatatgtatgttttaaaagttgtccagataatcctaacgagcattggttcaaagtctagtccccagaccagcaacatcagcattgctgggaatttgtaagaaatgtaaattctgagacccttccctgcatctactaagtcagaaatctgggaatggggcccagcaatatgtgttggaacaaaccctccagatgattttgatgaacattaaagtttgagaactactgctctagagtgttaatgaaagtaggacaggagcagagtgtccacaagaaaatagtttgatgttcttgtgacatcaaatggtcaggtaataaaatcattgcaagaacaaaatggtttttaaaaactgtacaaagaggccgggtgtggtggctcacacctataatcccagcactttaggaggctaaggcatgtggatcacttggggtcaggagtttgagtccagcctggccaacatagtgaaaccctgtctctactaaaagtacaaaaattagccaggcataatagtatgcacctgtaatcccagctacctgggaggctgaggcaaaagaatcatttaaacctggaggcagagcctgcagtgagcagagatagcaccactgcactccagcctgggcaacagagcaagactctgtctcaaaagaaaaaacaacaacaacaacaacaaaactgtacaaaaagcctttaaaaaaataagacagatcttcaaaaaaaatttggtaatcaggctaacatgaaggacggtcttcattgtatagaggcaagatgagagaaacataaatgagaaaagacatgcaggatcctgacaagatggccgaataggaacagctctggtctgcagctcccagcaagaccaatgcagaaggcaggtaatttctgcatttccaactaagtgtaaacaaagtcaccaggaagttcagactgggcggaacccaccgatgtagctgctgtagccagactgtctctctagatccctcctctctgggcagggcatctctgaaagaaaggcagcagccccagtcaggggcttgtagataaaactcccatctcccagggacagagcacctgggggaagaagggatgactgtgggtgcagcttcagcagacttaaacattcctgcctgctggctctgaagagagcagtggatctcccagcacagtgcttgagctctgctaaggaacagactgcctcctcaagtaggtccttgacccccatgcctcctgactaggagacacctcccagcaggggacggcagacacctcatacagaagagctctggccagcatctggcaggtgcccctctgggacgaagcttccagaggaaggagcaggcagcaatcttagctgttctgcagcatctcctggtgatacccaggcaaaaagggtctggagtggacctccagcaaactccagcagacctgcagaagataggcctgactgttagaaggaaaactaacaaacagaaagcaataacatcaacatcaacaaaaaggacatcaacacaaaaaccccatccaaaggtcatcagcatcaaagatcaaaggtacataaatccatgaagatgaggaaaaaccagcacaaaaatgctgaaaattccaaaaacaagaatgcctcttctcctccaaaggatcacaactccttgccagcaagggaacaaaactggatggagaaggagtttgatgaattgacagaagtaggcttcagaaggtgcataataacaaactcctccgcgctaaaggagcatgttctaacccaatgcaagcaagctaagaaccttgataaaaggttacaggaactgctaactagagtaaccagtttagagaacataaatgacctgatggaactgaaaaacacagcacgagaactttgtgaagcatacacaggtatcaatacccgaatcaatcaagcagaagataggatatcagagactgaagatcaacttaatgaaataaagcatgaagacaagattagagaaaaaagaatgaaaaggaatgaacaaagcctccaagaaatatggaactatgtggaaagaccaaacctatgattgattggtatgcctgaaagtgatggagagaatggaaccaagttggaaaacacacttcaggatattatccaagagaacttccccaagctagcaagacaggccaacattcaaattcaggaactacagagagcactactaagatgctcctcaagaacagcaccaagacatataatcatcagattcaccaaggttgaaatgaaggaaaaaatgttaagggcagccagggagaaaggtcaggttacctacaaagggaagcaatcagactaacagtgtatctctctgcagaaaccctacaagccagaagagagtgggggtcaatattcaacattcttaaagaaaagaattttcaacccagaatttcatatccaaccaaattaagcttcataagagaaggaaaaataaaatcctttacagacaagcaaatgctgagggattttgtcaccaccaggcctgccttacaagagctcctgaaggaagcactaaatatggaaaggaaaaaccagtaccagccactgcagaaacataccaaaatataaagaccaatgacactatgaagaaaccgcatcaactaatgtccaaaataaccagctagcatcgtgatggcttgaccaaattcacacataacagtattaaccttaaatgtgaatgggctaaatgtcccaattagaagaaacagactggcaaattggataaagagtcaagacccatcagtgtgctgtattcaggagacccatctcatgtgcagagacacacataggttcaaaataaagggatggaggaatattttccaaacaaatggaaagtaaaaaaaatcaggggttacaatcctggtctctggtaaaacagactttaaaccaacaaagttcaaaaaagacaaagaagggcattacataatggtaaagggatcaatgcaacaagaagagctaactgttttaaatatatctacacccaatacaggagcacctagattcataaaacaagttcttagagacttacaaagagacttagactcccacacaataatagtgagggactttaacacccacagtcaatgttagacagatcaacgagacagaaaattatcaaggatattcagaacttgaactcaactctggaccaagtggacctaatagacatctacagtactcttcaccccaaatcaacagaatatacattattctcagcaccacatagcacttattctaaaattgaccacatgattggaagtaaaacactcctcagcaaatgcaaaagaatggaaatcataacggtctttcagaccacagttcaaacaaattagaactcaggattaagaaactcactcaaaaccacacaactacatggaaactgaacaaccttctcctgaatgactactgggtaaataacgaaattaaagcagaaataaataggttctttgaaaccaatgagaacaaagacacaacataccagaatctctgggtcacagctaaagcagcatgtagagggaaatttatagcactaaatgcccacaggagaaagcgggaaagatctaaaattgataccctaatatcacaattaaaagaactagagaagcaagagcaaacaaattcaaaagctagcagaaaacaagaaataactaagatcagagcagaactgaaggagatagagacacaaaaaaaaccttcaaaaaatcagtgaatccaggagctagttttttgaaaagattaacaaatagaccacttgccagaataataaagaagaaaagagagaagaatcaaatagacacaataaaaaataataaaggggatattaccactgatctcacagaaatacaaactaccatcagagaatatgataaacacctctacgcaaataaactagaaaaggtagaagaaatggataaactcctggagacatacaccctcccaaggctaaaccaggaagaggttgaatccctgaatagaccaataacaagtgctgaaattgaggcagtaattaatagcctaccaaccaagaaaagcccaggatcagaggaattcacagctgaattctacaagaggtacaaagaggagctgataccattccttctgaaactattccaaacaatagaaaaagagggactcctccctaactcattttatgaggcaagcatcatcctgataccacaacctggcagagacacaacaaaaaaagaaaatttcaggccaatatccctgatgaacattgatgtgaaaatcctcaatcaagtactaacaaaccgaattcagcagcacatcagaaagctcatccaccacgatccagtcggcttcatccctgggattcaagtctggttcaacatatgcaaatcaaccaacataatccatcacataaacagaaccaatgacaaaaaccacatgataatctcaataggtgcagaaaaggcctttgataaaattcaacactccttcctgctaaaaacactcaataaactaagtattgatggaagatatctcaaaatattaagagctatttatgacaaacccacagccaatatcatactgaatgggcaaaagctggaagcattctccttgaaaaccagcacaagacaaagatgccctctctcaccactcctagtcaacatagtattggaagttctggccaaggcaatcaggcaagagaaagaaataaaggtattcagataggaagagaggaagtcaaattgtctctgtttgcagataacatgattgtatacttagaaaaccccatcgtctcagcccaaaatctccttaagctgataagcaacttcaacaaagtctcaggatacaaaatcaatgtgcaaaaatcacaagcattcctatacatcaataatagacaaacagagagccaaattatcagtgaactcccattcacaattgctacaatacctaggaatgcaacttacaagggatgtgaaggacgtcttcaaggagaactacaaaccactgctcaaggaaataagagaggacacaaacaaatggaaaaacattccatgctcatggataggaagaatcaatattcttcctatgggcagtgataatgcccatactgcccaaagcaatttatggattcaatgctattctgatcaagctaccattgactttcttcacagaattagaaaaaactactttaaatttcatatggaacccaagaagaacccatatagccaagacaatcctaagcaaaaagaacaaagctggatgtatcatgctacctgacttcaaactatactacaaggctacagtaaccaaaacagcatggtactggtactaaaacagatatacagaccaatggaacagaacagaggcctcagaaataacaccacacatctacaaccatctgatcttcgacaaaactgacaaaaacaagcaatggggaaaggattccttatttaataaatggtattgggaaaactggctagccatatgcagaaaactgaaactggaccccttccttacaccttatacaaaaattaaatcgagatggattaaagacttaaatgtaagacctaaaaccataaaaaccctagaagaaaacctaggcaataccattcaggacataggcatgggcaaagacttcatgactaaaacaccaaaagcaatggcaacaaaagccaaaattgacaaatgggatctaattaaactaaagggcttctgcacagcaaaagatactatcaccagagtgaacaggcaacctacagaatgggagaaaatttttgcaatctatccatctgacaaagggctaatatccagaatctacaaggaacttaaacaaatttacaagataaaaacaaccccatcaaaaagcaggctaaggatatgaacagacacttctcaaaagaagacatttatgcaccagcaaacatatgaaaaaaagctcctcatcactattcattagaaaaatgcaaatcaaagccacaatgagatactgtctcacgccagttaggatggcaatcattaaaaagtcaggaaataggccaggtgcggtggctcacgcctgtaatcccagcactttgggagaccaaggcgggcagatcacgaggtcaggagatggagaccatcctggctaacacggtgaaaccccatctctactatgaatacaaaaaattagctgggcgtggtggcgggcacctgtagtcccagctactcaggaggctgaggcaggagaaggcgtgaacccaggagttggagtttgcagtgagcggagattgtgccactgcactccagcctgggcgacagagcaagactctgtctcaaaaaaaaaaaaaaaaaaaaaaaaaaaagtcgggaaataacagatgctggaaaggatgtggaaaaataggatgcttttacactgttggtgggagtgtaagttagttcaaccattgtggaagacagtgtggcgattcctcaaggatctggaaccagaaatactatttgacccacctatcccattactgggtatatacccaaaggattataaatcattctctataaagacacatgtacacatatgtttactgtagcactatgtacaatagcaaagacttggaaccaaaccaaatgcccattaatgatagaatggacaaagaaaatgtggcacatacacaccatggaatactatgcagccagaaaaaagaatgagttcatgtcctttgcaaggacatggatgaagctgaaaaccatcattctcagcaaactaacacaggaacagaagaccaaacacagcatgttctcactcataagtaggagttgaacaatgagaacacatggacacagggaagggaacatcacacaccagggcctgtcaggggatgggggaaagaagagggagagcattacggcaaatacctaatgcatgcggggcttgaaacctagatgatgggttgatgggtgcagcaaaccaccatggcacccgtatacctatgtagcaaacctgcatgttctgcacatgtatggcagaacttaaagtataataggaaaaacaaaaaagaaagaagagatgcaatctaaaatggatatgaaggttaacaaaaaaacattctgcaattatacacacttaaaggggagagaggaaaatctcatacacactcccaaacatgaaaggaaaaataattacagttgaccatgtaaaagttattgtttttcttttttaatgggttctgggtggtggtggttttatctctgaattttataaaataatttatgtacaacagttggtcttgctgaggtagagtagaaagctagacacattgggtcagggatggaaatggctgctatgtatttttaattactcaatatatttagcattagggcctaatggtgtacacctcacggtcccagagagggagaaaaacctcctgctcttatagaaagaactcaaagctgtgagtcacaatacctagattgtagttctgcttgtgccacttaaccagaggcaaaacttttgttctcacctttctcatctatttaacttgcacataaaagtgcttttcaaagttaagagttctataaaaatatcagtattcctaagtacatgccattcatcattctgttttataccttggaagataaacacaacttcctacaaatagcaaaagggacagtctaatgcctgatgctagcaagaatggaaaggacaaccccaatttaatttgattttgatatacataaaaatactaaaacaaatcaacaaaataatatactcttaatcctctaagaaagtaccaactcctggctcaggtagcaattagaatggcttcttcaagagaaatgacaccaaagaaattcatttcatgacatgataacaggctactcacataaggaggaaaaacaggtaagtctgcttcagctacagttcaaatgattacaagtatttaacatggttaaagaaaaacgaatcaatctttacactctatttcacgttcctcttctcagcctatgacaataattgtttattggtttaagcaaagcttttggctttagccttatgctaaagtgtaagggtatctaaagtgataaatgggaaattaaatattaaaaatttttttaaagttgaagatagttgtaaagtactacacacacacacacacacacacacacacacacacacaacaagaaaccaagtgtaatatattaggaagaactctttacaagccagtattccttcattctaccctagaactaaagactcttgtttggtaattgtacatctagctctggtactctattgaaagttggtccaacctcagacagcaaatgggcatttcccagagacctgtggaatatgctgaactttctgcacttttcccttggggagaaaagaagaatgtggatcacaagaatctgccactttagaaatttagctagatcgaggttttccattgtaatttctgtaggatgcttgcacttctagggacagggcatgtttccacggttctgctgttaaatgaatttgggaagcacttcccactctaaccttgctcccttgaaaagtcacattgcccgttagcttattaaaggctctaaaaattctgcataagcttgtgtaatacaatgtgttcacccacaggatgatttttccccagtacctgtttctatacttttgggatatattagcttaaatgataaggtcctatagagcaagtgctcaagatatgaatcaccaaggctagcactcaaaggacaatgatcattgataaatcattctgtgaatggtgacctaaagtgagtgattagcctgaggcttaagttaaatatttttttaaacatgtggtcttgctctgtcacccaggctggagtgcagtgggataatcaatcatagcttactgtgaccttgaactcctgtgctcaagtgatcctcccacttcagcctcctgagtagctaggaccacaggtgtgtgccaccatgcctggctaattttttacctttatttttatcaaaacagggtcttactgtgttgcccaggctggtctcatactcctggactcaagcagtcctcccactttggcctcccaaagcactgggattataggcatgagccactgtgtccagtctgaagcttaagttattcattgcctctttttaaggtcccaactgaaggtaatgggagcacattcttataacatttgaagatgatactaagctaaatctatgtaataaaaacttcttgtactagccataagataaattcagccaattggacaaaattgagcctttttaacagacccaggaagtttattacacacacaaacactcacatttacacatataagttcagtgtatctatacatggaagctgtaattgaaatgaatgaccaagttttatgggcttgctaattccctggataaaagaataagaattcaaaattataattaaacattaaacaaatagtaaagtagaagaagcaagtatatagttgggatgagaagattagtagctttgtctttgacatttagcttgaattcgcaacagcattgtagacagagtgaagttctcagaaagagacctgaaagccttcttgacttgtctcctatcctttcacatctattccaactattaccaagttttaccagaagcagaatctccttttccttgctaattccgcagccatagcctatgccagaccacatctcctcattcctggacaatctagccttctctaggctccccattttgaattactcttgcatgcattcctgtcaaaataaccttactaaagcaccatttataatattctctagccaatctaactaccatagatctcagtgacctctacgaactaagagtacccatagtatttacaattatatccatacagcttaacatttaaacattctcagatagtttcatttaagttcattttgtctgccttgaggaaaaagagtttgtctcatatttctttgcagttactgtaacacgtaacacaaggtgttcaacatcaatcctcagattcaagtcctacccaatttggactactttaactgtagtagaatattctgatctgtgccaggaaaaggtaggttaccattcattcctttatccattcactcatcagacatttttaaggcaacctccgtatgcaagacactgtgccaggcaatagatacgaagatgtatgtcctgccttgaaggatattgtgggggaatcagacatgtacatcatggtgaggactagagagaagtatgcacgggtgcttcagggcacccaggggagacacttgaaatcagactggaaataggacagaacatcattgtccaaggtgtgtttcccagagtgctagtcctgtaagattccccaaggaaaaaaaaagttttatggtcaaataaatgtgagaaactctgatcactgtcactccctctcccaaagagccacaaagcccattagcatgctaatgcctaagaggagtcctgcagtagaaacctgtgggaaacccagggtatgaaatataaaattcctaaccatcaggagaaaagtagtagttgaaaccttctggatgggtgaagtcactgaggaattgagggaaaagaacagaggggccagccacagccaaggatgagaagagtatcaacatttaagtgtggaatggaaaaagagtggcccatgagggaggctaagatgaactggccagggatgtagaaataaatccaaaacaaaacagaaaaccaggatcagagggagaggatagaatttcaaggagggtttggccagaaacatcagagccccaaatgaaaaactggcatgtccactggatttagcaatcaaggggttattagagacgttggtgggagtgttatcagggcaacattgggagggagggggcttgcagtggactgaggctgtgaggaagtaagagtaataagtatagactggccttctgagaaatgtggctatgcagggatgggaataacatgggaagggacagagagagatgcggtgttgaaggagggttatttggcaatgaggagatttgaaactctttgttatattctaaggggaaagagccaaatagagaggaaaggttaagacaggaatttgagggaagggtgcctaattagactcagtaactgaaaagacagcgaggaggggaggtaaatcacagtgaggtggaattagccacagacagaaagagggcgaccttttctactgggcaggaacaaagaaaaaagggtaggagagagaaagttattagtaatatcattaattcatatttatgaggacctgctctatgccaggcactgtgctaagtggtttgcagagtgttgagaaaggcagtctcgtgcagtctctggatccccgttcagccacataaggatgggcttgagcctggaacacttcctaaccaagagatgaaccgcctacgcagcctgtgctgggcttatcaccttgtgtaggagtatctttccctgttgcagactccatgaatattcctggcctctgctgacgtgtgtatctcagtggccctcagacgcatcccaggctttcaatatttcagactccacacaggagaaggaggagtcctgcctctgtgataggtggaaggagtgcacataggcacattgttctgctggaagagatggtctagccacgggggactgaggcacactgttgcagttgatcttgcactgtctcttcactgtctatgtaacataacccttcactatgtaaagggttatgttatgttttccttggtaactcctgtgtcaaggtgcaatgggaaaaagtggagtactcctcttgaattagtgcacagtattccactcaacacataggttgtcccatttaatccttacagtaatactttagggtaggcactaatatcatcccaattctacagatgaagaaagagcagtaggtctaatggagtcaagatacaagtcaggtaaagaaagatttcttgcctagtgagtactttcttagaaagaagctcttccttggtgttatcaatttttctgattgaagtaattgaaggaggaagcaagactatttgctgagagtgaggcagggaggtggcaagggaaggatgtctgaggaacggaacagtcacgattggaatagttgcagaagagaatgagagagtgtgctaagtaaagacatacttgagaacctagccaacattgaagcacatacttcagttgaggcttcaatttctatagtttgtgacaccccgcccctgccacccccatctgctatgccaggatctagttaggaaggctgggaaaagatagactgagacttgcagggttttacaaagaagcatatacatccttagaaatgactaccaatatatacaagatgattgatcccagatgctctactgtagatataagcaaagtactgccagggtacagtggatggagagggattcattctgataggaaattagagaaatctgaggatatggataacatttaaacttttactagtgtaaaattttagcagttttcaagcctgatctactgagaaatgaattaacatcagaaaaggaagagcatgtttgcaggggaaacaataagttcagttttcagacattgattttgagatgcctacagttgtaacacatagaaatgtttagatttggaagttaccacctacaggtagtagttcaagcttcacacatgaagttgctggcatgcagagggagtaaagatatcataaagctatctcgcaacctcatcacagataaggacagatacaagggtaccactaggcaccagggcagagttttctggcaatgaaatcaagacagaagaggaagaaaagcctgggatgctttcgggcatggagttggtagagggttactgatgtaggtagcccttaggagtgattaggagattgcaaaagaagcgtatgaaggatttaagattaaggaagggaggggccacttggaggaattgcaaaaacaaagtttaactttatttttctttttacaagcttgcctggatccagccttgcagaagattatagcaaaagtattgtgggctcaatggcaaggtcaagatgactgggcaaggccctgggaaatgaatgctaacttctcactgttttttttttttttttttacctttctgctgccttcaatgtactttattgtacagtgctctcccactcccagagacattatctcgcatgtccctctttgccctcaaaatctatttttttttccctttgagacagggtcttgctctgtcacccaggatggagtgtagtggcgcaatcacagctcactgcagactcaacctcccaggatcaagcaattctcccacctcagcctcccaagtagctgggaccacaggtgcacaccatcatgcccagctaatttttgtatttttttgtaaagacaggtttcactatgttacccaggctgatctcgaactcccgtactcaagcaactccccacctcagcctcccaaagtgctgggattacagacgtgagccacagcgccgggccccaaaatctattttaaatgtaaagaaacccaaaagtaacagttttgtaaaagaaaattcacgtactgttttgtagtaaattctaaacactgtgtatctttgtgtctagttaaatcctaggcttacagctaaacttcaatgagaaggcaaccaaagaatacgttaggaattaacccctggaagtaagaccaggcaaaaggcacctcaaccatatctgctaagtgtataaagaattgatagttaggtgccacatcctttatctacatttgcacctacacgtgaacctagaccttatttatcaataccactcatcataatgaaataaggatacagtgatacaatttcaacactgtctaaaagaactcaggctaggtgcaatggcttacacctgtaatcctagcactttgggaggccaaggcaagtggattgcttgagctgaggagttaaagagcagcttgagcaacatagtaagagctcgtctgtacaaaaaataaaattagccaggtgtggtggggcacacctgtgatcctagctacctgggaggctgaggtaggaggatcacctgagcctgggagatcaaagcttcagtgagccatgatcatgccactgcactccagcctgggtgacagagtcagaccctttttcaaaaaaaaaaaaaaaattgtagatggagagcaagaggcaaaggggagcaagaaaaagggaaaacaagaaaggaagggcctccttcactggctgcctttgtcctgacacctcctttatttgagttactaacatggggttccagaaggtatttttccataaaaaaacattgaaatcattagctgaactggatagtctactccattatgtcttggataggttctgaccttcacacatggccccggagaataagaaactgaagaaagcagtttttatggcaaaaaaaagaaatgtaacgaggaaggacatatctggcttggtgagccaaggttttgcatgagagacagctttggcagaaaatatgtttggctgcatttttttaaaacccaaatgaaatagctttattttactaagtcccttgggtaaaatgtgtatgtttttacaatatatattacctacactattaagtagaaaaatgtcagtagcaaattggcacagcttcttagactcctaatatgtatgcctagtgttccattattggaatgctaagcttgtgggagttatttatatcctactgctcaagatcatcgccaagttctgatttttcacacacacaaaaaaattgcaatctccagcataaataggttaatggttaatatctgggcatagctgaaaagtagcaaaacagatgctgttttcagattttttattttgattagtagcatcagggaactggtatggtgagggtggttggggttcagaaaaggagaaggaagctgaaaggggaaagaaacataaatacatgagatgataattgagagattcaaattttctatattttctgtcttttgaaagagacagaatttaaattttatggaatttcattagaatttttttaatgaatgcagaaaaacaccttaaacaccttaaaacatatctaggctgacccacagaagagtaaagccatcctgtcttttctctgtatctctctgacacacacacacacacacacacacacacacacacacatcaatagtttctgaggatcatttttaatttatttttatttctagcatacaaaagcctaggattatactcctttttatgtgttttagaagggtgaggtgcaatgttaaggaaattaactcaataacattttacctgctaagtgaaatacaaaatctacccctacgattaatagtttatacttttttgttgtcttgcattacgtggataagtaaggattttttccaaaaaaaagatatgtgtagtttgagaccagcatgggcaaatgacaaaatctcatctctacaaaaagtacaaaaattagccaggcatggtggtgcacacctatagtgccagctactcaggaggctgagatgggaggatgacttgagcccaggaggcagagtttgcagtgagccaagattgtgccactgcactccagcctgggcaacagagccagaccctatctctaattaattaattaattaaaatttaaaaaaatatatatgtgtatgatatgtatggaaatcagtacgttggcgagaatgaaaaaaggctgcacattttcagggagccaaaagacagagagcctgagaataaaagggggactgagctggtttcagctgcaaagccagcaatcatttcagacaatagtctgctctttcagctgaaaatacgggaaaaggagtggcacaaataaatgccctccttgactgtccaaatatctgtaagataattaaagtatccttcaccctttttaatgggagcccactgcttcgctctatgtaaatgaagttaggatcctttcaaacaatacaaataggagaaggagatcatatatatattgtaatattatatcatacatatattacgtagaatgttcttttctgattataaagcaattcatgagaaaaatattaataaaatatttaaaattaatgatcattttagaaaaaaatgggcatacaaaaagattaaaaagaaaataaaatatttatattattagtaaaattaaccattttttaaaatttttaaattttaaaattaaaaaatttaaaatttaaaaaaattttacttttaaaattatttaaatatatgatctgaatttatattgtaattctactacccaagagatatgctgataatattttgctgtatttcttcctagtaatttttctttaatgctacactatctttgcctaggacaagaaagtactcccatttgatgctttcagcactgctagacagtaaatgaattaaaaacactaaaataaaagagacagaaacagtaattgcacccaactgaactgtgggaagctgtaccagcctccacaactaagtattcgaagaaagaaaacagttgtgagaaatcagcacagtgctgtggaaagaacacacagaagacttggtcctagtactgtcttactgttacttcactccatgaccttgggaaaaacattttccttttctaggattcattttctttatctctaaaataggagactgcagctcagcagatgcacaaacattataaggtattttgccctttgctggagactaaggatgatgggcaggaagcttctaatctaatctagtaggttttgcaatttagaaatgaaaatttaggtaaaattttatgatatccctgaaatagaccctgaagtttagaagaagataattttcaaattcttggcctaatgaagtggacaaaatgctaccaaagttcctcagactctgaaattctgtaatttattgtcaccaaaagtcaaatgcctagaccagtgttgatcattctcatgctgagagtaattagtgaatttgttcagggtctggggggaccccaatttcaaagcaaatggaaaccagagatggttgttctgtcaatccaattgtcactttatagtccctaaataccaaaggctaagctttggcaaagttgggcagtaaaaatctacccttactgcaaatctttctccttttgatccttctctccccaatcagttctatttcaatccagaaagtcagcaactttgaactttctcttccgtctgtgaaaacctattggtaagtggtagatatttacagcttagtaaatacataagtgtttctaaatatctaagtgtttctcccaaggatatttatgttaaagttttatatctaattttctaataaaagttttttctccctattgagggaattgttttccatttatataaaattattttaaaattatttgtataaatttaaggggtacaagtgaagttttgctaacatggatacactacctcctggggaggtctggacttttagtggaaccctcactggaataatgttacaatgtacccattacgtaatttctcatccttcttcccctcccctcccacccttctgagtctccattgtctattccacactctaagttcatgtgtacacacactacttagctcccacttatatgtgagaattttatgtttcacgatgagtaggtggagaagatgtatttagggagtaagacagaggactttcttaggttccctaaattcatacgagatatggggaacctttgtccaagagtattttcaaattctggaacaatgaggattatgtctttaatatgggcctttccccaaacaccactaataaggacctcttcctccctctacttggagctacatttgaacatagtttttaacaagttacaaaaacactacccccagttactacaagccctgaatgaaatgtaatagccaagaatccttttaaggattgggtgctgggattgtttgctttctcttctctcttttcttttcttttcttttttttccttcgacagggtcttgcactgatgcccaggctggagcccagagcacagtggcctgttaccagctctctgcaacctctgcctcctgagctcaagcaatcctgcctgagtagttaggaccacagacatatgccaccatgcccagctaatttttatattttttgtagtgatggtgtttcaccatgttgcccaggctggtctcaaactcctgagctcaagtgatccgcctgccttggcctcccaaagtgctgcgattacaggtattaaccatgtccggccttgctttgtttctggtttatagtgagactgaaaaaatttaaggaaggtatctcaatttaaatgaattactaattgaatgagtgatacatttacagataaatgattcttctacatcaatgctgtccagcagaacttctatgatgatagaaatgtcctataactgtgctgtctagtgggtaaccactagccccatgtgcactagaaaaatggcacttgaaagtcagaaactgaatttttaatttttattagctttaattaatttaaatctaaatagctatatgtggataatggacatcatattagttaacacagttctagatgattctgtgcagaggctggttggttgccaaatatattattctgaccctgacaagggaaccccatccaagtagagtgattcacctttttaatctcaggtctattatattagttatcaagaccaaggctattgctattaacaaatgagaaaatctatagaattgccatggaaaccctattggagaaacacaggtttccatgtcaacccctgtctaggataccgctacaaaatgccctataagcaaaaacttctgaaaccacaatgttttctgactaatggaattaggagactgcgacttttgtccattgttcttaggcaaggcatttggggcccttccaagaagtagtctgaatatctgttataaggaaagaaaatgatacagtgtctaaaggcccttgactgaaaaatttgttttttgataaatatgtttttatctaaaggctctttgtcagaaatccttccttgggattatgcttgctgacttttctgatatgtttctattaagaaaaaaaaaaagaaagaaaaggaaagaaaaagcagaaaagatgaaagaaagcttcccatcagtgtttcaaataaagaagtttatgatgagatgttaccattgacccttaatttctgccccgtttgaaacactaagggagtccaaccattgtccatgccccttttggaatggttgtgatttccagggccttggttaactattactcctagcccaaatcctggtgagctccactagctgcagaggccaccatttgcaagagcagatatgcagaagatccctggccagcctcctcatacctaccttcattgctatgtggagacaatagaatcattaaaagttatgggctggacatggtggctaacacctgtaatcccagcactttgggagaccgagatggatggatcgcttgagtacagcagtttgagaccagcctgggcaacatgatgaaaccctgtctctacaaaaaaaaaaaaaaaaaaaaaattagccagccttcatggcacatgcctgtggtcccagctactcaggaggctgaggtgggaggatcacctgcgcctgacaggtcagggctgcagtgagccaagattgcaccactgcactccagcctgacagagtaagacaatatatcaaaaaaaaatttttttcatagaccaatggaacacaatacagaacccagaaataaactcaaatacttacgggcaactgatctttgacagagcaaagaaaaacataaagtggggaaaggacacccttttcaacaaatggtgctgtgataattggctagccacatgtaggagaataaaagtggaacctcatctctcaccttatacaaaagtcaactcaagatggattaaggacttaaatctaggacctgaaactgtaaaaattctagaagataacattggaaaaaccctctagacattggcttagacaaggatttcatgaccaagaacccaaaagcaaatgcaataaaatcaaagataaatagttgggacttaattaaactaaagagcttttgcacagcaaaaggaacagtcagcagagtaaatagacaacccacagagtgggagaaaatctccacaatgtatacatctgacaaaggactaatatccagaatctacaatgaactcaaacaaatcagtaaggaaaaacaaacaatcccatcaaaaagtgcgctaaggatatgaatagacaattctcaaaagaagatatacaaacggtgaacaaacatatgaaaaaatactcaacatcactaatgatcggggaaatgcaaatcaaaaccacaatgcaataccaccttacaagaatggtgataatcaaaaaatcaaaaaacagtaaatgttggtgtggatgcagtgatcagggaacactcctacactgctggtgggaatgtaaactagtacatcctgtatggaaaacagtgtggagattccttaaagagctaaaagtagaactaaaatttgatccagcaatcccactactgggtatctacccagaggaaaacaagtcattattcgaaaaagaacatggacatgcatgtttatagcaacacaatttgcagttgcaaaatcgtggagccaacccaaatgcccatgaatcaacgagtgcataaagaaactgtgatataggctgggcacactggtttatgcctgtaatcccagcactttgggaggccgaggtgggcggatcacctgaggtcaggagtttgagaccagcctggccaacatggcaaaaccccgtctctcctaaaagtacaaaaattagccaggcatggtggcgggtgcttgtaatcacagctactcaggaggctgaggcaggagaatcgcttgaacccgggaggcggagtttgcagtaagctgagatcgcaccactgcactccagcctgggcgacgagagcaagactccatctcaaaaaaaaagaaaaagaaagaaactgttatatttatatatataaatatatatatttatatatatttttatatatatataaatatatatatttatatatatataatatatatgatggaatactgctcagccataaaaaggaatgaattaatggcatttgcaatgacctggatgagactgaagactattattctaagtgaagtaactcaggaatggaaaaccaaacatcctgtgttctcactgatatgtggaagctaagctatgaggacgcaaaggcttaagaatgatacaatgggctttaggggacttggggggaagggtgggagggggcaagggataaaagactacaaacagggtgcagcgtatactgctcaggtgatgggtgcaccaaaatctcacaaatcaccactaaagaacttactcatgtaaccaaataacacctgtacccccgtaacctataggaaaaaaaattaagttataaaggtatatttatttctatggttaaagaaaaaattccccttgttatagaaaactgaggtgtctggaaaagaagcctgagacttggctgccctggggaaggatcctaggcggctgtggttgaagaaacttacatgaacccacgtccttggcaagagtgcttggtttcctgaattgttaggaaagttgttgagaaactgaggactgtagtgaagggagaatatttgttttagacaataacagatgatagtatgaacaaaaacaggtggtggcaatcaattcctagtcgggagcccagagaaaggaatccacatttggatcctgtctcagtttaataagattctttgaaatgtagcagagaaggctcctgttgccttcagtaaatggcttgcttgctttttttcccactcaaatctatacagtataagcttttggaccttgctttccatactatattagaccaaaagttgcacttagaaaatctccatcttatacaatctcctcactttaagtgagaaaacaaaggtgcagacttgccaagcgtcaacccgttattactaaaattcctgtcccagagcttacttcatatgacatgaagttcctgtttccacaacagcagccaaaccctatctgctccctgtttccttctcctttttgtaatgaaatgatagaagttggggactcgaaataattttcactgagtgtatataaccctcagaacctttattatgcttcacttcaacaaatatttactaagtaactacaatgtccaagccttagcactactaagttgttgttcctccagcagataagggcctcaaacatagttgcagctaagattctctctaaaggtttatttcatctccacccaaaacaggaaggcctgggaacttgtaccaatatatttctttctttctttctttttttaagatggagtcttgttctgtcatgttacccaggctggcatgcagtggtgcaatcttggctcactgcaacctctgcctcctgggttcaagcaattctcctgcctcagactcccaagtagatgggactacaggtgcatgcagccacgcacagctaatttttgtatttttagtagagacagggtttctccatgttggccaggctggtctcaaactcctgacctcaggtgatctgcccacctcgacctcccatagttctaggattacaggcacaagccacggtgcccagccaatatatttctttaactcagtacagctaacacatatttacttatcatccttttctttctagctgattacaggtttcctcttttcttttttgtcttcctggtatccttgtctgttccctctgtttaaagttttgcacaaggttctgggaaagaattgaggaatgcttagggtgtgaccccacaagccaaatcttgcacagtttcagtatatggggattaagaaaagatgactgattcttgacgttctggtctgactttgggcttggttcgagagtgtggggattctagtgtaatggaaaagagaatataactaaaagtggtgcagatttgttagtctaaaatctggtccctgcttagagatactctgattcctctcactgctatggaacagacacacacacccacacaccaccccagctgatgttgtcacactcacacacacacacaccaccccagctgatcttgtcacacacacaccaccccagctgaccttgtcacacacacacacacaccaccccagctgatcttgtcaaacacacacacacacaccaccccagctgatcttgtcaaacacacaccaccctagctcatcttgtgtgtctctctcacacacacacaccaccctagctcatcttgtctctctctctctcacacacacacaccaccccagctcatcttgtcatacacaccaccccagctgatcttgtctctctctctctctctctcaatctcacacacacacacaccaccctagctcatcttgtctctctctctcacacacacacaccaccccagctcatcttgtcatacacaccaccccagctgatcttgtctctctctctctctctctcaatctcacacacacacacaccacagctgatcttgtctcacacacatacacacacacaccactccagctgatcttgtctctctgtctctctctctcacacacacacaccaccccagctgatcttgtctcacacacacacacaaccgcagctgatattgtctcacacacacacacacacacacaaccccagctgatcttgttatacagacacaccaccccagctgatcttgtcaaacacacacacacacaccaccccagctgatcttgtcaaacacacaccaccctagctcatcttgtgtgtctctctcacacacacacaccaccctagctcatcttgtctctctctctctcacacacacacaccaccccagctcatcttgtcatacacaccaccccagctgatcttgtctctctctctctctcaatctcacacacacacacacacaccaccccagctgatcttgtctcacacacacacacacacaaaccactccagctgatcttgtctctctctctctcacacacacacagacacaccacctcagctgatcttgtctcacacacacacaaccgcagctgatattgtcacacacacacacaaccccagctgatcttgttatacacacacaccaccccagctgatcttgtctcacacagacacaccaccccagctgatcttgtctcacacacacacaccaccccagctgatcttgtctcacacacacacacaccaccccagctgatcttgtctcacacacacacaccccacaccagctgatcttgtcacacacacacacacacaaccccagctgatcttgtctcacacacacaccaccccagctgatcttgtctcacacacacacaccaccccagctgatcttgtcacacacaccccaccccacaccagctgatcttgtcacacacgcacacaaccccagctgatcttgttatacacacacaccaccccagctggtcttgtctcacacacacacaccaccccagctgattttgtcacacacatacacaccaccccagctgatcttgtctcacacacacaccaccccagctgatgttgtcacacacacacacaccaccccagctgatcttgtctcacacacacacacaccccacaccagctgatcttgtcacacacacacacaaccccagctgatcttgttatacacacacaccaccccagctgatcttgtctcacacacacacaccccccacaccagctgatcttgtcacacacacacacaaccccagctgatcttgttatacacacacaccaccccagctggtcttgtctcacacacacaccaccctagctgatcttgtctcacacacacacacacacaccaccccagctgatcttgtctcacacacacaccaccccagctgatcttgtcacaaacacacacaccaccccagttgatcttgtctcacacacacacacaccacaccagctgatcttgtctcacacacacacaccaccgcagctgatcttgtcacacagacacacacatacaccaccccaaccgatcttgttatacacacacaccaccccagctggtcttgtctctctctctctctctctctcacacacacacacacacacacacacacacatgcataccaccccagctgatcttgtgtcacacacacacaccactgcagctgatctcgtctcactcacacacacacacacacacacacaaccaccccaggtgatcttgtccttgtctctctctcacacacacacaccaccccagctgatcttgtcgcacacatacacacacacacaaccacaactgatcttgtctctctctcacacacacacacaccaccccagctgatcttgtgtcacacacgcacccacaaacacacatacccacaaacacacatacccaccacctcacctgatcttgtctcacacacacaccaccccaactgatcttgtctcacacacttgcactcacacactccatcccagctgatcttgtaaacacacaaacataccatcccagctgatcttgtctcacacgcacatgcacacactcacacacacaccacccagctgatctgtcaagccagactttctcttcagctcttgccctcctcctcccaaactttcttccttactctctctatccccattgtctccaccctaatacaagtcaccctcatttttttgcctggattctaggcaggtcccagtagccttctgactggtctttgccatctattcttttctctctttgatcctttctccattttgcactcaaactgacctttcaaaactatgttgcttcctggtgtgtgagggtaatgacccaaatcatgaatggggcctacaaggccatgcacaaagaggctttcacccacctgcttagctttctcactcttcattggccacccacactggtggtgctaccctgaacactcttcccctgccctcaacccctaactccagctcctgccctcactcttcctttagcactcagttcaaatgtgacttcttcaaagaagaattcctaatactccagactgttagctgttcccctagcatcttcacttctttacactgcctattacagttgtagttatgtaattagttgctgtttaaacactgtgtccctagtcagaatataaactttgtgaactcagacgctatggctgtcttgttcactgctttgtccacagcatttatcccaatgcccagcacacaatggggttcattaaatatttgatgaatggatagcaacattcatgttgtagagatacatatggcctcttctttgacacgtgggttctggaacagaaagaacctggcctgtcccgtatcgtattgttattcttttaactttggtttggtttgattatttttatcctctgtgtttttacattttgttttgtaaaggcaagaaagaaccctcaagtggattgcctctggcagttggagccacaccggtgttctcagaatacaccctgtcctttccaatttccttcatatgcggtaaccaccaacagtcttggagtaacaagtcttaaattctgattctcagtcggctaaagtaagatcccttgtggccccaaccacacgccactttctctctgaaagcctatctgttcttgtcagaacttctctcttcttgctaaagcatttcactttcacctctgtctaacagttatattttctagctttttattatagttgttttgatacccatctacccaacctactaaactctgtgctgtctgagggcaggtacactgaactgttaaaatgtctgaatcacctgtgtattctcagcatctagcacaatgttaggtgtttattaaacacaattaaatttttcattagtatagtagcagagtgactgggctaaagtcctttagttttattgtttccattcatcaattccatcatatattctccctcgcttccaccaagaagtacagagaataaagatcctattttcttttcccttcctatgaaaggtttccaagattactgagaaagaagaaagtactgaggagccttatgtaagtagagaacaaagagaataatgccaataaatacatatattgtttaaagccctgcagctcttcctcaaatcagatgataacaagttcagagtgccaggagcatctggcaaagggcatctgctgaaactgatgtctcagaagaaaaaaaaagaaagaagaaaaagcaatagtctgtgtagtgataaatggaacattccttattgtcgattcttagaaagacagtaccatacattgtatgctttatagtggaaattatttttcctaatgtgtaaacatctaaaaataatatattcagcccaggcgctgtggttcacagctgtaatcccagcactttaggaagccagtgcaggaggattacttgaggccaagtgttcattaccagcctgggcgatacagtgagaccatgtctctacaaaaaaaaatttaaaaattagccaggcacagtggcccatacctgtagtcctagctattcaggaggctgaggcaaggagaattgcttgagcccaggaggttgagaatgcagtgagctatgatcatgcaactgcactctaccctctaccctgtctcaaaaataaataaataaaaatagcatatttactgaaagcaaatatacagacctggaaatataggttctaaactcatttcttcctctgtctagcagggtgaccttggtcaagtcagattatcatctataggtagttgtgctgcatatggggcctcttgttacagatttaaaaatagaaaccctcctaaagcaaattccttttatttaaatcagccctcatggaaccaaatgttgtcatgggaaggatacagtcaggccatgactgtcaatgagaaacaagattgatgccattattgaagatatgatatgatatcatatctagggaaacaaatcttcttatcagttgttattaatttccattcaggtgtttctctgttttcttcagttcagctggtacctattaaaagcttgttactcaaaagaaataacctaatatggcagaattgtgcctcaggaaacctgtgctttaaatctgactgtactactacaagctgtatgatcttagacactttataatagtgacagttgccacctactgagcatctactctctgctcactgtgctaggccctttacaggtgctatttcctttagttctcacaaagcccatcatgataaatgctattagcctcattatacagataactcaaatgttatttgaagaagttaagtaatttgccacaggtcacatagctggtatagtaagtgagattccaaagtccttgctttttttccaaaaagcaagtgcttctttccaaagtgcttttttgtgaagagtcctgggggaattctttactcaaatttttccaatcataaagttaggggatttagttacgtgacctgcaggagtgatagtaaataaatgtaacttttttgttgactttttataatggattttttttttttgaaacatgatatcactctgtcactcaggctggagtgcagtggtgtgatcatggctattttttgtagcgaccgagttttgctatgttgtccaggctggtctcgaactcctgggctcaagccatctgcccacctcggtttcccaaagtgctgagattacaggcatgagtcaccacagcaggcctataatggaaaatttttatcatacacaagaatagagagactaattcagtgaccaatcccacagccacaaaaatcgtcacttcataaccactcttatttcatctatacccattcacttttccctttacctcaacacccaatggattcttgtgaagcagtccagctatattatttgatctgtaaatattttagtatttatcatgaaagggaaagaccttttaaaaacataatcctgatccttttgtagttcatgagcgtgatgattgggtgttcacatgcatgtgtgagatgtgccgctgttgaaccttgttatgatgtcagcacattacccgtctgacaagaaaaaataccaatactattagcataccttaaaaattaacaagaattccttaatatcataaaatatccaatgtttgtgtttctttcattttctccttctaaaaaaatagcttaatatattttaatagcaaacttacaggaatagcacagaagacagacaacattaaaaacctgtacttgcatgtaggacaactcagaaaagtacagtgaatgcacagaatcgactgtattatcaaatgctaccaacattatttagttgccatcaataagaaatttgcttgtttttaaaaagtccaaatgctggcattgtccagaacattttaacaggtttatttatattgttataaagttgaactgctggccaggtgtggtggctcatgcctgtaatcccagcattttgggaggctgaggcaggcagattgcctgaggtcaggagttcgtgaccagcctgggcaacatggtgaaaccctgtctctactaaaaaatatgaaaattagctgggcatggtggcgggtgcctgtaatcccagctacttgggaggctgaggcaggagaatcacttgaacccaggaggtggaggttgcagtgagccgagatcacgccattgcactccagcctgggtgatgagaaactccgtctcaaaaaaaaaaaaaaaaaaaagttgaactgctgaaacttgttcactgaaacattttgacttgcattaatgctttgtgtccttgcatttttaaaatttgttattgatacacaatagttgtgcatatttttatcatacatgtgaaaatttgatacattcatataatcaaatctgtgtccctgcatttatattaaaaattcatacacaaatgaatatggagaaattgccaatacctgatttctgtcttctgtttttccacttgcaatcattgtatgtaggtaccatttgacctcatgggaaaaagaaatctaacattcacaactaccagtgtcaggaagaagagagagagagaagaatgaaatgttttccagcacagtgaattcttaagcatgttcttcacatatgtggtgtgctagctggatgtcttttgccataattgttacacatttggcatagaggacacataggttgttatcttcaaaaaggccagccaaataggcctcccttgcctccacaaagcaccaatagctgtgctctggaagcacagatctgttttgaagtcctgagaaatttcttgcaccaggtgctggaagggaagtttgcagatcagaagcttatggacttctgataatatttaattttatagagtaccacagtaccagtgcagcagtacctcaatgatgaagtttcttcagcactccagtagagggtgaactcttgcaggtgacttttgtatccagtgacttcttgaatgctttaccactgatagatttgtaggccatagtatagaaatctttctcacctccttctccttccactggagctcagtgagctagaggcggcttgtaatctctctctctctctctctgacaatttggtcattaaagataatttaagattttcttgaagtttttttttttttttttttgtatcccaaggtagtatattccactaggggtatacagccaaattactgtgttctaatatcactgataatcaaaatattaaaacagttagttaaaaccaatcagaatggacagccccctgctatgatctaaccctttagttattggaccgtaaagatgaggggtgggaaaggtaatatctcagggcagcagtagttcaccaacctatatgttgtttaacaacccaacattatttcaatgttttgttttgttttgtttgtgacggtgtctctgctctgtcacccaggctggagtgcagcagtgtgaacacggttcactgcagcctcaacttcctgggctccacctcagcctcccagtagctgagactacgggcatgcaccaccacacctggctaattttttgtagagatggggtttcaccctattgcccaggctggtcttgaactcctggcctcaagcgatcttactgccttggcccccgaaagtgctgggattacaggcgtgagtcaccacacccggcctgtttcaaaaactgggaataccatcctctgcatactggcttgttacaaaccctggtatctttaagttccattctagctccaataggaatgtaaatagtcacttaatggagatacccttttcctgcttccttacactactagtctttatatacataaacacacacacatataaactttacaataacacaaatgattattttctataattctggaagttctggcaagtaaaataaacaacaaaatagaaatatgagttatgactattaggaaacaaaattattagcatttagaacaaatataattagatacctaaaacaaaactaacaaaaaattagaataagcaaattatgagtacaaacttgtaggccaaacaagtctaaaaatctattgtggtggcgccagctacagtgctagcagacctggatcaattagtaattataagtgaagttaaatataattaaatatataatttaaatataattaattatataactttcagctcttctgatttaattccactaaaattcttaagaattacttgctctggcagatatctgtgctattgccttcactaatagcactctttcctaaggagtaatagccctatctcccaccaccatccacatggctgcagccagaaattttctgtgtttacgtgatccttctttcctggccacacttgataaatcagggataggcgcacctgatctaagccagtacaataagaggccttcctctggatttttcagactggaatgaagaaagagagacagccatatggttcttaaaggacactgacccaaagagctgtaggtaatcatgttttctgcttcgggcagattctgtctcagatgaagctgatatgcagagacgggccaagccagttgtcaaagggaattctgatggcaatggggtttctgaggtagaactatagttctgcttatctcttggtttggctttttaacccttttttggaacccataagccaataatttctcatttttgccaaagaaattcaaattaggtttctatcacttgctgtcaaaagaattcccacttcattgacaaaaggaaatgcatagaataaattttccacaagtaacagatttatatttgaggcatgttcattttattgtatacaaatcttttcaattccctcactattatcaacttttaaaaatttggaatgttcacggttttttgattatgtaatttaaaaaaaaacttggactttcagggtctagggtgtggtaagagaggcaggagataagtttggaaaggtaaactgagattagaatatatagggccttaaatgtcatgtgaagtttagactttatcctgcaggtaatggggatccatttggcaagttttcaagcaggagaaggatatgtttagataaataattctggtggcaatttggagcttcaataaaatgagggaaaaatgaaaacagcttaataggtgcttgtgctggaaacctaattacataaagattattccaggtgtccaaggcagggttgatgaaagaatcgcctaggaaagttacgctgaaaattgtcgggaaatggaaggattcaagagacatttgaaagacagaattggtactattgaatgaccacttggacacaggggatgaaaatgaggaaatatagaaggactatgactagatggggatgccatcaacacaagaaaaggaggaggaacagatttgagaagacactattcttactgagtatcaccactcatttttatgatacttctagcaggtatggagctaaaacgtatgatgtcccattgtaacactcatattatatcttggcaggttgtttgtactttattggatttgctgcataatgtaggatgccaaagtaatcattacgttctggaacttaggagtcctacttggtctctgatgaggaaggcattaactgtgatttctgtcacatgctggtgtgtactgatctgggagaaatctttgatttaatgaatagaattaaatgtaattatagccaacttaaaattctgtatatcacatatagagaataccattaactcattgtctactctgccttcctctactttcatgattaagggcagaggagttaaaattttatagtgaaataaaattggatagatatgataaagtaatgggaggcttacattttcaaagtaaatatttctgtgttcaaagcaattcatcagagggccactttccctgtactttccctgaagaactaaaagctcttgtccacctgatttctaaagcaaaattatcaaatgccagcaatgtaacttgttctgtgttaaaaacagaactagacacagtccttatccttgaggactagctcactatcattccagtattttttggaaagtgtgaaattcctatttgcagatggtgactttgccaaaattgaaaccttagtagctcacatacacttgtgtgagtacctaacatctttataattctgacaacactaatgagctacaggaaacactggccaaattctgcttggtttggtttccattcttttgcactgaccaataaaaatataaagcaagccacatttgtgattttaaattttctaataaccatattttttaaaagtaaaacatgtaaagtacattttaataggcttttttaaaaacttatttttagagcagttttaggttcacagcaaaattaagaggaacatacagagacttctcatatacccctcgcccccacacgtgcatagcctaccccattatcaatatctcccaccagagtggtacatgttttataactgatgggcctacattggaacactcaaattctgtagtttactttagggttcactcttggtgttgtgcattctatgagtttggagaaatttgtgacctatatccagcagtatagtatcacacagagtagtttcactgccctaaaaatcctctgtgctccacctattcatccctccctccaccctaaccccaggcaaccactgatctttttactgtctccagagttttgccttctccagaatttcatatgggtggaatcacacagtatgtacagccttctcagattggcttctttatgaaattaattttcatactgtattttctttaaccaaaattgtttaatgtgattactttaacatgtaatcaatatttaatattactaattaaatactttacattgtcttttcatactaagtcttctaaatatacaccagatacttatctatctatatatctctctatatatctaaatatatagatagatagatatgtatctggtatatatctatctatatatacaaaatctggtaaatttacaccagattttgaagacttacagcatatcttgattcaaactagccagatttcaacttgatcaccacatgtgactagtgactactatattagatagtgcaaccttagatatgagtcacaactggagacatctttgaaagaattaagctgcctgtcccttaatttaacaatgaatacaatgtcctttacactattggccacttacagatggaaggccactccaagtctaagggagaaaggtaatatgatggaaattacaaatatgcattctaatatttaatcttttttcattcaagcatctatcctgccattcagttttccatgctttgaagaatggaaaatggtgatacttttctgtcatgttgagtaatggattagataatagggaagagtggagttgccattatattgaatttattctgaattatagaagtcacgtgctattttggagagagtgccagtttaagaggaggatttgagcctttattctggtagacactatatggcctgagacagatcaagtcaattttttggatattttcttattctctaaaatgaaattgaactagttcagtggcttttaaaccatactctggggaacgtaagggtttatatgggaagagtgagagtgaggaaggatttaggtggaatttttcatgcacacacatacatacacacatacacacacatacactggcagattcaaccactgctggatcaagttcattggatgtatatattaatcttcagtgtaagttccagagctaattaaaattttaaacataataactagataatttgatcatatctactttccttttcaatgataatatcaggtataatgttcacaccttctggcctatttctagaggtcctttcacgtactttttactcaggcttccttgtgaccaatcttaacccttccaagtcactggtcaagttaccaaactattagccactgctaattccaggcaaactgaacaacgagatacatattatttcagtttctgcccattttgaggattgcccctttttttctttttctttttcttttttttataaattgagatggggtctcgctattttgaccaggctggtatcgaactcctggcctcaagcagtcctctcatcttagcctcccaaagtgctgggattacaggcatgaaccaccatgcccggtcaaggattgtcctttcccctggtctttctgggtcttggagtgagctataaatgctaaagcaacccacttcaagccaagaaaaaaggatctgtaaaccaggattttaattttttcctctcaaatcaattggacatagtgaataccccatgagacactcacacgtaagctagagagggacagcagtgtgacagacgtaagtagcaggagaatacaagcaacgtgctcactaaactcactcatcctcaggactatccaggcctggtgagttatgagcctgaattaacacctggatcctgatagacaattacgacgcaaagtcacttggtgtctcagggttaggtgttccactgggacctagtagcaagcctctaatatccaaagaggtccaccaaaatagtacctcttcatattggtaaggagctcaggtacaacagtttatctctcactttagaattatagccaaacatgttctgtataccactggacccttgaaaaattcccactcgagcgctcatgtatttttttcaaggtatccaaggtatttattgctttctactcttttgtccccacttgtataggatgaataatctgatatcatgtgaaatgaggaaataagaagctttctgctgacttcattttgacccagggtccaaaaggtgatgtaatcctgtggcaagaaggtaaagctatattcttgtccgtaccagatgaaagtgaactatctctgcttcatcattcacaactgtcctaataaatggccacaagtccctttgtattccaggaggtagactcaagtaggcacttcctcgagggtactcagatttcctttaactgtgtctgagaacgcattcatatctggaaattggataccgtctctcttttctagacataaaggttttgtttgtttgcttgtttgctatacaaatcaagtagaaccttagtgactgcttatttatttcagtcctggggactccatgatcagttagtcacctcccaagaatccatgagtcagagcattctaattttcacactgacctactaactttcaacttagccccatgcaaatgtgctacctagaccatgtcactctgggatcctgccatccctctgaaactcagtaagccaaattcaactgtagccttttttcagcatcatcgctggtctacgtgaaacgttctctaaatcacttttatactgacccttccctcatagatttgtttctcaaggcctttgtaaagagtgttttctggaccttcttatgatttttattttaattagagacagggtctcgatatgttgcccaggctggcctcaaactcctgggtgaagtgatcctcccacctcagcctcccaagtagctgggacaggtgtgagccactgcaactggctagacccttttttggaagacaaaattgaggtgggtggttgggtcagatatgacaaatctaatccagcattcctgtctcctaaaatttaaaattttgttcatttacattttacctaagagatttgcatctcaactttattttgtatgactcacccctcagtctaaatgtcaatgaacatttagcagagcaaacagaattattcctagcttctcaaactagaataatccagaatctcttgtaagccctattagtaaattcaacccaatctcaaatcatgtcctcttcttcttcattcaacattcttaaaatcaattctaactcacatcccacagattaattagcaaagttcttcaatttctttggtgcttgagatatatcttactgagcttcactttgtaaactagcctcttgaagcacagtagaatttttttgggggttggggcgggggacggagtcttgctctgtcacccaggctggagtacagtggcgtgatcttggctcaccacaacctccacttcctgggttcaagcaattctccttgcctcagcctcgcgagtagctgggattacaggcacctgccatcatccctggctaatcttttgttatttttttgtagagacagggtttcaccatattggccaggctggtctcaaactcctgacctcaggtgatccgcccacctcagcctcccaaagtgctgggattacaggtgtgagccaccgcgcccagcgagtttgactctaattacagatctggagatagtgcagagtaagagtagggtataagagaacctcctataaggtaactccctcaaactagggagtttcagcctcttcaaacaaaggagaaatagctttataataaaagcttcagctgcaaagaaggctgagagtttgggggcaaggaatctctgcgttcttcaaattctcccctatatagcattttaattttaaagatcttactctttcggaatcagcactttaacatatgctcttctaagaccccaggtaaggaggtgaattcgactgatttgcaaatcagcaatcaacaagaacaaatattggtttatagctatctccatcctagggctataaaagtttcttttaacaaattcacagcttgggtttcagttcatgttttaagatgagaatttagagattttcatttgttaatgtcttcaaatgaagcagctagccttagcacccagctcttgaattcctcatttccttcatactgttctgtgacaacagcaattctctcccccatggtcttgtctttaatacccaactcaatcctaatgctcacaggcattaatttcattagctattttactactataagctgtgggtttccagagtctcatctttgaatattaattggtttttattatcttcaaacacaatgagtctgcatacccagattctcctgatttccctgaaagtctgttgtgtgtaaccgaatccccattaccagtttctgtacaagtcagaattcctatttgccagcattagtaaccaattctaggtagattaaatagaatggaatttactgaaagagtaacagtatctatatacaaagttatttgggaaagttaaaaatcaggctcagaaatcagacaggagccaaaggaggctggcagcagatgaatcagccaaggaccactgaaggaatagtctgattagaatgctgccagaacttggtgaagaactgttataggaagagcctaaatagaaactaaggacagtgccaccaccagacattctcttctcctgaattactgacatcatcactgtctcagtagatagcttgatggtttctgcatctttgcatcactccttctggattcaatgtgggaatcccactggacaaacttcagttatgtgctgatgtccttgctgtctagaagaggaagatatgccttttttcagttcctataacaggaaaagtgttgagatgccaaataccaaagcacacaaaccccagacacacaaacacatccaggacaccatacttgggtttgtttctggactcactgttttattggtttgtttgtttattttgctgtcattatgctactgttttaatttcagctgttttatcttttttaaaaaatctagcagttaaaatcctccttcctctcaaatggttgtctttttttcttgactcttttcagtttaacttttctcaaggaacttcagaactcttttgtaaagtttcaaaaaaaattccattggcatttccattggaattgtattatatttatgaatatatttggggaataattaaaaaatttttaaatgccgagtgttcttatccaagaacatggtatatctctgtttaagccttggcaattttatagttgtcttcacatagatttgacatacttattaagtttatgtttttgttattctggtaattacaattttttccactttgttttcctttaaaagagtttcaaagccccccttttggaccacagaaaatcttaacgtgttataacctaactatgcaaatagctctgtgattctaatttctcttttaagcaatataaatcattgaactacattcttcctatgtttatccagctttccttaccaaattaaatctcatactttgtagtgtaaatttgagtttgaaagttaaaggtaaagaatgttttccaggggactaaaacaggaaaaatactgtcaacagaattgaataaattggaagatggaggccactgcgctagtactacagtgccccctagtggaaaaaaggaagcatgggcatgtttataccaagaatgaccccagtctctcttccacaggcaattagaatctggaggtgtgttagtggtcaactaggtcaactcctctggcttccaaaaagggaaactgagaaacaaaatgaagaaatgactggcccaaattcacattgtcaacccaaggcttaaatccaagattcctaactctcatttttcttcctttttgctaccctttcttttttcttccttcctagttcaaaatatattgtgctcttattataaagcacaatatattctaggaatgtgttctaggaatacagatataaagaagatttagtcgttgccttcaaatctagttttacttcaagcctaatttttttagccattttcagggaatgaatttgttggggaatgaccaaacaactatgcaggggaaggttctcaatcatccacaaattgactcacaatatgattaattaattattgagttttaactggaaagtacaatcacaaatgtgaaaattgcccttgatcagattcagaccatttcatgaggaggtaaggcatactttcaaatggcctgcattaaccttaatcttatttctcctttgcagattcaaaactgtggactatcttgcaaaaaatacaagaagatattgaaagttttcatgagtgcctaccacctaatctcaaacactatcattcatatgtgcctcattgagcaaatctttaatgaggatctatatgccaggtatgtgctaagctctgtgcttagtgtggcaaagagaacagatatggccttgaggtttctgctctcacaaagcttatagtctcctatttgtgtatgtgtaattctctaaagctcaggaaagctgttttcctcatttttctttggcatcatatttttaggctatagaaatcagaaagtacgcaaacattttctaaaattactctgccccacaaaaagggaaacaaaaataacaatttggggccagacagaactggatttgaattccaagcctgccctttacaagctattaaacaagcttattctctgagcccctgttgttttcatgaagtggaaataatatgtatcccttgtaagggatcatatccttattaatacctaaatagagacattactttttgagtcaaaactatgaattatatggtccatctcctaaaatgcagaaaaattatctaaagagaagcattattaatattgttcacttagtttcatcaagaatgtcactttccagaattaatacagacagatattctttgccattgactttttctttttttttttaaataaggtgaaatgctctaacaatggatgccactataacagagtttctgtaaggctattagtttctttttccatggatagtttccatggccttgctccacataaactaaaccctattatttcagttatgatgactaaatctagtatgaccattatttatctgtataagggatcttgtagtaatctgtgtataagcttatcactccatctatttaatgatttgactaagtcaaggatcatattttatttctctctgttctcccctcccagtggtaccttacacagaattagagcacactaaatgtgttctgagtaaaaagactatcttactatgtgctgtttgacatgtaagctgagagagaaaatttggcatatgttgtaggtaaacttactttgttttacctgggagtagcaagtatcaaacagatcctactcctgttacaatcctgctagagaaaaaaagtagttaaattccccagtctctactcaaaccaaaacaaaacttcaaaaatattgagacacagagagaaggaataggatggggtcagggaggactggtgtttctgcgtagtgtgcatgcagcaggctaatgtcctttccctgttgtaatagctccgaatgtaagcgccacacaacaccaggtctatgaaaagcccagggtttcaaggtcaaacaagtttgggaaagcttgcccagcattttcctctcttgcaagctggcagtggacactggtaaattaaagcctataaaaactgcttaacattgttttaccttgcaatccccaaattcatttgaccaacgtttcacctataaacatcccgcagatctggtagattctgtggaaggcacagacttcaggaaactgctccactgtgttgaaaggacttctttctcttgttaattcacacacaaaaagctgccattttatttccaaatcctacagaactgggaatgtgagcatttccagcaatgtttcaactgtagaaaagtgagaccactttctgacaatttagaggtcccagaaagtttatacaattgaattttaggtatgtaaggagtcagttcgaatccaggaaatggcttcccagcaatgcctggaatgtcctcacaaaaactgagaaacagatatccaagtcctgttttggatcttggagggacagagagagagaagagaaaaacataaatttatagtcccaaatctcatgatgtttcttccagttttctacaaataaatacacagtatccactttccctgaactccatcttgggactttatttttgcgtgtttccaattctcctctctagatggcagcacagatgaaaaaatgccagaaaaacagcaggccagactcagcggcagcaaactgccatcaacagccctcccccaactcactcttcctttttttttttttttttttaagaaacagaatctaagatacgatggccgacactttttcccaaatagatttaatcagttacatgggaatacaaaaaatgactgacgacacaccgatattagtgatcaggggaactgactctaacagtgtctcttacatgttacttgtgttttctgtatcttaaagataatgtaggcattgttcctaagtcatgcagaggggttgtgtaagcatggtcatttgcatcattatcctgcacgtctgatacagccaaactccacgccacctggtttgctgtaagtattggattcatttaagatccataacaatgctatttactgaccctcttgtcaactgatgctgtgacactgctgtaaaatgatccctatgtcaccagatgctgccctgaaacttaggaagttagcatgaaggtaatacttcattagaagtttgcaatttatgggtgaattaataatgcaagagaaaaggaatagaacagacatagagagaagacctttgaggtttacatcaaaccccatcaaaagagatttaaaaaaaaaaaaaccttaccctgcaggggttcattgaatctcatcattaataaaatagggtctatcagcaagatgtttttaacaaaatctgctgacagggaaaacataagaaaactggcccctacaatgtatgacatttcaagggctcaagagtgttctaaagaaaaccaaattgttcatgtgtaatgaactggacagaagctaaaaggtgacctgtgtcttttaaacagcaacagcaaaagacacggccgggtgcggtggctcacccctttaatcccagcactttggaaggccgaggcgggcggatcatttgaggtgaggagttcaagaccagcctagccaacatggtgaaacccagtctctactaaaaatacaaaacattagtgagacgtggtggtgtgctcctgtcatcctagctactcgggaggctgaggcataagaatcacttgaaccccagaggcagaggttgcagtgagccaagaaggcaccactgaactgcaggggagaaaaaaaaaaagaaagaagaaaagatcaccatggcaataaaaacaaatatagtgcataaataaaccaacctgaggccaaaacaaaaaactaagtgaatctttcatatttaagaaaaaaaatcaatttttgttgtgtcagagaacttttaaattctgtctctatcctttttgttttttcttttttgagatggaatctcactctgtcacccaggctggagtgcaatggagtgatcttggctcactgcaacctccacctcctgggttcaagcaattatcctgcctcagcctcctgagtagctgggattacaggcatgcaccaccacacccggctaatttttgtatttttagtagagacagggtttcaccatgttggtcaggctggtctcgaactcctgacctcgttatcttcctgcctcagcctcccaaagtgctgggattacaggcgtgagccactgtacctggccccatttttttttttaagtgaaagcagtctttccacaagattactctaaacaccacatctttccttaaatgagtacctttgataattagtgtgggttgaaattagttaatattataatgggtcaggctatctgtctttgccaacgcaactcctagtgctctaaggatactgaatactttttcctgggctctaagtttagagacaaaatcaagccctaaaatgaacatgcagagaggtactgagacagtatggcatatgagggagtgaaggagctgggacaggcctgcattcatctcaaagaccacaccagtccagtgctacacaccagcaaccctcagctctgaacctatccctggaatcaatactcagctcactccttccagagactcaggagccttggaagtatgacacacccaggacaaagctgaaggctaagaggcctaaatgttcttccactcccactaattctgcatctgtgcagcccactaaacccaccatccctcagaccctcagtatccttaatgtgtgtcctagagggagttctttcaatgagttatccttttatgaactctcatcctcatactagactcagtttcccattccaccctgtggtattgtgacaagaaatatatttttgggccaggcgcagtggctcatgcatgtaattctagcactttgggaggccaaggcaggtggatcacaaggtcaggagttcaagacctgcctggccaagatggtaaaaccctgtctctactaaaaatacgaaaattagctgggcgtggtgccaggagcctgtaatcccagctactcgggaggctgaggcaggagaatcacttgaacccagggggcagaggttgcagtgagctcagattgcgtcactgcactacagcctgggtaacagggtgactcaaaaaaaaaaaaaggaaaagaaatatatatctggtctcttcccctggttcctggcacacagctcctaaaacccttggactctccagagtgataagagtgcctttggtatgctaataagacattggtggctggggagccctagatagcttcaagaggggtgctgatcaccggaaagaccaaggcatgattagagggttgggactttcagccttaccttccaacttctagagagggtagaggggctgaaagatgagttgattaccaatggccaatgatgtaattaatcatgcctacctaataaagcctccataaaaacccaaaggacagagttctgagagcttccaggttgctgaacatgtagaggtccctggagggtggaatgtctataaagggcagggaagtttcatgcctcttcccccatccctcgccctgtgcatctcttccatctggctattcatctatatcctttgtaacatcctgtattagtcccttctcgctgctataaatacctaagattgggtaatttataaagaaaagaggtttaatcggctcagagttcagcaggctgttcagaaagcacagcagcttctgcttctgaagaggcctcaggaaacttacaattatggtggaaggagaagaagaaacacacacatcttacatagccagagcagaaggaagagagagagtggggagatgccacacacttttaaacaaccagatcttgaaagcactcactcactgtcacaagagcagcaccagggaggaaatccgcccccatgatccaatcacctcccaccaggccccacctccaacactgaggattacaattcgatgagagatttgggtggggacacagatccaaaccacatcacatgctttgtgatgaatgggtaatgtaagcggtgtttccctgagttctgtgagctgctctaacaaactaattgaacccgaggagcagaatcctcataggaacccccaatttatgaccagtcgtcagaagtataggtaacaacctactacttggaattggcatctgaagtggaagcaatcttgggagactgagccttctgcctgtgggatctaatgctatctccacgtagatagtgattataggaaaattgtgttaaattataggataattatgtccactgaagaattggttgtaggtagaggaaaacctccagacattttggtgactggaagtgttgtattggttgagtatgtgagattacgaaaaactttttttcttatatctcttacattccctttcctctaaaacttttcctctatgacgttgggaatctcattccatcgtcagcaaactccctgatacacccagcctcttcaatgaccattgtttattattattatactttaagttctagggtacatgtgcacaacgtgcaggtttgttacatacgtatacatgtgccatgttggtgtgctgcacccaataattcgtcatttacattaggtatttctcctaatgctatccctccccctctttagctatctaggtatttctgtgaaacatacctgacttctcagtttcttgattccatctccaattaccttctccattgtgcttcaatcactcaatcccatggccacccctaggccatgtcttcaacaaaccacagcacctctgaacccttgacttttaagtcctccaattcttttcatttggttattttcactacgtttatcttccaaacttattaagatctgcagtctttctgctttctcctttctctttatctataataagcttgctgtcccctattccttatctactgaggaaggactccatgactcataacattggcctctgaccggtgttctcaactccattacttcattattcttctggtttatctgcctgacaaattttagagtgtataccctgaatccagctgtctgtcttggccattcctttacctaggctgttgggcactgtaggaaaaaaatcaccctgtcacacagattggggctaccttaaatttatgctcagcaacctcaagtgggacctcactgctgcctgcagtcctactctattccccggcctgcttgttttctcagcctccagaggggctatttcaaggatttgcctcttcctgcacctccctatgttggcctctctaccttctcattctcaattggtgattttttttcccccacatatcagagttgggtgggtgtggatgttatgagatgtgagcagtctcagttttccataacaacctatacactttttttttttttttttgagacagggtctcactctgtcgcccaggctggagtgcagtggcatgatcatggctaactgcagcctcaacctcctgggttcaggtgatcctcccacctcagcctcctgagtagctgggactacaggcgcatgccaccacacctggctaattttttgtagagatgggatttcccatgttgtccaggctggtctcaaactcctgagctcaagcaatccacctgccttggcctcccaaagtgctggcattacaggcatgagccaccacacccacccacaacctataaacttacttgcatctttatacatttttttgaccttgcctcttattataacagaaaaactccccctacctccatccaaggccaatctcttggcctgatgctctgggtcccatctctctctgacttcccattgacctcactctctcagttattccttcatactcctacctttatattcaaccccttcctctccactggctcctcccttctcagactaaaaaagccacatcctcttccatctaccgtcctctcttctcttgccagttaaactttttggaaaagttgtccactcactgttttaacttcctcacctcccactcactctccaaaattcctctctccaaaataacccatgatctccatgtagctaaattcaaggggcacttttcagttctctccttatttgacctgatggcagcatttaacatatcctcctttttgatactttctctttcctgagtatctatggcactatctacctgctcccagatagctctctccatctccaacccttctcttgagcttcagaccctataggttccacaggcatcttaaactcaaactgaactcattttctcttcaaatctgtgtatctcctcctgagttccccctggaggtagcaagcactgccatggactcattgctgcagctagtcacttgtgtatcattcctcactgttctcatcatcatacctcatgtccaattgcatcaccaagaactcttgatcctgccacctgaatacctctcctaccttttttcttgtcttctttcccctctactctcatcaggtctcacctaaacccctgtttccaatcttcatctcaaaccattcaccatgcagtagccatgtgagtgtaatgagcaaggagtctcacagatgcaagagtccacaaaccctcaggtgtgcagtcatgggatgttttttcctggagtaaatttgattttggaatctgaacctccagccttcctcctggtggacaacttcatctagattatcttaaatgaattcagtgatttgtcaactgagattccataaatacttcagttcagaattcagtttcaaaccttccttcccctgttcttgcctcttactcttgggcctcttggggctggctacccaagggaagtggggaagaagatggaggtccatgtgtgagtagcgggtggggctgggggagctgtccatctagtcatttctggggtcactctaaagctagcctgagccgctaataccattgttgcctatgctctcagcacaggcaggccccagtgtgctgtctaaagtaccagatcctgctagctttgaagggtggggatgggctgtctgggtgcacatgcaggtcccatgtagcttcatctcagaaaggggcagccatgtcccccataatgccacgaagtaatccaggaacattccttccttttgccctgcacatctgctttctgatcagatcatttcttctcccctcacagcatagaggtgaaaaaccaattcacatttacacatttgtatgagttggtttcattttaattgtttcatttctgagttaaagtgcagagccctttgtatttaaattgtgcaatgtagagtctagatttctctcagcagcagacaatctctacaatcattaatttgctttccactctcctggcgaaagagtgaggtggggtgtgtgcatgtttgtctatgtatgtgtatgttggtggcaggcaaggagcagatgggcagcccagagcccaagtagagaaatgagtggagagaatacattccattaatacttcacatattatcctgtcatgtgttctttctaaatcacaaatctgaacaggtctttcactgtgtaagcatcacttacagatgcttaaagccatctgtagcttccccattgcctttaggataaagtctaaacatgtaaacttgatttacaagttaagatctgtttacagatgacctttcccacctcatttgccacagtttcctctcttctgtccgttccatgggttcactgtactctgttgcctctggactgtctcacattcctagaaaattctcttcaacttttccctacacctcactaattcctgcacattcctctgatctccagttaaacaccacctcttccctaagtcctccttgacctccctcctacctctgactttgatttgtccctgctatgcacacccataaccttctcatatcatagcacttatcatattctaactattttgtttgttttcccacttgactattaatgcttttaagacaagaatatctgtctcgatcagtgttcactctccagcactagcacgtatctgacacctgataggtactcaataaatatcgttaaataataaatgaatgaatgactgaagaataaattgaatgtgcaagccaggtgctggcttcatgtgccctgtcttatagcaggacttagtactttattgtgtttccccaaaagcaaataaactccacagagtagaggtgagtaatgtggatttgaccaacaattttatgaggagacataaaaggaggtttaaatggagacatttctattctcccctcagtgttcctctttggtttccagatattgggtcttcctctcttttgaccctcccttcctcccattctctcacccccaactcagcctctacttcccttttctaggcagtatcactctgagaggactatggaggatgaatcggagagaagtgaggctagtatcagggagttccatttaatagacaatttaatgaggccaggcagagatgatgaaggcctgagttaagaaaatgacaaaatggcctgaatcccaggactttggagccccaggtgggaggattgcttgaaaccaggagttcaagaccagcttgggcaacatagtgagaccctgtctctacaaaatagaaatttttaaaaagggaaaagaaaatgacaaaatgaagaggagggggtgggtttaggagatgtttgggagggaagatcaataggatgtgagaactgattggattggagtagaagagaaagaggaatatagggcatgtgtcaaggtttggtgaatgcaaaaggagaaataaagaaaagaagagaagagtaaaaagggtaggggttgagagttccataggattagagttattaccaagggacgtataaaagagaattaagtggagaaggaccagtataaggattataatcacctgagaatctaacaggttagagaccaaaactggtatgggcactagtatttaaattgtgtaatgtagagcctgggtccctctcagtgtcagacgatctccacaattgttaatttgctttccactctactgacaaaagagtcaggtggggtgtgcgtgtgtttgtctgggtatgtgtgtgttgatgggggtaaaggggcaggttggcaacccaggtagaagggaaataattgtgtgattttctttaataacttgggctgccaatggtaagagctgagaaaatgggtggtaggttgatccaagacttgggatttctgagacgatggggcagaaggatcaaggggcgaaatgatggatgattttatgaaaacaatgttcaaagtgatggacaatggcatctaggctcaacagggatagaaatgagccaggatggggctgacagattgaggggggagggtggggataaaagagcaggggccatgcctggtgcaatgtttacaggaaataggagtccataggatgcaggacccaaaaggaaaacaaattgtggaaaggagaagttactcttccttctctgaaatgaaacagaaaaagagatatcatctttaagtatttctcagtagagaaaaagcaatgagaggatacccacattggagaatcttgatttcttctattaagcaaaaggagaaagttgcatacagtgggactggggcttgaaggaaacaggaaggatttagaaaaggaaaagtgaggactgtggaaggaaggaaattttgaaaaatcagagaattacctgggagtagtaaaggctcagctgggaccagtcagctgatattggcttgggtcagatttttacatttttaatttaattttcagcaatatcttttgcttgggagcagaaacagaaagtacatgatggacttcattgaaggatggagatttggaagacatgaatggatgaagaaccaagtgcgtgagggcacctatcaggattattgctgaaatccttatggagttaactggctgagaggaaggcaagcaagcgaggactgatgggcccttggcactgtgagaacagtggaggaggagggagcagggttcataaggaggagcacaaacagaaagttcagtggccccaataaaaataacaccagaatcttccagatactttctccataaggcgaaaaggtaaatgcccctttaaatcattaactaaactggcacttagatctgggcaggctctcccagattgggctgttccgttttgccaggaattgataaacttctgtgacccctccagggtgagtgagcatgatccatcttccctgtctggacaagtttgatccagcctccttcctcctgctgaagcaggcctgaggtgtgtgccaggattccatgtcttatgctaatactcacattccacataccggctcttgctggtactgcctttaggcttttagaaggccgtgcttttaccctccctggctgcaccccttactacagggtgaggagactgtggcacctaggggatgtgtccactcagaaccacattaccacattgctcccttctagaccacactctggataacttggaccacctcaggattccttgctcaaatgccccaagcccacttccagggcctgcctagacttcttttccagacccatcctcccaagggcaaaccatgccactagtgtgtgtggtcagcctgagaggtagccaaggatagcctatttgcagaggcatgcacagggtatggatgcgtgaactggggcatctacatgcatgcatgagagggccttctcattcagagtcaaggatgggaggagaggggaacgtttcaggttggggtccagctctctccatgcctctttgtcctggtgcagaactctaaggattccaagcattgcacattcaaacctgaccttcaggtcttttggaagttagagttatcaaggtaggaaaatggaacatattttatttaacagtttgacttgacttataactttcttttttttttttttttttttttagacggagtctcgctctgttgcccaggctgtagttcagtggtgcaatctcagctcactgcaagctctgcctcccgggttcatgccattcttctgcctcagcctcccgagtagctgggactacaagcgcctgctaccacgcctggctaattttttgtattttttagtagagacggagtttcaccatgttagccaggatggtctcgatctcctgaccttgtgatccacccatctcggcctcccaaagtgctaggattacaggcatgagccaccacgcccagccaacttataacttttatatcattagacacatggaatatgggcctccgtttgtactcttgcccttggccccacaaacgttagggagaggcctggctcctgcaatgtactatttacctgttgtaaagaatagcccttcaaaagtattattctaagtctgtttgacataataggtccaaattgtattacaacatggtaaaaaaacaacaatccattaacaatcctctttggatttctaaaaaagttttggtagcctaaactctttccccaatttttgatatcacttcatgtcattttagagagtaagttttcctgttttattaatgtttatatttaagctgaattttctaaaagaattgtgagtgtttttattctattgtgacattcaaggtacgcagctgacccttgagtataagtcccatcaactaagtaaacatcaaacatatcttcagtacatccctttagatcttgacagttatttatcactttttcataagttccaaagttccagatggttactgatacattcaggctgaccactgctagatttgagacttgtcccacagatctgcactgtatcttcataccttcattaatagatcttttattctttttttttttaatttttttggagacgtgggtctcattatgttgcccaggctggtcttgaacttctggcctcaagtgatcctcccaactcagcctcccaaagtattggaattataggtgtgagccactacacccagcctagatctcaatcaggtgacactgaaaatgtttggtcataaaccacagtgaaggaaggggaggcagctgttagatcatctgccttgacccacagtcctcatccatttgcaccttggcaagccctctactacatctgaatctcgaaatgggggataacctcttgggagagtctatgctagtacccttctagtagtagtttacaatctgccaacaaatcttgaagccttatttggttgatatcaatttgagaggtgggaggttcagtttccaaagagtcaggaaagagcattcatctaggcttgagaagcctccatttcctaactcaagagttctgattaggttgttggttgagtgacacaaggcaatcatctcacttttctgttcctgagcttctccttttatagaatgtgggcaggagtgtggagagggagaatttatttcatttcctgttttccaaacttactaaactgtggaaactttttcttttgcagcattgggcaaaactgatgttctaaggaacattctttaggaaaggttagccagatccgtggttctcaacaggcatgtggtacacatttaataatgtctggagacgtttttggttgtcacaactggggatccagggatgctgctaaacatcctgcaatgcctaggacagccctccacaacggagaattatccaactcaaaatgccaatcattctaaggggttgaaaaactctggactatatgaactatctcaattctctttcaacactaacatttaaatgtggtgtttcttgttttttaaacacacaaaattttatttctgttttacacaaagtcagctatgggtatggatgaatctgcggacagttttcttccatgtgttggctccatatttcagctgctttgatctttttgacatcttatcaatgtgttcttctatgatttccttggcagagaaagagaaagcagagagaatcatgtgctggatcttaaatgcttctacgtggatgtagtaaatgtctcttctactttttttaaataagaagtgtattaaaatataatccatgtatcatataatttactcatttaaggcataaaattcggctgggtatggtggctcacacctgtaatcccagcactttgggaggttgaggtggggtgaatctcttgagcccaggagtttgagaccagactgggcaacatggcaaaaccccatctctacaaaaaatacaaaaattagccaggtgtggtggcacgcacctgtaatcccagctatttgggaggttgaggtgggagtattgcttgagttttgaaggcagaggttgcagtgagccaagattgtgccactgcactccagccagggtgacagagtgagactgtctcaaaaaaaatttttcagctaaaataaagtgtaaaactctgtagtttttagtgtatccacaaaatgtgtgcaatcgtctctacactcaattttagaacatttgaatcacccccagaagaaacactgtacctattaacagccattcccaattttccctcaacacctccacctcagccctaggcaaccactaacctattttctatctctataggtttacctatactggatattacatataaatggaatcatgtcctttgtaactgtcttctttcactttgcataatgttttcaaggttcattcatgttgcatccttctcaatatttcatttttattgctgaataatattccattgtatgaatataacacattttatttatccattcatcgcttgatggatatatgagccatttctactttttagatattctgaataatgctgctatgaatacttatatgcaagtttttacatggacgtatgtcttcatttctcttaggttatatatctaagaaaggaattactgaatcatacgataactttatgcttagacttttgagaaactgccagactgctctccaaaatgactgtgccattttacattcccaaaagtaatgtatgaagtttctaatttttccacaccctcaccaacacttattatctgtgtttttgattcttgccatcctagtgtgtgtgaagtagtttctcactgtgatttgtatttgaatcttcttgaaggctaatgattttgagcatcttttcatgtgcttatcgtctcttctttatatagatgtctattcaggtccttggcccatttttaatttgggctatttgtcttttcattactgagttttaagaataatttttgtttattctagacacacatcccatattagataggtgatttgcaactatttcctcccattctgtaggtttcttgctggtgtccttttaggaatagaagttttacgttttgatgaagtcaagtgtgtatgttttcttttgttgcttgtgtgtttgatctcatatcaaaaaaccattgcacaatccaaggccacaaagagttatgtctatgttttctagatttttatcattttagtgcttacatttaggtctttgatctttttgtgttaattttttatattgggtgtgaggtaaaaatccaacttcattcttttgcatgtgatatccaattatccagaaccacttgttgagaaggctagttcttcctcactggattatcttggcacccttgtcaaaaataagttgactgtagatgtgaaggtgtatgagttgctaaaatacctcttctgtgatatttataatttattttctaaaaggataagttataggtcacatctcagattacaatgattcaagtcaaaaagttcaaagtagaatttactttcaaaattgtttgttcccccagagctagttaatgcccccagagctagttaataaactctatttgcagataaaagcatgctttcccttcaaaggtatttcaccaagacgggaaacacaaaactaaataagctgggaaactgaggatacacagagggtctccttaatctctggatatgtggtctaatgtatcctttttgtgctcattttttcccttttatccagaaatacaacattacctttttataaaattcctggagattgatcatatctctagtgtttgggtctagaatgtattttttggccaaaacatctctttaccccacttccacatgtggaaagaaagaaaacatggtactctaatctcacaagtgaggcatggggttgtttcctgaaatgaggcaaggactttggacaagaacatgtttggacttgagatggtttttgtaaacccaaatgatattagttctagtctgtctttatcgctcactgtattttgttttcattcatactaatgaataatagacttgattgtgttccatcatttatgtcattaatatttcctttatgtttgagtgctgtgcagttctccttgaaacttgtatggagattgaacttgatagtgatttaaagtaattaattcatatgtcagttgttagcaaggtctagtaattaaaatctactttagagtaagttattaactctccaaaataaaaacactttatcaacttaccagttttagctatttattctacttgacagatgagatagggtagttattgactgtacataatcacctatgtactttcaccactgaacactagggtcaaattgaagtctaggttattaaagttcatagtttaaatctagaataaaccagttcaggttgatgggagaaggaagagagtgtccttggatcttgttatctttgcaatattgtctccttaaattttgcaaagtccatttttgctgtcttcaaaattctcaaacttctaaactaaaaacaccctagaccaaggatttcatattgagatctaagatatcaaagtgctatattgtttatgatttattttataatgctttttagtaaaacaaactttagatgccatgatttccttgtgaacaggctggagggaagaaaacaagttacacgtaatgcatgggacacaagtgcaggccttttatttgcaggcctaaactagtcacaagtttccatcttatgaaagcaagttttcttttattctgctttgttttttgtcttgatatctggttacatttattcagtttgagggcatcttataacgggccctttacttccctccatttggcttgtgatgaactactaccaaggtcaatccaggtctgactctttcatggagtcagtgtggctggggtagtgtttcccaagccaagcttgtcatcagaattacctggggtggtttgtaaagaacttttcaggcctcattccaaacctactaaatttagatctctggtgtggagcctgtaaatctgtatgtttgaaaccttcccaaggtgattctgatgtccagtcatatttgggtcatagtccagaatgcagtcatgcattgcttaatgacagggatttgttctgaaaaatgtgtcattaggtaatttcttcattgtagaaccatcatagagtgtgattacacaaacctagatggtatagcctactacacacctaggctatgtggtatagcctattgctcccaggctacaaacctgtacagtatgttgctgtactgaacactgtaagtaattgtaatacaatggtaagtatgtgtgtatctaaatatatcttaacatagaaaaggtgcagtaaaaatacagtattcaaatctcatgaaaccaccatcatataagaggtccgtagttgaactgaaatgttgttgtgttgcccatgattgtacttggatttcaggactctgcagatgcttggaggtcttatgggtttggccatggggtattgcctctgagaaactgccatctgcttgccagagattctgaaaagaccagagttgcctatttgcagtctgttcttcaagactatctactatgttggcaaaaaggcctaggtttcttctctgtccattctcaatccctcaatctgtccttgtgacttacttgctccttcaagctgcccagtagtggcgctggtgaaaataaaatagactttggtcctacagacctgtcatggactctcagctcagcctcttctatgtgtgccatttgcctcatctgtaaatgtagttaatattgtcctctcaaagatgttaggaaaaccagaagaatgtatttatgtaacacctagaacaagtataccctgcattaggcattatttgtttggttttacctgtccatctcaatgaacatgctgggttaatgaagtgtgttcatcaattttccctgatcgtagccttttagattgctctgggcagtgtttctcaaagtaggagacacagaccacctacctgtgattgacaggaggacagaaatctgctctaatgcactctaaccttctgcacttttcactttttattgaaatatacatatagaaaggtgtatttattgtaagtgaacagctcagtggcttttcctaaactgaacacacccatgtaaccagcacccagatcaagaaacagaacattaccagcacccccgaagcctcctctgcaggcacactttaagaaccactggtctaggaagagcccagctggggcactgtcctaaaccaccgtcccgcctttacctagcaggccaaatctgcatgcagtgtcagctattcccaatctgagaggctgggcctatagcctcacatacacccttcatagtgatgcaacttcatttgtaaaaagggtcacaaagggtgtttctataatttatattcctagcatacaccctaaactgcttaaagcaaatgaattcaggtcccagccaaaaaggagtggagaccagtcactgcctgaaagcattggcttattacaacactccagcattttctcacggcagggtgaatgaggtggattctagtgtaattacctttatgtaattgaaaactaaatcaccgatggctgcagagtttaaatatccatttaaatactttcaatttattcagcttattttttcaggacatgctactaccaaataggctattaatttttctaatggattaaaatctgaataggtacattaaaaactagcatagctcaaataaatgtcctctttttccaaagattattaaagagagttttctttttctttaacccagctattcaaatactctattagaccaggacctgtaataatacaggccttgtccagaagggatcaggtttctatgttatataattaggcaagactttaaatagtaagacatgcacctgtggtgcttttgtctctaactccacaaatttcaacatgcatacaaatcaagaaggggtgggggtgttacatgcaaattctgcttcagtgggtgttggagcctgagattctggctttctaacaagctcccaggtaagtgctgatgctgctgctttgagggccacacaccttgaggagtaggaagagtactcatactggaagagtattcagcacggactggaatcctgcatacatatctgagctctgtgttctggtatgtatatagactttttaaaaaaattagtagagatggggtctcaccattttggccaggctggtctcaaactccagggctcaagagatcctcctgccttggcctcccaaagtgctgagattacaggcatgagccactatacctggcttatatagactgcttctaaggtccattctaactgtacaattccatgattcagtcactgtttggctattaactaatttttttaggcttctgattctcattgtttataagctgctatattagagaatgttctgtactggaaggccagataaaaagtcttacttatggccagtaagttttatttttcaatcttctacaagtctgcctcaacccatgggaaatcttggctaatagtaacatgatactgggcttggaccataaactaaacttgagtcagcaatgtagggctttggttagataagcaagaatgaacttgggaatataaccaaaagaaagggacagctaatcctaccagaacaggcagtatttatatgaatacttttttcaaatatccacaactgggaaaagctgctgaacacataaagaaaagttaaaagcacggcattatttagctagtgaaaagagaacaaagaatgccttaagaataatttttgaatggcagcagaaaccagcatatcctgtgaagtaaatgcattttcaggacctcaaaatagatttaggttgcctctaaagcagaactttcccatgataatgatgatcctaggtggtaggattgccaatggtaattttctttcccaaagattcttacaaccaaccataaacctactagataacctatcagttgtgttattaactgatatatcagttggggttcagtgcagacacttctctaggtactgaatgctaagaattatatgcttaaaaattatatgctcttaccattagaagagctggaagaaggctgagggagatgccttcttccagcccttctaatggtaggagcattaagagggatgctgttgggctcgcagttcagtccacacagctacaatctagaggtcaggaagctataaagtccactgctggcatcacagtcatttctcacagatgaagttagtggcaatgcagaggcacagaaagtctggtcattaaaaaccacatttaatgttgcacgtacatcaacaactaccagtgaaaactaataggcagccaggcatgttggtgcatgcctgaagtcccaaacatttgggacactgaggtgggaggatccttgagcccaggaggtctaggctgcagtgagttgtgattgtgccactgtactccagcctggacagaacaagaatctttctcaaaaaataaataaatagagagagagaaggagggagggaaggaggaaggtaaaaagagagagagagaaaggaaggaagggaaagaagaggaaggaaggaaggaaggagaagagaaagaaaaggaaggaaggaaggaaggagaaagagaaagaaggaaggagaaagaagagaaagaaaagggaggaaggaaggaaggaaggaaaactaataggcaggggaaatagcctctctcttccttttacctttctaatttcgcatcattatatctgactggcacagtttaaattgtttaacaaatcctattagcagctcagcctagaattatagttattgagctttgttcctaactcagtataaatctatctttattgaagtatagcatacagacagaaaaatgcacaaattataatcagagagcttgatgaattttcataaagtaaacacacctacatattgctagcacccagattgggaggcagaaactactaccataccagaagctcccttcattatcttttctaggcattatcctccctcaaattgactgtaatcttggcttctaataccctagaccaatttggcctatttttaaacattagacaaaatggaatgatacagtgtgtattattttattactggcttttcctactcaactatttgtgagattcattcatgttgagagtaataatagtatcttcattttcattgctgtgtagtattccattgtatgaatataacacaatttatacgttctaccaaagatggacatttgggttgtttccaatttgagattactgcaactagtgccactgtgaacattggtgaacacacacacacacacatatttcagttggatatataaaagtgtaatttctctgatgcatggggttcagcttgagtagtactgcccaacagtttttcacatcttcatcaaaacttgatcttttccatcttttaaattttagccattctcttcaaagactaatgcagtgtattgaatctcattgttgttttcatttttctgatatcaaataaacacctttttaattgtttattggccatttgggtaccctcttctgtgaaatgcctattcatgtgttttgtgtgattttctatgggcttgtctgccttttcttgtttttatagtcctttattctggatatgagtcctttgtcgggtatatgtattgataatatcttttgccactatgtggctttttgttttttgttttttttttttgagatggagtcttgctctgtcacccaggctggagtgcagtggcgtgatctcggctcactgcaagctcctcctcccgggttcacgccattctcctgcctcagcctcccaagtagctgggactacaggtgcccgccaccatgcccagctaattttttgtatttttagtagagacggggtttcaccatgtgagccaggatggtctcaatctcctgaccttgtgatctgcctgcttcggcctcccaaagtgctgggattacaggcgtgagccactgtgcccagcccactctgtggcttattttattcactcttttaatagtgtattttgaagaagacattcataattttgaattagtttagtttatcagatgttttcctttatggcttatttattttgtgtgtctccagtttaagaaatctttgtggattccaaaatcgtgagtattcttctgttttcttgtgaaactgttattgtcccacttagatttacaattgtgacttttatggatggtgaaaagtgggaaatatagttttgagccttccagtttctataattctgtagagtaaaaatggagtatatagagaaggtagtgaaaatgtatgcaagaaaccatatctaacacagttaacttaggtgactgtttacgctgtaaaacagtgatatgtttaggctttgtgtccccactcaaatttcatcttgaattgtttttgtttttgttttttgagatggagtctcgctctgtcgccatgctggagtgcagtggcacgatctcagctcactgcaacctctgcttccagggttcaagcacttctcctgcctcagcctcctgagtacctgggactacaggcacacgctgccacgcccgctaatttttgttgttgttgtttgtattttagtagagatggggtttcaccatgttgcccaggctggtctcaaactcctgagctcaggccatctgcccgcctcggcctcccaaagtgctaggattacaggtgagtgcccggcctcttatcttgaattgtaattcccgggtgttgagggagagacctggtgggaggtgattggatcatgggggaggttcccccatgctgttcttatgacaatgagtgagttctcatagatctgatggttttataaggagctcttcccactttgcttctctctccctccctcctgctgccttgtgaagaaggtgcctgcttccccttcaccttccaccatgattgtaagtttcctgaggcctccccagacatgtggaactgtgagtcaattaaatctcttttctttataaattacccagtctcaggtagtatctttatagcggtataaaaacagactaatacaaacaggtagctctaaattgtgagtttttcttaactcctttgatcttctgtgatagcgatttttcacatttcacacttccctaatgccaaaaatccacctccagcagctgttttgcctctttcttatcctgccccttggaagaatgtcatcattattgctgccacagcactgtgttctttttcagaagttacagcaagaattggttggctttctttctttttttttttttttctcagacagaatctggttctgtcgcccaggctgatgtgcagtggtgggatcttggctcactgcaacctctgcctcccgggttcaagcaattctctcgcctcagtctctcgagtagctgggattacaggcacaagccaccatgcccggctaatttttgtattttcagtagagatggggtttcaccatgttggccaggatggtctcgatctcctgacctcgtgctccacttgccttagcctcccaaagtgctgagattacaggtgtgagccaccgcgtctggccagatctgctttcaaataaatgaaaagaagaccagggttagaactggtgggaaaatgtgaatattagaattcttttaaagaaatatagttttaccacataatctaaggtcgtgtgattaagtacaaggcattgttctaaaaggcttgaggaaaagttgtttctcctaagaggttaaacaagctcataaccctacctctcctcacttgcaggcacaaccacttcctgtgtttttttcatgtggagcaactgatgttttctcaatcttatataagatgttatacaaggccgggtgtagtggctcatgcccgtaatcccagcactttgggaggccgaggtgggcagatcacctgaggtcaggagtttgagatcagcctggccaacatggtgaagccccatctctactaaaatacaaaaaaaaaaaaaaattagctgggcatggtggaaaacacctgtgatcccagctactcaggaagctgaacctgggaagtagaggttgcagtgagccgagatcgcaccactgcactccagtctgggtgacaaagcaagactccatctcaaaaaaaaaaaaaaaaaagttatacaaaagaggtttcaagcgagttccctaccttcctcagaatcagatttttccccataggctcctctagaaattatggcatggctactggaacagtaaaatatatctagagcaagattcttctcaacccttttgtgccttatccccgctctctcctttgatatttggatatatcatttggttccctaataataataatagctgaagtgggttgtgaaatatgacttttttattattcaacccaatttctgttccatggccacatatctctgggctgttaggaaaaatcattttacgatatattttcaactcataccacatagtagcaggatcttacacagtgccaaggcttctggaatggggcaggtatcttagctggtccttaactagttcacaatgattcagccaagattcatatacattgtaggggtcccatggcccctttatgtctaggaccttctattatttctgagttaccctattgtttctgagttatgttcatctgcataaatgcatctgcatagtcattcccctaattcctacttgccaggcactcttctaattactccatgtgcattgtctcatttaatcctcataataaccctatatgacagtgttgctattattatttacattttataaatgaggacattgaggttaggtaatatgcccgaagcccttatatctcagtagtgctgaagtttttgctgtggattgactctctactcttaaaagtgtgagtgctcattaataatccattggcacactcactgtgcttctcaaatcttagacaaacctcttgtcatcaccttgaagaattcatctttgcaaagacccattacaccaaggcatgccagtcatcttagttaatcttcatattcagttcatgaagcaaatatttctagagactggctatatgcccagcacaagttctgatgacagaatgggctaaggagctacagtagcacaagagtccctttcgtcgaaatcttaaaagcaaattttgtccaagttatcaattttatctaatggaatttaactaaattagaaagaaacctaagtccttcagtcactaacccatagatttaatacttgggactcagacatatgaacattgttgttcttgatggccttattttctgggtcatctcccagaaatagcatattcttatgctaatttgagtgctactaaacccagaagggcccacattcacccacccctcactcccccatggttcagtaggcctcaagtctcaattttccaattatctaataaattgaaggcttccattgggagtaggatgaggatggaatcttaaggaaattgaaagtgccatttcagagtcaatatagttttagtaggttttagggatgaacctggtacctaaccactaaatataaggcttttaaaggaatctatgtccatgtccctaaaaaaacaatttaaaacccagtatggttatattcctcaattaagaaccatgttatattccttatatttattggtaccttaatcattaaaaacttgaccactttacagtgaacttctagtattttctctactttttactcttctagaagacagtagatatttctgtcctgataccagctcttgacttgagcaaaactgtgcttctagctactcaagggcagacagagctctctggaagggaccattgaagagtttataacaatgttttacaaagttcaaattacccttgcttatctggaatcttttgaaaattaatccctaagtggctgaatgtaagaaaacttactgtggggctagttttactgaaatattttgtcctagatttttgtgaccatgagtgtctccttctcccctggagaaggatatctgttctatgtcattctcacttcctagagaggagaaaatcagaactatttcctctactctgtcaggtaggtctagtcaaacagtccatcattctgatagcagaatatcaggacttcataacaagaaacatagaatccctaaccccagagcgtaatcagctcatctcattgcttcccctttagactaagagcaattttagtagaatgagttccctggacacagcacctgcaggatatgtgaaggtgctttataaattttttgtttgtttgtttttgagacagggtcttgctttgcagtgaacacagttcactgcagcctcgacctcctgggcttaagcaatactctcacctcagcctcctgaacagctggcaccaccacacctggctaatttttgtattctttgtagagacagggttttgccatgttgtccatgctggtctcaaactcctgagctcaagtgatctacccacctcagcttcccaaagtgctgggattacaggcatgagccacagtgcccggccttgctttataaactaaagcagcatataacactgcaggttgttgaaattttgtctttatatttcctttgctttttagcctagaaagtactctgaccagcaaaaacaaccacattacacatcttaaaaccattgctagatttcagtggtggtggtatgatagtagcaatagcaagagaaacaaaaagaagaatgtaagggtggggtatgtgtatgtccatgcccatgtactggcttttctacatgctccaagaaggtttctcaaaggtatccaatgttcaaatgggaaggagcacagatcagatggggaatctgcccaggtgtcagagaattcatgttaatcttctggccaaaataactatccattccaagttcatgttattattttttgaaaaaataacaaccattttcattgctaatattcttcaaagacttgcagagattttacccacttctgtaaaactgtttaagatttcttaagttagctcttaagaacttatcttaagatagctctgtcttaagagctgagataaattctagtctggaagtcagaatgacccagaacagatgccctttctcaattccacattaatggagaccttaggctgggttccacctccttaaaaaaaggcagggctgtgtatggacccagtaaagggtggagagacaaggttggtagtgactcacttcagtttttggaaggaggcggattaagcttccacccccacaagcctaatgctgggaactcccactttggaagatgaggcagatcttgacatgaaagcagtctgaagtagcgtcccaccctagaaaagaagttacattcatcgttagatttgagactgcacagctaaaatgtaagaaacagaagtgtccagtatattcaaaagccttaaaagtgcacattttgttcgctgaccaatgtcaaatttataactctatctttaggaagttattaagcatgtgtgcaaagattaaactactaggcagatcatctaaactgtgtttatcataaaaaaatagaaaaccaacctaagtgtccaacaatacgagtttaattaaatacatccatataatgttatatttttcatatttaaaataatgttatagatacatatttattaatgtggtaaggtgtctaaaatatattaaggacaaacacaggtgaccaaccaatatgtacttgatgattccatttcagtaaaataaatacatgtgtgagtatatgcatatggttttaaaagctcttaaagggtttctggttcaaggtggtggattgactacatgcatttaacttccccttgctctctaaatctcactaacatgatataaaaatacacacacatacagtcacaaagaacacagtttgtataaaagtacgaaaagaaattcccccgactttaccccccatccaaattctaggtcttgcctccatctctagaaatgggaagaatgctgaggagtaagacaaaagaatgggaaaaggagattttgactttttttttaatactttctgtactgtttgatgctttcattagtactgtgtatttttgtaacttttaaagttattgaaggctaaatttaaaagtggtaatacagtagcatcacagcattttgcatttagcttaactagctttcacctaaatttgggaagggtggagggcaaacgagaaagaataaaggaaagagaaaagggagagaaagaggaagaaagggagtgcaagagagaacattttaaatggtgttgtgatttctgcctgacctttcttctttctctctctctctctctaagagacagtatctctctctgtcacccaggctgaagtgccgtggcatgatcataactcactgcagcctcaaattcctgggttcaagccatccttcccactcagcctcctgagtaggtgggactacaggcacatgccaccacacctggctaatttgtttttatttttacagacacggggtcttgctacgttgcccaggctggtctcaaactcttgttctcaagcagtcctcccaccttggcctcccaaggcaatagtatctgatcttttcaattagcttggatctaacccaaaataactctgaaagagctgatgtgaatttgatctatttctggtcctgtgtgctcttcatacgttgagtatcttgtcatgctaagtgtgattctattgttaacaggtccttttatttttatttgtttatatacatttaagtagcatggcttataaatataactacttcattagttgctcaactaacaaagcttatatcatgcacatgtgttgggttttctacatgctccaaggtgctattccaaacttaatgatttaaggtattttcaggggtaatcccattcccctcttaatttagtggttaactctcagtaacatggaaagccagtgcagaaattagtaatcagtggtggaattcaggtgtttttaatattcttcctctctctctttagttctgttttcaatttggataataagtattccttttgtagtaagaaaactaggctgggcacggtggctcatgcctgtaatcccagcactttgggaagctgaggcaggcagatcacgaggtcaggaatttgagactcagcctggccaacatagtgaaacccagtctctactaaaaatacaaaaattagccgggcatggtggcacatgcctgtaatcccagctactcaggaggctgaggcaggagaattgcttgaacccaggaggctgaggttgtagtgagccgagatggtgccattgcactccagctctgtgcgacacagcaagacaccatccagggaaaaaataataataaaataaaataacattatatctgtatctatctacctatttatttattcagagacatggtcttagtcagcctggctagagtgcagtggtgcgatcacagctcactgcagactggagctcctgggctcaagcaatcttcctacctcagcctcctgagtagctgggactgcaggtatgcaccaccatgcctggctaattttttatttttatttttgtagagacagggtctcactatgttgccaggctggtcttgaactcctggcctcaagtgatcctccccccttggcctcccaaagtgttgggattacaggtgttaaccactgcactgggccagaaaactatgtatttttaaaaactttttgaaatgatagctatagttcttattgcaacttcacctggatgatgagcatccagggactctcttctcttttcatgactcaactctattttcataggcatctcatttccttcttctaccacaagtggagcacttttcagtgataagaaatcatagcatcacaattttgcacctgctatccatccagttagaaaacccactcagtcccaatctgtgtcaaatagtatttataaccagcccctcaaatgattttctctttttccttgtgtaaagtgcttcctgaaattataagaaactcaaatttatattaatcagtaagactttttcttcagaatttgaaatatacatagaaaagtgttgtttgtagcaaaaatgttaaatagactactattttatgatataaattaaaagtcagccgagaaacttcagatagtgtagatgaagaactcacatactgatgatgaatccatgcttctggctgcaaaactgaacaagtggggttgggccatccccaaagaacaggtttgaaatcctggaaagacaatcaagcctttatctcaggcctgtcgggtaaccaaatcctttggatccttttgaagttagggagtaaggagcagttgagggatttttactctttaggggaccaggtcctatagaaatctgcccaacctggtagcctaactaggttgcggggttaatggtcctgatcagtagaaagtgagactccaagactgtgtgttctctgtggaagatagacacttggatagatacttaattacaagttagggacccagtttttgtttgtttggttggtttttttgtttgtttgttttgagacagagtttcctctgtcatccaggctggagtgcagtggcgccatctcagctcactgcaacctccgcctcccgggttcaagcaattctcctgcctcagccttctgagtagctgggattacaggcacctgccaacatgcccggctagggacccacttttaataccttatgatgtgatgcagaacaatttctttaatctcatggactcttatttttatagatttgaaatggaaatgatgttgtttattctgcaaattaaatgagaggctccctataggtatacagtgctgaggtcctaatggataagaacaacctttaaaacatttattaagataaaaaggataaaatacatcctgtctatagtacagttgttgggtcttttttagtgtgaaaagtggtagataagcagttcctgaggagcccagtgggaagcctggaaagaccttcgtgttctcctttagtattttgtaacttgtttacttattaaactaatgcctaggcaacaagaatagcatttttcttgcatggaatccatctctaagaaaacatacacctggaagctgtcaacaacaatatgccaacaagccagggtgagcccattgacagagttggcatggatcagctttaatccttcctcacggcactgaagcaaaggacttagaagagtacttgtcaggggttctcacaggaattccactctgcctggctatccaaagatcacagccacctcccctgtcacctgatgtcagggctcctaaggatgctttacagaaagctctgctgaaccaaactcgagatctcaaatagcacaagtccagatataaattctgaaaatccttcttgagatgaaaatctctctccccagatccaccaagctccctgatgacatgccaacttggtctctttgttcattatctccaagatctcaggctggctgctaagccactgcagcagcctccttacctgatgtcccacttatacccccaaactcaacacaacttctctaggatattctgtccattgcaccattttaccccaaattcttaggtgtactaaagttttgttccagcttggattgtgcacagtaactccaatactatcttcaccactattcccatgcctcacccccactaaacctgctgggctgggcctgtactgaatctccgcaccaccctcacccactccaccctacctcaccatctttgttggatcactgctcacttgcagaaagtcaagtgtaaaccctgctagtcatttccactctttttggcctttaatcactcatgatagccctttaatgtgtcccttagactctatgatatttgatagtaaaagaggtattgaaagcatattttctggtcctcctgctttcagattcttccttctgtccctacttctgagatggagactgagtagggagtcaccaaactgatctggagaagatgaactagatatgctcagattatggaccctggcctcagtggggagaaactggaattctaacccaccagtccaactgtcatatccaattttaaactctggctgcgaaccatggctcacacctgtaatcccagcattttggaaggccaggcagaaggattgcttgagttcaggagttcaagaccagcctaggcaacatagtgagacactgtctctacaaaaataaaaataaaaaacatgtctggcagcagacttctcagtggaaagcttacaggccaggcgagagtggcatgacatatttaaagtgctgaagaaaaaaaaaaacttttatcctagaataatatatccagggaaaatatccttcaaagatgaaggagaaataaagattcccaaccaaacaaaagttgagggatttcatcaacaccagacttctcctacaagaaatgctaaagggagttcttcactttgaaagaaaatgatgttaaggagcaataagaaattatctgaaggggctgggtgcagtggctcacgcctgtaatcccagcactttgggaggccgaggcaggcagatgacctgaggtcagaagttcaagaccagcctggccaacatgacaaaaccctgtctctactaaaaatacaaaaaaaaaaaaaaaaattagccaggcgtggcagtgcatgcctgtaatcccagctactcgggaggctgaggcaggagaatcacttgtacctgggaggcggaagttgtagtgagccaacattgcgccactgccctccagcccaggcaacagagttagactccgtctcaaaaaaaagaaattatctgaaggtataaaactcactggtaatattaactacacagacaagcacagaatatcatgacactataatagtgttatgtaaactactcatatcttgagcagaaattctaaaagctgaatctatcaaaaatagtaactacaacttttcaagacatagatagtagaataagacataaatagaaaccataaaatgttaaaaagtgggggcaatgtggtgtggagtttttattaactttctctcctttgttttttgcgattagtgttaagttgtcatcagttttaaataatgggttatcaaggaggatcgcttgagcccaggaatttgagaccagcctgggcaacacagtaagactctctctctataaagaaaaaaaacttaaaaaaaaaaaaagaaaagaaaacaagacccaacaatctgttgcctacaagaaacactcttcacctataaatacacacataggcctaaaataaagggatggaaaaagatattccacacaaatgaaaaccaaaaaagagtaggagttgctatatttctatcagataaaatagatttcaagagaaaaatataaaaagagacaagattattatataatgataaagaggtcaactcagcaagagggtataacaattgtatatgcactcaacactggagtacccagataaaaaaagcaaatgttattagagctcaggagagagatagaccccaatacaataataactggggactccaacaccacactttcagcattggacagatcatccagacagaaaatcaacaaacatccaacttaatctgcactatagaccaaatagacctaatagatatttacagaacatttcgtccaacagctatagaatacacattcttctcctcagcacatggatcattcttgaggatagaccatatgttaggccacaaaacaagtcttcaaaaaattttttttttaaattaaaatcaggccaggcatggtagctcacgcctgtaatcctagtaccttaggaggctgaggcgagtggatcacctgtgacctattcatataacggacactacataacaaggagaatgaaggaactaaaactttgtgcaatcacatgtatgaatctcacaaacataatggtgagcaaagtaagccaggcacaaatgagaacacattatatgattccatttatataaaattgaaaatcagacaaaataaatcagtgatgttggaagtcaggatggtgtttacctgttgggatggtggagatagtagtgaccaagaggaaggcacaagagctacttttgggtggtaatattgttcttttccttgatcatactcacataggttacataggtgttgattttgtgaaaattcattgaactgtaaacttacctacttttctgcatgcatgttatccttaaaaagtttactaaattacctgtacatccttatgataggaaatctagaaaatagaaactatatagtgttaaaaaacagttttcaaaataaggaaacattatgactgtcatatataaatataaaatgagcacatcaaagattttatttaactcattaattaatgagaaaaccagtaaggtgttatagctggttcaaatggatttgatttacagagatctatattacctgccagacaaaatttatttgcattgacatgaacagggatcatttccagttataacaggaaacatttgcattaatgtcaattttctacatcttcacctctttctctacagagttataaatagtctaatcaaagactagtcaaagacaatgaaagtagaaatgaatggatgcactaattaggatacccactacatttcaaaggttttaacatttttacttacaatagagtaaaatcaaaacaacctgtaatccttctattcaggagtaatctatatatacacaattttgtgccatatttttaaatattacataagaattgtcttatatctagagcaaaattacttaagtaaaatttttagaaaacaacttttcatattgagtacaaaggtttttttcccctttgttctaaaaatcctctgttcacatttctggttatttccttaacatattttcttagaaggaaaagtattggatcaaaagatatgaccatttttaagactcttgatacatattgccaagttgttgttgtggtggttgttgttgttgttttgtttttgagacagagtctcgctctgtcgcccaggctggagtgcagtggcacaatctcagctcactgtaacctttgcctccggtttcaagtgattctcctgcctcaacctcctgagtagcgggactacaggtgtgtaccaccacgcctggctaatttttgtattttagtagagatggggtttcaccatgttggccatggtctagaactcctgacctcaagtgatccacctgcccagccttccaaagtgctgggattacaagtgtgaggcactatgcccagccttatattgccaagtattataggaatactttgcagcacataattaggttggagggtgagaggaagcaaaaatctttctaagctactttcatactcccagaattactcctgtccgtaagatttccaggagtaaaacatgtttatagttttgcaactacccaccatctgcctttttctcttcctttgcttttggactttgagcaaaaacccagtacttgcctaaggaaaaagtgtgggttggcacagcaaaccacaaaaatctcaagttctaaccaaatttaaggctgcaagatgcctccctgcactgatggcttcatctgtattaggttataaatcccttgaggaattttctaggacccaattctagccctacttcccgtgtttacacatattttctgatctgttttgccagtattgatttaaaatattttgacagccgggcgtggtggctcacgactgtaatcccagcactttgggaggctgagtcaggtggatcacgaagtcaggagatcaagaccatcctggctaacacggtgaaaccctctctctgctaaaaatacaaaaaattagctgggcatggtggcacacgcctgtagtcccagctactagggaggctgaggcaggagaatcgctcgaacccaggaggcagaggttgcagtgagccaagatagcgccactgcactccagcctgggcgacagaatgagactgtctcaaaaaataaaataaaataaaataaaataaaataaaatattctataagccacatatatctaaccatgagacccaacttaattcaactattctatcaattgcctactgagtgccaggaactgtggtgtactaggcctagagtaagtcgtgagcaaaacagactttttcctgctataggagcagaaaggtgtagtacctttcttcatccatcataagcgttacagttgacactcctataacaaaagacagattaacaagagaaaagcataacaaatttatttaaccaaagttttacatgaaatgggagcctttagaaatgaatagcccccctcccccaaaaaaaagaaatgaatacccaaagatgcaaggaaaactgtgtttttatgctgaggctcgatgaagaatggacagccatgtagaaatgtgactggacaagagagtatgatcttactgtaatagactgaggaggaaacccagcaaggcctgcctttctgtttaggttcttctgggtctctttatgtagcattccttcctcctgagtatgggtaggacccctctggaatgagagtctccaggataaaagggaaagaatgacccagaggttttatggcttgctttgcagaagagtggtcctagtgtctaggacctgtcttggcatagaggaattctgatttctatccttgttttagagaagaaaaagagacaagagacaggagagcagaagagggtcagagaacactttattccgaggtccttccagagtccttcagtttaaagtactcagccaagggccgatcatggtatctcacacctgtaatctcactactttgagaggctgaggcgggaagatcacttgaggtcaggagtttgaaatcagcctgaccaatatggtgaaaccctgtctactaaaacacaaaaattagccaggcatggaggcgggtacctgtgatctcagctacttgggaggctgaggcaggagaatcgcttgaactcaggaggcagaggttgcagtgagccgagatcgcactattgcactccagcctgggcgacagagtgagattccctctcaataaataaaaaaaaataagtaaaataagtaaataaataagtaaagtactcagccaagtgaggtgccatactttggagtaacatgtcctgagtcctgacactgcgctgaggatttagaaagtatgattaccatatactatataaaatatagccatatatatatagaaggagcattatacattttaatgtcaagctatttattattttgttttatttctttattttatagagacaaggtcttattatgttgcccaggttggagtgtctatgcatagggcgcgatcatagtgcactgcagccttcaactcctggcctcaatggatcctcccggcctcatcctcccaaggctatttattattttgttatattggtaggtaggtctcttaccaactggataaaatgctccttgaaggcaggggccatgtctttacttctctggtatactccaaagtgctgagcatttaataggcatccagtggagagcaacccagttgaaaacattagtgcctcatgtctgcatgaaccaagcttgccttccagctcctcacagaatctctgtgggaataagtaacatgattggaaaacatgaaataacttactatgtaagtgatcattttacactttatgtcatcaccaataggtggcaccatcaattttaaaattatatagcccaaaattgtacatattgatggtgtttgttcaatagatgtttactggactccatgtatgtagaaacttctcagctcgccactaccaccagagtaaaaataaaagtattacagacacgctttatcatactttcttttctagtaataccctaaaaaacatgtatttccactttcagatttcatccccgttttaaaaaaacaacatctaaatcttggataacacaaaaacaacggttttacaattttgtccttttgtgtttgtgtgtatgtgtgtgcattccaacccagcttaatatcttattgtaaaagggaaaaagggatgcaaaaataaataaaaagcaaatttaaaaacctgggttttagtgggggaaggggacctatcagcagaatttaacccgagttggctttcagttaacacaatttaccactcctctctttctttccttttggaagataacaaaagtttgattcaggcacagaagaattatttcaacagcttccaagtccgcataatcccatctggagataataaaaggccccattcctctgtgtttatttcaagaggttcgttctttggaatgacctgaggttgcaaactgtagaacagttgccagctgaagagaactgcagcttgaatgctactcaggaagtctctatggacctgggataactcctctgagatttccttagtgtagaaagaggcccctgtgcccttccttctctacaagatgagggcaaaaaagggacaaaagagaaaaagaggggaaagggagcagtgaggaaattaaactgcagtatttgcatcaaacaccatataatagtcactaattcactaatttatccacctactgctgagagaataggaaactctgcccaagtctgccttttttttttttttttttttttttttgagacggagtcttgctgtatcgcccaggctggagtgaagtggcgcaatctcggctcactgcaagctccgcctcctgggttcacgccattctcctgcctcggcctcccgagtagctgggactgcaggcgcccgccaccatgcctggctaattttttgtatttttagtagagacggggtttcaccatgttagccaggatagtctcgatctcctgacctcatgatccgcccgccttggcctcccaaagtgctaggattacagacgtgagccaccgcgcctggccgtctgtgcctctttttactgaatgtctttaaagtgcgatgaatggcattagggagttgggaagatgcacagagggaacatagaagggtttttgtcattcaggagcttccaatctagtaaaccataagagtgtcttgtatagtggtggttagaaaggcaggctgctttattcatttgtaccacaactccaccacctatgcacatttgtgctaatttcaagcaaaggggaatatggatccacctttacactactctgcaaaaaagaaaaattacctatcctcctctgatgtttttagaaattcgaaataaattttaaatgaagtaaagcaatgaggcaaagtttttatttcaaaccatgagcccttctctccccactagttgagaatctctatgatacttattcaatgtgatgaaagattgctcaggctcagaaaggggcaagttatgattggagacaatgactttgcaacataatcaattcatctagttttgctattaccttgacagcctaggtccaggagcagggaaattagatggtgtcctattcagagttgggaatggcaagactggctcatgggccagggatgatgaaaccagcatgctggtcaaagcctttgctaaatatctccccatggagcccaggctcagaaatggctgtccagccttttgcagcccttcctaggctgccataaaaatgtaccaccaggcagcttcaaacaacagaaatgtatactctcacagttctggaagctagaagtccaagactaagggattggcgggattggttttttctgaggtctccaaaggagaatctgtttcatgcctctttgccagcttctgatggtggctggcaattgctggtattccttgtcttgtagatgcatcactcacatctctgtctccatcttcacatgatgttctcactatatttctgcatcttcacatggccctcttcacgtggacattagtcttgttggattaagggcccactctacttctctagtatgacctcatcttaattagttacatctacaatgacactatttcccccaataagctcacattctgacgtactgagggctaggacttcaacatatttcaccgagggcacaaaattcagcctgcaacaggcctgatggcagggaagagagctgagtgttgtagggggagaaggagggactaagggctggtcagagtggcagggagtacagggtggaattctcaacactcaggaatggtggaggtggctttggtctcaaattgatccaagtttaggataactatattggttcatgcagatttaattgtgcctccagttttagaactttttttttttttttttttttttttgagatagggtctccctttgttgtcctggctagagtgcagtggcgtgatcatagctcactgtagtgctaacatcctgggctcagtctcctgattagctgggactacaggcacactgcactatgcccagattttttttgatttgtgtagagatagggtctcactaggttttccaggctggtctcaaactcctgggttcaagcaattctccagcctggacctcccaaagtgctgggattataggtatgagccactgcactcagcctagaacaccactttttaaccatcaggactttacttggatatgtgagttaaatgctttactaaagtcccagtgtagatggattcagtcctctccagaggcttggggtgctaatctggttggaagtgagaagcttggggacttgtcttaagctgtgctttatggcaagctcatcatgtttacatggtttgttattacttagggcaatctgggattaggggagctaatgaagattagggaagccagacccccaatcaacccttggacttgcgttggtctctagcttatccttttatcttgctgacctttcaagatctgttgtaactatattaactcaaatctgtttgttggaaattgaaccaagactatacgatctccatgttctcagactcacttactggcttatgctcaacaacagagagagggcagtgtgcagcgtatgagttaacttttgtagtagaatagttcaagcattttagagcaggctatagccacagacttgcatagtgtggcaacacaggttgtacaacttacgcaaacaaaaagatgcacatttaattgagtacggtgaatggtcacttctggggagggggaggagaataagaggagaaacataaaatggatggatggatagataggtatataggtagatagatagatagatagataatcaatagatagggataaatagaacaagagagaggccgcgaagagactgatgaagagagggtactatagaatgaggagtattattaattcaacctcctgcatctttagtctaaaagaacaagaatagccagaatgtctggattaaaagtgcgaatcctctacccactaggtttttgtaagttagctaatctctctttccctcagctcatttaaaacagaggtaatattagtacctacctcatggaattgttgtgaaaacgaaatgagtcggaatgtgtaaagtgcttagaagagcacctgacactcaaccagtaactaccagtaataaacattcaaccatatggtcaggagaattaagtaaaataatccacataaaatgcttaggcacttaacagtgcctggctcattgtgttcaatagacgttagttaggcagctgttgtcatagtcaacatcattgtcattatcatcatttctttaaatggccaactccattcctttagtcacttacagagaggtagctggacacagtgttgtacagtggaaagagaatgctttctcctatactaatgccacctccatcttttccttttgtgtgatcttaggcaagtcaattcttccagcattggtttctgcaagtaagcctcctacacccattgttagcattaaatctcactctgggcacatcactcatttggaggctctagtgttgaaaccccacacttaactctgtattagctattatgccaggcaagcaaagacaagggcctgaccctcggggaagtcatgttggccctagtgaaatggccagaccattaggcataccatgccctgtacctacgcaagcctcatcagtgcagcctaaacgcatagccccagtgtggagtcatttggaaccattagtgttacatggaagcagggacccaaaccaagatgggtcaatctgggtcattccccattgtctgagggattctacttgtcttgttttgacttttgattttctgttttgtgtcagagttacccagaaattgctttgtgtcgggtgttatactgtttcacatgtattctctcatttaaacctcataataaccctgtgaggaaacagctgctattctcccccattttatggatgaagaaactgaggtacagcattttagagtaatttaccccaggttacacaactagtaagtggctaagccagtagccaaaccacagcagtctggcagcagaacccttgctattatataatactacctcttggaaatttccagggagtttggcagtttgggccaaaatgagaattggacataatctgtgatccaacagtttcactttaatgaatttatgtaacaaatctgtttgacttgctgtttgaattgcttataatgacaaaagaaaaaaaggtaaacatccacctataggaaactagttaaatagtttatgctatattgttgcaacagggtgatgcagactcaagaaaaataataatgcaggctgggcgcggtggctcacacctgtaatcccagcactttgagaggctgaggcgggtggatcacctgaggtcaggagttcgagaccagcctagccaacatggcaaaaccccgtctctactaaaaatacaaaaaattagccaggcatggtggtgcgtgcctgtagtaccagctagttgggaggctgaggcaggagaattgcttgaaccagggaggtggaggttgcagtgagccgagatcatgccactgcactccagcctgggtgacagagcaagacgctgtcttgaaaaaaaaaaagaaagaaagaaagaaagaaaagaaaaagaataatgcagatttatatgcattcatgtgaaactatcctcaagatatattctgaagtgaaaggaacattgcaaaactgtgtattttttattttttattttttaacctggctcactactgacagatgtattttttaaaatattgcaaaatagccaggtgcagtggctcgtgcctgcaatcccagcactttgggaggctgaggtgggtggatcctttgaggtctggagtttgagactagcctggccaacatagtgaaaccacgtctctactaaaaatacaaaaattagctgggtgtgctggcgtgcacctgtaatcccagctattcaggaggctgaggcaggagaatcgcttgagcctgggtaatggaggttgcagtgagccgagattgtgctactgtactccagcctgggtaacagagtgagactctgtcttaaaacaaaaaaagagagagaggagagaggaagtaagaaaacactcattggtggtatggaggtttcagaccctcctcaaaggttcctgttcactttgggtttctagggaaacctgattcagtctgagttcctgaagtacgacgacgaagactcctgcaggttaacattgtggccacttccgtgcctcatttcacttaaccctcacaactatgtataaagtagttttattatatctacattttgcagattactatcaagtagatctgagccaagagtgcaaccaaaacagatcctccagtggtaatcaaaggctgaaataggcctcccctactctgttccatccccactccattcagtttttaaggtagccaagggtctcctagaccagtgcttctcaaaatgtggtgcccaggccagcagcatcattatccgataggaagttgttagaaatgcagattctcagaccctactccagacctgctgaatcacaaactctggggatgggaccagccatccgtgtggttttatgtttggtttcagttttgttttttgaaggagggccttgaactcctggcctcaagagatcctaccaccctggcctcccaagtagttgggactacaggcatgtgcgaccacacttggctgatttttttttattttttgtagagacagggtcttgctatgttgcccaggctgatctccaactcctgtcctcaagaaatcctcctgcctcagcctcccaaagtgctgggattaccaatgtgagctaccatgcctggcccatctgtgttttaatgagcccttcaagtaattctgatacatgttaaagtttgagaaccattgtcctaggctaatggcttcacctgccaaacatttaaaacacactgatgcctgagtctcaccccaacccaggattctgatttaattggtttggatgtagcctggtcatgggttttgtaaagctccccacataaatggagaccactgcaacctgcaccttctgaagcagccactttcattgggaatggctaatgtcacacttacggcataaagacaagctgcagggactagccatctatgtgaggacatcacaacttcccagttttaagtcttttccccttccccaaaccctgcacctaaaccgagaggtatgggtgaaaaatcctccttggctaagcaggtgtgagctcgttagttttgatagcttcatgtttcttactttaagccaataaattcagtctttagtgagtattgagaagatgcaggagagaaaatatcaagttgcctagagaataatgtaatagaggaaatgagatctataaatggcatagtaaaagcttaatattatcagctcactccttcctgggcttatatattttgtactgaaggtcgtatcatatcgcatagcacatctccagtataacagagtttcagtcagcatttgtctaataaattaatctgttaattaatcaataaatgaatggatatcactgatgaagaggctgattctgtctttggcgtccagtgtccaacttactaccaatgctgctcttggcgtgaaactcttggcatgaaagtccattgacaataaatgtgctaggatcaggtgctagagctgaatgtcaccagaaagagactataaacccagatggaggcaaggcacagtggctcatgcctgtaatcccagcactttgggaggctgaggtgggcagatcacttgaggtcaggagtttgagaccagcctgctcaacatggtgaaaacttgtctctcccaaaatataaaaattagctgggcatggtagcgtccccctgtaatcccagctactggggaggctgaggcagaagaatcacttgaacctgggaggcataggtttcagtgagccgagatcatgccactgcactccagcctgggcaacagagcaagactctgtttcaaaacaagcaaacaaacaaacaaacaaacagatggaggcaggaaaggaaaagtgggtatagtggtcattaaagctggtggccaaatatttccaagtctcctccctgggacatagaagggtccccctgtgttgcccaggctggtctagaactcctgggctcaagcagtcctcctacctcagcctcccaaagtgttggaattctaggcgtgagtcacctcaccagtccagatctcccattgtattcatgactcctcatttgccctgtataatcaatggccagagtttgcaagcccactgggcaggattctctgccatggattgcagccagccactggtccaaaggagggtagtctttgttaaattgaggaacgaggtacacaaccctccctagggatccttcctactggtttaaaggaattagaataaagccttatccagagaggggtggtgacaaagcatgcagcacaggtaatttgaagcccaagagctcaaacataactagactgttttgccagccttggacaaagagagtgtagtttttgaggaaaacaccactgtcctgctatctgcacttgggcagcctccagggctgcactgaggtttcagtctctgagtacggtcaatggcatcaactgttctgatggctttagaagaaattaggcagaaaatgtgtgcatatttgaactgtttagggaatagacataggaataatcaaatatgcaaaacctactgctttgagatttttttttaacagatgtgttccctacagaacaggtttctcttattgcctggatccaagagcatctcctgggttcttcctgttagaatactgaatgtccatggagagtttaacataaggaagaagaggcctgtctcccagctgaaactggtgcagcagatcatgcaaagtaaaacctcagcagctgtgatgaagtagagcagagggcctgggtgtctgtcagctccaagcggaagatttccccagctttctaggtaactgtgcttccactgagcaagccagacacagacttgaatgtcatcacaatctgtgcctgtgacatctttccccaagaatagcacaaattgaacttttacattcttcataatatggaaggaaaggtattgactgagccacttctttatgcctcaagacatctcatatgtatttatatggatacatacatgaatgtatatattctgtcataataacatattctatttttcttattatagcacagtgttaggataggctacataggctgcattaaaccctcaaatagaagtttatattatgcatcagaagccagtgcagggactctcctcagcacaacatctctaagtggtgacttggaggttcaggctcctttcatcttaaaatgccatcatcttcagcatttggcctcaacagttgccagagagggagaagagagtatgtataagaccacactgcaggatctgtgttaggtctgcaagcactgctgtcacctctgccaaatcccgttagccagaacccaatcatatggccccatcctaactgcaagggaagcctgggaaaggtcttcttgtatgccaggaaaagaaaatgaaatcgacaagtatctagccagtctttgctacaagtttctacatgttggaattattatctatatttttcttctgatcatgcttagcatttgatactatgtagactgccttgttgagtcctgctgtattttgtgacatccacatgcagcatcccattcctcacaacaggactaggagtggtcagaagttttatcacccactttatggacggaaaccctgagacccagagcagttacatggcttgtccaaagttacatagtactgttaacttaaaaacacaatttataaatttagacaaagaaagaggagactttatttcttataaagggttatagccttcaaagtggctatctcacaggctgggaagctcagccttcagcagaagcccagagacaagcattttgaaggcagaggggttgggatggagctttatgctgaacaggttgactaaatatacatattcaacaggttacaggaggagctatgaatattcatgagggtggtcctgacacatgcgtattgaacaaacatacatgtaacacatgacccatgttcactttgggatggagacttaacatttcaatgtattacagttaggccctacacatcaaaaggtcatttcaggacacaaaagctcacaagtacacaatctctgtaaactagtcagaaccagtccatggttggtggtcttatcaggaaaaagttactaaaattagtctctcatccaatgaaagctgtagttatggctggtggaacaggggttcagttgggcagagtctatgagcaggatgatttgcaattgtttaaatattgcttatcttgaggccagtgcttgtttagctgctggagaaaaagaaaatccttgtggcagttagagcatagtttcttccttaggtgtaggagtacatgacttcccctcacctggcatggccttaggtcctgtttataattcggtatcttattgccacaaagaatctgttctgtgagtcatgtgatctctattggaacattaatgctgctcagttgttgtgtctaaaccataaaagagaaggagagtataattaggcatgtctgacctctcatcatagctgggaactaagtctttaaatttttttctggggtcctcttggccacaagggggtccatttagtcagtgggggccttgggatttatttttagtttacattgctaagtgacagagctttgcttctttcactctgaggttagtggtctctctgctgtgccacattgtcttccccagaagctcaaactggatgcccagccctcagtgtacaaactcaagtatgcaagaaatacatctttattcttttatgaatatacctaatttatatgttggaaggtgtcagcaatgaatttgatcactttggtatttctctacctttaaagatatgtttacatttggggtgggatgaaggtttggtggaggggaaggtggtcaggttgggccaaggtattgggaaatccatttgttcctcatgtcagctgtttgaggaggcaccaacccagatgtccacagttccttctggccttcctttaccgatactgatgcacctgtgcctccttcctgtgtgcatggcccatttgtgcccagcatctccctgctattttggggccactccagggtctgggaagttctgtaggcttataacatacagtcattcttctccccagcttgctgcctccctgagacacagaggtagagaagtaggaaaggacctaccgtacccaggcctttgccctctcacttttcatccatccttcttcccaccagtggagggatgtgtttctagtcttccagggaagctcctctctcctcaaaccattttcttccaaatactttggctttattccaaatcctctctagtcctctgagatttttttataacacaaaacacaacttacagaagttgtgttgttgttttgctgtttatcttgtcacattatttctctaccttgaggcaacaggacaagggcctgctgtccagcgcacggaggcagggaggaaggggtaggggaatactaagaaaaaaaaatttctcgatcacatgtgtaccacatttaactttatcaggtccttgtgaggtgagtatctgtgtgtcattgttctgaaactaacagtgaggggacaaagcattgataggagttcttacaatatatttgggaactcgcaggtgagggcctctcctgcctgattggtctttcaatgtaccatcccaacccacccacctcaatccccatggcttgatcctgctgtctcggtgatcaagctttcagttaagaattgggtgataatgagctagttaatccaatttaaaaaaaaagaattaggatctgggctcagaagccccacagctgtgaaagcctggccgtagattactagtcttctagatgtagaaaagatttttcctttctctggctatttaagtctttatcagtcaccctgcctcagttatcaacacacaccctagagtaaatctgttccctgggggtggaaatagaaggggcatgtcattgtacatccacactgatgaaaggaaaggaaacattaagatggcttaagtggaaaggtcacatacggcttgtactagagagacaccatgctaaagcaaaacatcgtttaaaaaaattctgacttatcatgtgctcagaaatgctcaaatgggtacaaccatcaccaagggtgggatgggagggcaggggaaaaaaatatgaagcatcaaaaaaaattctgatttgtatttgtgaaattcaatagtaaccctattcattaactggattttaaaatcatttcaaagcacattcggctttcaaaagatgtttgtttaaataatacagttggcttttggtcaaaaaatgaagtttcggtaatgcatagtaacaactgtagtgtaattactggccacaaaataccaggtgccagaccaacccttttcgaaccatttaagagaaccaagccaagcaaaaatgcccagcctagccttacccagaagttcaaaagctcagcctttgtcaccaggaaaaaattaattcaaagagcaaagccattattcggcacaaccaggtattctgttgtaaacatcttttgttaatacatgttgaaagctgaactttctcacgtttgagtgaaagagggctgcttaaagagagtttaaaccaagccaggttcaaggtttttttcttttctttctttttagatttctgacttcatatctgtgggatccacacaatggggaggtactggccttggaatccatggttccccagctatcattttactttagaattacagtgttctctgttagtgtcaagggaatgaacctgacgagaaaagaccaaacataggactgttacagggaagaaaaatatgaaaagacctaaagatgcacgtcctcattatatgtaaggaatctatttcctagaatcctataaaaagctcaagtgaatttgcttcagttaataaatgtgatttaattataatgataatgccacagcatatgttttgtttcctctttttgaattgctccctgttaattattgagagaagaaattcagtgtaacttttttgtaatctgataatgatgaggctgtctcatgtgttccttatgtgcttcacaatgtatgcgtatgtgtgtgtatatagttaagttgaagaagacggccatgtgtgggcgctacagacagatgtaaggctaaagaaagggctccatggtgttagagcaaaacctcatgataaaaagctcttttttatacttaggacctgattgtattgggaggaaaaacaaacattcagtcttggaatgacctgaaaaacctgtggtatgaacctactcccctttcctcaccctgggattagaatgaagttctacagttcagctaaggtgaccaattcactttggttcatccatgttccatgtctcaggaagacaggaagagtctgggctaccctaggttcagctgatggagtctaatggccctgtatgcctgcctcttcaccagtaggatggtggtggctgacatcactgacatggactgtggggctaggactgttctgaccaccttatgtgtccctctcatttggtcctcacagtgtcctgaaaagtttggtggctatctgcgtttcacacatgaggaaaccaaggaaaaagagagtaagctattaggctaaaccacgtggaattcctgtgtgtgtagatcaaaaaggttaaatatcagcaaatgcatattattcagtctacaacttgcccaatatcacagagttggtaggtggtgatcccagagtctgaactctcaactacccaggatcatagctacatatctgtattatagatgacagacccaggctcaaagcaaatgcattatatacatatatattgctatcagcagactacatcctttcttctccagtctgtggcttcaactgctgattttattcaggtcatagtgtgaaagttggctcaagtcagacaagactgccctgcctgtggcctgttcctgctgtgcagctaaaagcagcccatcaaaccagctctctcaggctggctgcctcaaaacctgcctgcctaaaaatatctttctctcagatggcacagagccatacactccatctccccagctgaacttcccaccattagaacgactcagctacccacatgccttccacccgagccattgttaaaattcaactgtgaaccctataatcctctcctgttaacacactaatgattagcttatcaggttacatgaactcgatcttggatcaagtgaagtttgtttgggagttgggctgcagatgggtaaggtcaggagcatgagagtgaatcatggactattagatgtggcagtaacatcagaagctgtactggccagtcccagcattttacagatgaggaaactgatgtttaggtgccaaagcctaggtgtcttgacttcagggtgaccaaccatcccagtttgcctgggactgagggatttcctggctgtagaactttcagtgttcaaacctggaaagtcccagacaaactggaacagactgaccaccgtgctcgattgggagcccaaaactcttctgcttgtctggacaagtcaggtttgagcgtgcccttgcagtaagaacccctaggctgcttggtacagctcaaaaatgccaggtggggaaatgaccacagacctggtttaccaaggctggctccccttcagtctctaagcatggacttggatgccatgtgggagcagccatattgccccatgactgaccaaagtgttagcctcttgggccacagcatttagggaagctggttacatagagatggtctcagaaaataaggctgtggtatggtttgtgtacttcacagagataggaccactgtgtcagccacagctctgcggttctcaaagcttgggggtggagtgctgctgctgtttgtctctgctgcacatggctgcacagatgttgggaatggagaagtatttgggcagggagatggatcagcagggttccccgtgctatcatcatttccttttttagaagttttgtcatttagaggttttgaatcttgcaataagcggtcatccttgattaactttggactttttcccttaaatgtcaggcacctaattttaaactttttcctggttttacttctcctcccaggctattttgtccccagtccttggttgcttggcagttgtttccaatatagcgcctcctgctttccattcagctgggatccagctctagctcatgccctgtacctggggcctatgtgtgtaaactaaagaagggaaggatgccgggcatggtggctcacgcctgtaatcccagcactttgggaggctgaggcgggcagatcatgaggtcaggagatcaagaccatcctggccaacatggtgaaaccctgtctctactaaaaatacaaaaattagctgggcgtggtggcacatgcctgtaatcccagctactcgggaggctgaggcaggagaatagcttgaaccagggagtcggaggttgcagtgagctgagatcatgccaccacaccccagcctgggtgacacagtgagagactccatctcaaaaaaaaaaaaaaaaaaaaaaaaaaggaaggaaatcaggaggcaaggaaggaataacacaagaatcccagccaggcaaaattgtcagtgtaagttctctttaatattctctttcctgcatacattgctttaacatacccccaaacccacctccacttccagccctacctctacacacatctacgagaatctaaacttttcatggtccacccttgctctcaaccatcactaaaatgtccttagtgcccaaataacaagtttactgatctggtaaatgaatccctgatgatgcgggttaaagttagaggtgcagccctcagaagtgaatcttaactttgacctttatagttaatatcctgccgaggctatcttaacactttaataaatgtagttcttatggaggaactgtggagctgggagggcaggtagtggcaggaagcatagtggaggattattttgggaagagctctgtgataagctcttttttctttttaacaaagaaaaatacaggatgcccagttggatttgaatttcacataaacaacaaataattttttggtataaatatgttccatgcaacatttgggatatacatatacccaaaattatttcttatctgaaattcaaatttaacggggcgtcctgtattttacctggcagttctatctgtgacctgtgatgcctcctaaatatgcagcctgtgcagtagacgggcaggattgctgtggagttcagaagtttccaaattctggcagaaggcaaccagcccttcagggagggcatcgcacaatatagtcaggtgaaactgctgcccccaaagccagccctgctgatgtctgggggcatccaaggcaggcctgaatggaacatgcccagagactggccaaggtgccagtaaagtgggtgtgttctgctagatccttccaagaacataaagtgtctagttctggtgctgacaattgacctaatatctaccacactagcacactatttttaggcctaaggaaggagtgcaagattttaaaaataaggtagtagatgtaggggaaattacattcaaaaagctcaatcctgaatgtgagtttaagaccaggaaatgcaatatattagatctagaaaaggttagtacaactagctttccatatataaatacctaacactggctgtgcatggtggctcacgcctgtaatcccagcactttgggaggccgaggtgggcagaatcactcaaggccaggagttcgagaccagcctggccaagatggtgaaacactatctctaccaaaaaataaaaaaagtagccggacgtggtggtgctcatctgtatgtagtcctagctacttgggaggctgaggcatgaaaattgactgaatccgggaggtagaggttgcagtgagccaagattgcaccactgtactctagcctgggagacagagtgagactctgtctcaaaaataaataaataataaatatataaataaataaataaaaataaaataaaatacctaagactaagaccccacacttttctttcacttttttttaatgaacaaagataatgctaccagcttcaggaaaattgcttttgccacccataatgttttgttttcaactaataaagacagaggctgttttgttgtctgctattggcttccatatatagccgacagctataccctgtctatacttccagatctactctctacccttctctgtcctgctctatgctctgggaagctgaccccttatggactcccttcctttctggattctgattagggccagccagtgggaaacaacaataagagatcagatggtgggaagacagaaagatcagaagagtagctttattcttgttggtgtttattaaaatgctcatgatttcaacaacttggtaaaaagcactcaataaaatagaaacagatgcatacttctttaacatgatacaacacatctagccagcattatgcttgatggggaaagtctagaggtagccccaataaagttaggaatagacggggtgctcactatcataattactatgtaaaattttactgaaggtactagcaatcatgacttggcattataaaacttcaagtataaaaataggaaagtaagaaaaatattttcattatttgtagatgatgtgactccgattttaaacccaagagactcaactgaaaaattattatgaacaataagacaattcagtaaagtataaaggtggaaaattaatatacagaaaccaatcaatcttatatgtgcaaataataacctactggaggatataaggatgaaggaccttatttaaagtagcaatagaaaaaataaaatacttgggaacaaatttaacaagaaatgtgtatgccctatatgcagagaactttaaaataaaaccaaggaacccaaacaagctttggataaatagaaagaacatacctgggtaggaaaaataaaaattgttaaaatgtcatatctccctaagttaatttaacattttaacacaattccagtaaaaaataccatttttttccctttcaaatttggcaagagatttctcaaatgtatatgtgtgagggagaatgtggaatggttagccctatcaagtattaaaacacattataaagcctcagtagttaaaacaatgtgagactgatccataaatggacatacagatcaatagaacagatgaaaatgttctgatataaacccagatacacgcaggaatttgtatacaataaaggtgacattgcaaatcactagggaaaagagagactgactattcaatatattgtattgaactagttgtaacaagttagcctagttctaggcaggctgtaactaggcagccatctggaataaaactggatctatacactatacacgaaattacaaagacatcatatatttaaatgtgaaaaaccaaattaaaattactagaggaaaactatgagaaaatgtctttataaccttggaaggtccttgtaaatgtgacttaaaatatataagccattaaaaaaaatgataaattcaattatgttaaaataaaaaatgtctgtgtggcaaagaaacaaaatcaccataatcaaagttaaaagacaaatgacaaactgggaaaagtattttcaactcatgtcacaaagtactaatatcccttatatacaaagcaccactagaaataaataagattttaaaaatcaacaacccaatagaaacatgggcagtaatatgaatatgtttgtcacattttcaaaaatctaaaagttttgacaatctaacttatggtattatacattggtaagactctatgaaaggtaatttggcaagatctgtcagtcttataagtgcttatccttgacccaagaggcacttttcaatgactctatcctgtgaatatacttaacacataaaatgacctattattaatagttagatttatttaatcatctcgtgtgtgcatgtatatatctcataacatcacattgtaccccataaatatatacaattatcatttgtcaattaaaataaaaatttaaaaatcatttaaaaaatggccaggcacggtgtctcacacctgtaatcccagcattttgggaggccgatgcgggcggatgacctgagatcaggagtttgggaccagcccggccaacatgggaaaaccccatttctactaataatacaaaaattagccaggtgtggtggcacatgcctgtagtcccagctactcagacggctgaggcacgagaatcgcttgacctgggaggtggaggttgtggtgagtcgagatcgcaccactgcactccagcctgggtgacagagtgaaactgtgtctccaaaaaaaaaaaaaaaaattcattaaaaaatgacccaggtcaaggtcaaggtaacttattgcagcatgacttgtaatagcaagattagaaacaatccagtattcatcaatatgaaactagttaaataaatcatgatgcatccatgtaattgaatattatgcagctttagaaagaaacacatagagggggccgggcgaggtggctcatacctgtaatcccagcactttgggaggccgaggtgggtgaatcacgaggtcagaagatggagaccagcctggccaacatgatgaaatcccgtctctactaaaagtacaaaaaattagctgggcgtggtggtggtcaccgtaatcccagctactcaggaggctgaggcaggagaatcgcttgaacccaggaggcggaggttgcagtgagcagagatcgcagcactgcactccagccggggcgacagagtgagactctgtctcaaaaaaaaaaaaaaaaaaaaaaaaggaagaaagaaatacatagagagtgaagatgtaccacatagtatattgataaacagtacaaacctccaagacatttttaatgaaagacacaagatggagaaccatatgcactgtttgctaccttttgtgtgaaaaatgagaaaaatagagtatatatttgcttatatatatatacacatatgagtatatttatacagaatatatattatagtatatataatatgatagtatttaggatgtatatatttgcttatatatacaaatgagtatatatagatagtatatattatagtatatgtaatacaatagtatttgtatatagagagtatatatttgcttatacatatgtttctggggaaaagtgaggagatttagtgaatggaagatagagtggggaggttaactttttactttttatattttttaaatattcaaatcatgaggattaaatatgaaatacataaaaagtgcttattaaaaaatcaaacaatacagaaatatgtaaggtaagaagtaatgttcctctacccttaaaactgccactcagagaaaaccaatatgagtagtctgttatataccttacaggatttagtcattgagaaacagataggagacttcaaaaaaattacttattaggcaaggaaagcattagtttctgggtcctggcagtcacattgttctggcactaccaaatccacttagaccacatataagcagctgagataaatgttgatctcttgccgcacgcccacagtgagctgctctcaagagacttcacccaatcctacgggagttcagttatatgtaaaataagaagttagaaaataattctgaattaggtggcattttaaaagtgaacggtagaggccattaacgccactaaattaagtatgatggtagattttaaattaagacattaacatttcagtaaatgaaaatgcttgtgcagtctgcaaaattcttggcagtagtaccacagaattcagccagtaagggctcctaagttacaaacataaagagtcccaaagaacacaaagaatcattctttattttccactgctattattaaaaattttaaaaatatattctagatggagcctgctagttcactagtgcaataaagcgagcctcacattactgagacctcctcgcaatcctgttcctttgcctcagaaaattccttgatgagtagaatatgaatgttataaatatttattaacaaaaatatatacaaaatgaaatatgcagccttcctatttcaacataaataccaaggtctcttgctaaaccagcagttgatattttaatacatgtgccctaacacaacaaaacagtgtttatgcaacacactctttcccgtcatcttataaaagcagtctgttgatgttggaacaaaccttagaaagtttagtcatgcaattgttcattcaattaaggaacatttaccaagtatctccacatagcaggtaaagtaaaaagtaacggagataagaagatgaatagcaccatctctggctcttgaatttaagtctaagccaattcttttatttttatatcaaataatctctaggtttctcaagttcagaccataactttttattatgtcaagtatcatgcatttataaaaagaactaaatattttatatttgtgggttggcagtggtctattcttccatcaatgttgttcacatagtcattttttgttttcagatgattatttcagaggatctgactgctcttcatcttcatgaataactttaaatacattaatccagttagcctcacaacaaccctcattttacagactaggaaacttttgtcagtcatgctgaattactttctcaggctctcacagctagtatctaaactcaggtgtgcctgtctcacacttatattctctacacaatagtaaacagcaggatttgtagaaatgtaggctagagaaattgtaatttgtattaattacatgattgtcatttgttaaaacctcagctgcttcacagatgatttcttagagaaaagtatactatgacagtaaacacaatgtgtttccgaggttcataagactgtgaaatgataccaggtgactgttggtttccgtcattacaatattgtacattaaaatgaaaacatataagtgaagttactgctatttcaattgtatttctttacattttatcatcaaaccttcctatagccttatcttttgttcatttgaactgctttgctatacatctttttactatccatatcatctattatatctttaaagataccataatatttttatattatattattatgtttttaaaagatacttaatctttcttcttttagccacattggtgtgactctcctcctaacacactctttccacataagccttctgaaaaacaagacattcactcatagtgaatgatcaatgcatagcttgctcagagcagggtacacatttttgaaattatgaaggtgagttgtagtaaaagagataatttaagttgaatatgataatttgatagaatctggtactgattgtcagctttgaagaccttgtaccacagaatcagactgcaaaatcttagagtgatattcttccaatgagccactagcaatcagagagaggtttctgggggccctcgtactttctgttttatgtatttgcagatttggatcaagagcagagggttagtaagccttaatcaagaaagaaaaaaaacaaatacatggaaatcttaaattgaattccaacatgaaaattatggcacagtttatacaactttatgatatctcagttgcataaaattatacttcacccttcaaataatgacatacaattaaatgaggtctatggcaagtactatcatatagaacgtgatccctacaatgtttaatcattcacaaagcattgggaggtgtcttggggcctagcccagtgaaaagagcaaaggttttgaaacagccaaatctagaatttcacatgagctcttccatggaatcttggccaagttactgaatcagattgaactcggctttatcacccgtaaaatggctattgctagtattagtaatgacacatacaaagtgtttggaaggagagctttgtacataatgctcaataaactcaagttttacctgaggcacttcacacagtacacaacagtgttcttaaattaaattgaattgattataaggagatcaagtgttcatattatctaatcttccaaccagagcggacaattgaaaagatgtatttcctgctaatacagtacttactttcccaggaggctagactgggcaaactttagcaagaaatgtctccatatatagtgtacaaaaaaatctccctctagtttatgaatccgtgttgtcacaaaacatttatttattcagtgtttagagcttttttaaaaataaaaaataaaaaaactacagtgaccttattaggttaggtaatagatattttaaccaatttgatttaaattgttaatggtgtcgtctaggaatttaggggagaacagtcaagaaaaagaaagaaacaggtaatagttgttgcatctcaatgcagttcagaaaacatgagtaggtccaccagcgtgtggtagcagaggaaattctcaggcaccagttgaaagtaaaagcttggtattttatagtttccttttgtaagaactcaagtttttgttgagttgcatattttatattttctggaattttggtgtcattttatccatagttaataatattgtttcaccataactcctctttgattatgtaaccagcaaagtttctaacaataaagcatattttaggggtacataccttcctctcagtcaatgtatagaaagtattacattatgtattaaaacctcagtgccatgacaagatagtcaacatctttagtcatcagaaaaatacaaatcataactacaattgtgtgtgtgtacttatcaaattgtgtactttatatatatgtaatttattttatatcaattagacctcattaaagctatttttaaaatattatgtgaattttgcagaaaatgaaaagagaaacccctgacctcagctatcaggttggctacattaactgcctgcctcttttgcatcatcagctacttcctggctatgggcaagtgtgatgtttttttactggactgtaaggaccttcagagtagaatccatgtttaactcaactgagtcttccttcaaactctctcactaagtattcaactgttgttttttaaatgaaacataaattgcttggatagtttttggtgaaacatttcagaaaacatttctacctaaattccctaatgaacctttacgattttttgaactatgcatgggaggcagcatatcttcatgcttaagaactttaaagtcagtgatttgttcagctacttactaaccacctgaccatagataaaattatctcacctctccaggcctcagtttgctcatttctaaaatgggactgtaaaggacctgtcttggattttctgagaggattaaatgatataacccatataaagtacatgggccatatttagcactcaataaatacttgttgtttttgttgtgttgttattgctttccatatccctaatatattgtagagaaataaagaatctaaaaattcgggttattatgcatagtaagcatacaagaactgttagcagggaaaaagacaagtgaattaatacactgaccgttacaaatttttgaaagtttacgaactccaaagactgaaatattccatctttcatcaggagaaagaaaacgtgatgaacaagttacctgaatcttacaggagggatagctctaaactgacattaaagttacctgcatattaggctttttagaatcacacaattagagaaatttaatttattggaagaagcaaaagggttttaacaccttatagtcttctcagtacattttgattcttgctcttagaccttttcattaaataagaaaaattaaaaacctgctggtacgtagagaggctaaagttgcaaacagctcatttactttctccctacccttcacactgaagttcttaaatgcagaaatcctgttctcctatttgtttgcaagttttctctctagtgaaaaatacttcatcattttgtccttggggaattcattaaacagaatgtggaaaaatgtaatctttagggagttttgctgtgagtactctcagtaaatacagcacaagccaagagactctacagagacctgacctagagtagacgaagcctgggccattgtcagataatcatttccttgagctttgaggcagtcacttaattgttttgtcacctctgatttttgtaatattgggcctaattgcatctccctgatttgtggggagtgtttataaaatatgtacaataattattatcattaataaactggattattaatcccctccaaaaataatgtgccaacatgtcaataaaatttacaccttatcctttaagtctggcccagtactagatttgcctttaaaagtccaagtcagccgggcgccatggctcacgactgtaatcccaacactttgggaggctgaggcaggtggatcacctgaggtcaggagttcgagaccagcctggccaacatggtgaaaccccgtctctactaaaaaatacaaaaattaactggcatggtggttcatgcctgtaatcccagctactggggggctgaggcacgagtgtcgcttgaacctgggaggtggaggttgcagtgaaccgagatcatgccactgcactccagcctgggcaacagagtgagactctgtatcaaaaaaaaaaattccaaatcaatttgttgtatgcgaagaacataataccatgagtcaggaaatgttattctatttctggttctgccagtagttacctctgtggtcattagtaaccacttcactcttcagtttcctcaaatgtaaaagtaggaatttggactatatcaaggaagaaacatacctgatatgtgccaccactcataattctgtgcccatggcagacattgttaatcaatcattgaactttttctaccaaattgggaagctgtttttgaatacttttcagcaaagcactgtaggcagccactaccaatgtatcagaattggcaatcaaagtgaaatttgcttcccatctccgggccagaagacgtctaaggtttttttttaattctaatattactcaaagggcaaaatgagagtccatggaatagaaagtgtcaggagacaattatgttggcaaatctcatttcccttttttattttccagcctccaagaatgttatagattatctgtaaggtctgtttatgaggatgctctgctcttccattcgttgtagtctgctttttgtttgttcaaagtggaaatagtttaattgtttttatcccttaattctaaaaatgctttctgtaaggatttgaataatacagaaaaatacaaagatggaaatgaaaattatctgatattctactcccattattaatatttgagaactgtccttgaagacatagctctaggcataatgtttttctgtattttattttccccacaaagcgatgttacgtttgggctactttgcctgttactgagaggctgcagttcttaatctctattcataaaattttgtctttggtaattcctgttctgctgagttaaacgttgcaaatatagcagtaaattggaagagaaaggatctttagaaccttacaacaactacacttaaagatgtggtaaaattctccaggctccactcaaataaatacaaaatggaaagatttacaaagcttgtggttataattcaatttgaaaataaaacagatccagtggcatgggagaaaagcaacgttctttccttactcccacaccctactcccaccttttttcttcttcttataaaagtaatgtatgctggccagtcacaatggctcatgcctgtaatcccagcacttggggaggctgaggcaggaggactgcttgaggccaggagtttgagaccagcctgggcaacatagtgagactaccccctctacaaaaaattttaaaattagcagggcatggtggtgcatgcttgtcatcccagctactcaggaggctgaagtgggaagattacttgatcccaggaggtctaggctgcaataagccatgatagcaccactgcattccagcctgggtaacagagcgagaccctgtctcaaaaaaaaaaaagtatgtttatttatttagaacaatgtaaacatggaaaaatgagaaaaaaaagtcatcagtctccatctagtcaaaataattacggttaacattttggagtatatgcattctgtcttttttttctgtgcatatatatttatataggtatcaacacataaaattcaaaggactcttttaaacatttttctctttactcactgcattgctgttgctgcaggatactttttctttatgagcaggaaactacacaagttaaaactggctttggagatgtacagctcattgtaccagtagtttgcacagtgaggtgtacaccccagggaaccaaggatgcgggtgtgttttgaaattaatacaccaaatattttgaacactgctttactggagtttgttattttatttacttatttatttttcgagatggagtttcgctcttgttgcccaggctggagtacaatggcgcgatctcggctcactgcaacctccgcctcccggattcaagcaattctcctgcctcagcctcctgagtagctagcattacaggcatgcaccaccatgccaagctaattttgtatttttagtagagacagggtttctccatgttggtcaggctgatctcaaactcccgacctcaggtgatccgcccaccttggcctccctgggattataggtgtgagccaccgcgcctggcctatactggagtttagtttatccactgggcaggttgctcaagttcaaactccctaagcagatattcagcgagtatcttacataactggcacaaatgaggtcatatcacggtcagaacctctgtatgcatttatccctccatctacttcattgataaaatgtctgtgttcgtgaagtgtattttgataaggagactatctctccatcgtctaataaaatgaaacttatgcatggtgtgatgaggttttttactttgtatgtagcaacaaagatatgttatgggaaagacagcttcctcattcccagggaagtcattttcttctgagagtctgagttttattaaatcaccaagtatcatctccctgtttgtgctcccaatgttggttaacaaacaaagagcagccaggggaaaccctgcctttgatagtcaccatacatacagtatgctgttttggttatcaattgctatgaaacaaaccacccccaaatttaatagctgaaagtgatttattataatttctcacagttcttggtgttgacttagcttagccagggagtcttctgccggtcttgcttacagtctcttgtatgtgactgcagtcatatagcagctggagctggagttctttgggggcttgaataggtgggctcgaaggtccaagatggtttcttcattcacatgtctggtgtgttggttcacatagtctctctctctccatttagagtttcatcttccatgacttttcccatggcctctctttccatcaaggtagtcagacctcttaggatgatggctgacttccaagagtataaaattaaaagctgtcagggctttttcaagcttaggttaaaacctggcataatgtcacttctggcctctttccataccttaaagcaagttgcagggccagccatgcttgtttcaatatgaggggactagacaaatgcctcaatatcaggagaggtggtttactgggtgccatctttggaagctttctatactttacactggacaaagtagaatttcaactacaattctaaaagattatgaatattttctggctcaaacatggagaacaattgagaggaagtgacagagagaggaagaagcctcaaagtgatggaggattttgaaacaatcggtactttcttgcaccttgcaacttggcagattggagcacaaaggaggtggaactaaggggtcaatgcatcaccattatccagacttcttatacccagaagacttacttgatgatactttttttttagacagagtctcactctgtcgccaggctggagtgcagtggcgtgatctcggctcactgcaacctccgcctcctgggttcaagcaattctcctgcctcagcctccctgagtagctgggactacaggcgcatgccaccacaaccagctaatttttgtattttttagtagagacagggtttcaccacgttggccaggatggttttgatctcttgacctcgtgatccgccagcctcggcctcccaaagtgctgggattataggcgttagccagagcacctggccaatgatgcttattttttatgagcaatctggagcaaggtatcacaattgacacatctcaagcatgtagggaaggccgtcttcccaaagacagcaaatgattcaggaatcaatgaaaaggtacaagagtcaatagaacataaaaccaattggagggtatttttcccaaatagtagcgaggagagcctggcagcaaaaaaggatcccatggcagcaagacaggagagaaaaaccagcacctcctctttcttgttctttcttgctcctccagagcttctcaacatgcattatctgtgccctcctaacacaataggcaggtttggagggcaaagcaagggctcaggctctcatatgaagacaatcacattccagagtctgccaagattgggcacctccttgacgtgggtggtcttgagaatggggttccctttatttggctaaaccaaatgccaaacagcttttccttagtgtttgtttttcttaaacaagttcaaactcttatcatattgctcccctccctttgaaaatatgtactctgcagatgcctgaaataacacactctcagcaaattgcagcattggaaaagtgaaggttatttcattcagtctaaactcaatggaaattttgtggcttaacaaggaaataccaaatactttataaactcctttagagcagtaaccatgtcatatgactctggtatctcctacctactaggctcattgtctaccttctctgatgtcgtaattttaataagtaacttgaattgttaacaatttactcttgtctttttcttggactcagaaatgttattttattattatgtctctgcatctttcatgtgaggtcctttgcaaacagttttctcctaacttgttttcattgtgcagatcatgttgcagggttttcacataacagctgaaaggaattaataggagttaaagaagcttgcttcaattacaagtaattaatttaggcttcacttatctcaaggaatatctgaatatacaaatttacacataaatcctgggagtgtcaaattatgcaacctagagaaagtaagctctgcagctttttgggcgttgattgctatagtcaggggtgtgtgtgtggtttttgaatgaaatagcaaaaccactgccagtattatctacttcacctggttttgaataattccaggaagctagaaactgaaaaccagtcttgtatagagttagaaagattgtaaatgcagaagaggaagaaaaaaacaaaactaaaccatttatctatcctctttgaacccttataagagttcacaatattcctcgtttcaaatacttgaagtcttctctgggcaatgattaatttttaaataattgtttttaatgtaagacataaaacatacgcactgcagatttaaagcatacttggaagtaacaaggagaaacataaaaatcgttgattccacagcatttaatatattggtaaccttcaatttttttctaggcacgtttttataaaatgagccaatactatacaaacgtttttgtaactttttttaatttgtactattttgtgagtacgtgaaaaagaaatttgtaaagagtaaacgattacagcatgttgtggtattacacactgttgaagggcgccatctgtggcgtggtggctgcgctttggtgggaagaggttctcttggggttcccgtttttctcccagctctgggtgggcaatactgaccactctccgacctaaaggggcttctccgtttgcctttgacgacctgagcttaggagaatggagacacgtgggagttcagaggagggcgttcagggtgactgcgaacacgagctgccggagctgtccacatctcccctaggcagggcccactggccccagcccgggaagggagcaagggcgggagggcagttggcagtggcacggtctgggtccaaatctttagccccccccaccccggctggcgccattctcgggcggtaaagtgagataaaagcagggcaaggttctgcaactccaaatcagggaggcgcagctcctacaccaacgcctttccggggctccgggtgtgtttgttccaactgtttaaactgtttcaaagcgtccgaactccagcgaccttcgcaaacaactctttatctcgcgggcgagagcgctgcccttatttgcgggggagggcaaactgaacgccggcaccggggagctaacggagacctcctctaggtcccccgcctgctgggaccccagctggcagtcccttcccgcccccggaccgcgagcttcttgcgtcagccccggcgcgggtgggggattttcggaagctcagcccgcgcggccggcgggggaaggaagggcccggactcttgccccgcccttgtggggcgggaggcggagcggggcaggggcccgccggcgtgtagccgattaccgagtgccggggagcccggaggagccgccgacgcagccgccaccgccgccgccgccgccaccagagccgccctgtccgcgccgcgcctcggcagccggaacagggccgccgtcggggagccccaacacacggtccacagctcatcatgatggacttggagctgccgccgccgggactcccgtcccagcaggtgctgcctcggccctctgggccctgcggtggtgccgggacgggggcgggggagctagggaaccgcggcccgggagggacagccgcaaccggcttcccccacgtctggccagagccaggaccgcggcgctgggtagagccgccgcgcttgcgccggggcagggcggggaggggcagcggggacgcggccgggtgatccgaccgaccacgagcccgagggcgaacgggtgggaagttgcgggaaggtctggggactgagcccgctcgcgtgggccttgggggagaatccagccgcgtccccgggcccgagagctgggactccggagcccctaagtttgagcggcccggtgggcggcggggcaagagggggcggacgctggccgtctgagccggcgcggcccggcccttccggggctgcgcggctcccccgcctcggtgccggcaaaaatgtgcctagtcacggggccgctctcgggggaactgaggtcgccttcgggctgggacccggagccccttcgccgcgccccaagacctccttgagtgcgggctgcgacgcgctcaccccgctgggccgtctgtgggcgcggctttgcgaagtcatccatctctcggatcactctctggcagccttgagctctcttgaaagcccagccccgggacgagggaggagcgccttaagtgcccagcgggctcagaagccccgacgtgtggcggctgagccgggccccgcgcactttctcggccggggaggggttcgggctcgggcacccggagttggcccctcgtaacgccgcgggaaagtgcgggcgagggcagtggactctgaggccggagtcggcggcacccggggcttctagttcggacgcggtgccccctggtggcgctcaccgcgcgcgtggccttggcttccgtgacagcgctcggttggccgtcacagcagccctcggttggccctttcctgctttatagcgtgcaaacctcgccgcgccagggccaagggacaggttggagctgttgatctgttgcgcaattgctattttccccagagcggctttgtctttggatttagcgtttcagaattgcaattccaaaatgtgtaagacgggatattctcttctgtgctgtcaagggtaagagttgcgagtgtagattagaatttctgttgcttttagtctgttagtaattttttgctttcagctattatttctcccctgagtactttatatatgtttccttttcagttgagaatttgcctcaatttcttaacatgttccccctcttctgcaggggcagagagtggaacgcttgcgtttcaaaacacttgctaatttctgtgaattgttataaaagtgaaaagaagtttctgctcatcctttgtagaaactttaaaagtagatatttatatttctaacttcttttgtaaatgaattttaggaaaaaaattggaattcaaggaaatgtgtacttgatgtacagtaaatacgtttatgctgttaaatgtaaagttttcggttaattccaaagatctattgtaaagttttaagttatggacaatgtattaattgtgcttttttccccctttaaagttgtttgtcttgaacttttccccagtcttcattgggattgtattcttctggttccaactagtgaagaattaaattgtaccttccgatttatttaatagctgctgttcaagagttatctataggaatgcttgtttgactgaaggatatatgataaaaatgaactttagtttttctgatttccggaattgtctacagccctctattatttttgaatttttctttctttgctgtgtaatataacattccttatacaaaaatgcgtgaaacatatgtaccgcattaagtgtgtattttccaattacgtttgataaaaataactgcttttctacctttgtaatcagacatcgatttgcatatttgaaaacagaaaaagaacaagaaaatttagaattgattttgtttatgattcatattagattgttgtcatccataaagatttgaacagagtcaaacattttcttgaccttttgtcaaaaaaaactctccaggtgtgaagtggtagtaggatatagtttttcaccttctgtgcagaggatgtgttgataaacagggcagtaaggagagccttagattcagtatctccattaggtggaaggaaccatccattactcttttcaagggtgtcttggagagataaagcactttcctagatgagggatgaagttgatattgaaatagaccgatgagattatttttaagtcaaacaaaagaaaaataggacaggcctctcatctcctgaatgaatgttaagcaaagaacaacttgactttttagatatgtgaaaaatctcttgagaggttgtggaagcagcatgtaggaggataaatgcataactcacatcagtcttttacgcattaaaaataacttgggccattttgaaatctttctttcttgccctgggttcttataagcaatgttggggggaaaactgactctgtctttaggattaccaggaaaagttgaaagccaaatgcatcatttttcttaatatttgtttttattgaggataaatcatgtttaacaaagctgcatgaaaaaaaggaacccaacaagtacatttttttttctgggaatttcctctgtcctgactgaagacatttaaagggggttttgtgtcaatatttcctccttaactgttcctcaagcctgggttaacttttcagtatgcaggaagaatttggcactaagataataatagataagttactgggcacgtccctgggtgccagacataattgcttcacatgcataattttacagtaacctcacgggaaatattattatccctggtttccaggttgggaaaaccaggcataatagttagatcaggcattaggttaggaaaggttaggagagaggcatagagaaaggccaggacctgctaaggtgaccatactattgagtggccaaggtagcattcaaacaggtttgactcctgggggcttctaatcaccacttccagactgtaccaaaactccttaaactctaaataggaagaaaagctcacactttaaaaagtgggtaagttgagatttgcctattctgggggaaggagaggccggaatataaaagattaatgtctgcagcttttccatttagcaagacatttaatcactgtatgtgacgtggggaggtggaccttgttaaatacagggagagtgaatacaatccatcaatggtacccactgtggtccttttaaggaagacacagaggcctcggtggattcaatttagaaaggcaggactgttttttgttttttgtttttttttttttttgagatgaagtcttgttctgttgcccaggctggaatgcagtggcctgatcttggctcactgcagcctctacttcccgggttcaagtgattctcctgcttcagcctcccgagtagctgggattataggcacccactgcccggctaatttttgtatttttagtagagatggggttttaccatgttggccaggctgggctggtctcgaactcctgacctcaggtgatccacccgcctcggcctcccaaagtgttgggattacaggtgtgagccactgcgccagtctgtttcttaatataataatagttttaaaaatttctgatgtttggcaatgtccaagattctgcctcacatttttcagaaactgccttttttcttaattaaatctcttagctactggagtctttgcctttgtttgccttgctacttggtacatttcttctgttccattggctctttttgttttgaagtagtgctcaaaaataagtttggtagtaagaatatggtgaagagtgtgacagacagggttaaaccaggctgaaggaaagagagcagaatggggaaaatttgagttgaaaacagctagcagaaagctgatggcgcaaattcaaccctaatctcatgttttggcacttctgaactatagcaagcataagggctcaactcttatctagttgaagcttacttgggtctttgagaatagtacatctcaaaattaaacactttcttagtccttattgttaagttgtttttggaattattgtcttatttgtctgaattaagtgtgctgcaggacttataggatctgatggatgatttgcctaaaagttggtccaggtcaacctcagggcatttaaatgcttggtccagccactttctgaaagttgactgaaatatgttgcacagcagggtagaggaggacaagtttactagatgtcatttttaacctgcttgtcttcatctctgactgtagaaatgtatattcattataagtttgccacaaatagagaatagagtttattctttgatcatctaatttctaggagctattgaaatttcactgctacctgcttttaaataagcgccaacaaacatttattaaaagggctttaaggtataggccaagatttattcaattgctaatggtatgttttctgtaaatgaaagcaaaaatatgttcaagtgtataatattaaatattaacattcagaaacttggagaaatacagatggcttttttttttgagacgcagtcttgctctgtcgcccaggctggagtgcagtggcatgatctccgctcactgcaagctccacctcccgggttcacgccattctcctgccccagcctcccgagtagctggtactacaggcacccgccaccacgcctggctaattttttgtatttttagtagagatggggtttcactgtgttagccaggatgatctcgatctcctgacctcatgatccgcctgcctcagcctcccaaagtgctgggattacaagcttaagccaccgcgcctggcctagatggatttcttgtaccagactataccctagacatgaaaacaagactgttaaacaaaatcctgtgctacctaaagtttgagccttctgtgtgtcagtttctgccataataaataactcttaactatgattattaagtatattaagaactttgagtaggggaggcacgtttaatcattcgtttttacggcatatgtactataatacctgtgtgttgcaaatcctggtatttaaaagtctttttgtgtatttgagcatgtaagtttatttggtccaaactgctggtactagtaaagacaagtccagggcataagtaggacttacagcaccaagttcgtcttttttttttgagacagagtctcagtcggtcacccaggctggagtgcattggtacagtctgggctcactgcaccctccacctcccgagttcaagcgattctcctgcctcagcctcccaagtagctgggattacaagtgtgtgccgccacgcccggttaatttttgtatttttagtagagatggagtttcactatgttggccaggctgatcccgacctcaggtgatgtgcccaccttggtctccgaaagtgctgggattataggcgtgagccactgcgcctgacctccaagtccatctttcaaaggctctgttgataattgactcttgagagtcattacagtccatcaacagcctgtattctgaatatttgtttttaattctaagacaatgctaaatagccattccaaataaggtgagaactgagactttagggcctgtattatcagctgtacactgacaagctctgaactctattgctttttcaaatcagagaagaaaaatgagtaagaaaagaaaaatatggatcacttaggctttgatgcctcctctgagtttatagtgtttaccttctgtattacttaggtgatcctctctaatggcattttaaatctctgttgatacttgtcttacttatgtatctgtttttttttcctctatagtagatagaatttatagatatatatgtattttaaagtaagatacaatttacgtaccttacaatttacccatttaatctaattcagggttatgcaaccctatgaatttagtagtttattcatagagttatgcaaccatcactgtaatcaattttcaacaccctcaaaagaaaccccatatccattagcagtcacttcccatttcccctcaactctcctggcccctggtaactactcagttattttctgtacctatggatttgcctattctggacatatcatgtaaatggaatagcatgtaaatggaatcatacagtatttatccttctgttgctggcttctttcacagcaatatgttttcaaggtttaaaaatgttgcaacgtatatcaatagcgtcattcctttttatggctgcatactattccattgtatggctataccacattttatttatccagttgatgatcatttgagttgtttccactttttatgtttctgtttgtttcttacagcagtggttctcaaactgttgtatattagactcaccatcagtatttaaaaaactaatgcccaggccatatccctcatgaaatcaaaatctctgggggtggggcccaggcatcactattttttaaagattctgaggggattctaacgagcagtcaggtttgagagccagtgccctagggcagcagtccacaacctttttagcaccagggactagttttgtggaagacagtttttccatagaaggaggtagaggatggtttcaggatgaaactgttccacctcagatcatcaggcattagattgtcctaaggagctggcaacctacatcccttgcatactcagtttacaacagggttccggcttctctgataaactaatgctgctgctaatctgacaggaggtggagctcaggcgggaatgctcgcctactgctcacctcctgctgtgcggcctggttcctaatgggccactgacccctccgcagccagcaggtggggacccctgccctaggggacccacctcagtgcttggtatccattgaagtatatagtgatttagaaaatctggttaggatgtcttatttaaatcatgaaagcaagtgcttttgtctttgatcattgcccttcacagccttacagttaacacctacattcaggaactgtgtttcaaagtgcctggcgagtgtttgaaactcactaaatatatataacctgggctcattaaacccctccagaagatttgggtaactttgttatgaaagggcttccctgaagtgggtcagcaggattgctctgtgttttttcaggaatgtggcctgtgataacttgcaatctagattatttggaaatagcactgagagaagccagtgaggacagaatgctcagaagcttgggataggtgttgaacatcctggaggccaggacggaacactgtcttactctaggaagctgtgttcctgggcctcattatcttcctccgttaaaaacaaaagacttaaatctccacagcagctttcagcaacttcattttttggttctctgtatctgcctgataaagtcccactttgtagtggctcccacttatatttacctgaatggcttttgggttgacatatttggaaactggggctaacttccaaactgttggcaacttgtgtgtgggtgtgcgtgccacagcacagcagtcccacttgagagacttgatggtgtggtggtggttggggggcttctgaagctggcttagccccagccctatacacccaccccacagatggtgggaacaagcccagaagagagtgggtaactctgtccactgtggcctccacagccaaggttgccaggcagagctcgcaaggcccaattccagtcttgtctttgaccgttgcccctttgtgttgggggggtgtatttagtcacctttctggaagcatgcttttctaattctagtcatcagtagtttgttgctttaagattttgaaaatggtatcctgttattttacttaggagtttcgtattgaatggtgtacataatgtgattcaagtacctcaaaacagaaggacttcagttaagatttaggctctatgcaacatacacttcttgcattttctcattcaatgtcctttcctttttttttttttttttttttgcaagaatgtagctgacattcagagtagattagtaccttcaatgtctgtgtgaaagaaatgaccttaatatgaggacaatattgactgtgtatttagggggcccactgttaaggcatatagaattttgctttatttcagacctgacaatctcttgtctgctctgcttccgcataaaattataatactgcacatggatgtaaaacccaacctattccctgcctgagggactagaatagagggaagaatgactatagttctttgttgccttttgtgaaggtaacaggcacagaggtatgatgcatgatggaattatatacctcttcttgaggtgtttgagggctgactaaggacctgtactttttttttggtttgttttgcagtactggggccagggagccttgctgttgtgtctagagagtgttgaagaaccatgaatatttcgcaaaaagaaaataatttttttaaccattaaaattcctggtagtgacttcctctggcaagtaaaaaactctcattttccttaaaaaatgagagttttttacttgcaataggaaaacttgccaatttttcaagttatttttattcttgatgattctcaatgagacataattaaaatacacatagaaaaaacaaccgtaggccaggtgcagtggctcacaccagtaatcccaacactttgggaagtcaaggtgggaggatcactagagaccaggagtttgagatgagcctgggcaacatattgagacactgtctcctcaaaaaattaaaaaaattagctggatccagtggtgcacacctgcaattgtagctatttgggaggctaaggtggaagaatagcttgagcccaggagtttgaaggtgcagtgagccataatcatgccactgtactccagcccaggcaacagagtaagatcatgtctcaatgaaaaaaagaaaaatcaaccctagtggactggaacagggctggtttactttgtgtcagctgcagtgcccccactcgccaacccacatgttcttctcctgctggttcccaagcagagaccagaaccaagaatgagaatcatcctgtgggtgcaggttgtatcttatcctccagagacagcacttcaccctctgttagaaacttctttaccacactgcctgtttggtgaaatccttagggcagtgacttccaaactgtgatccaggggccacccttggtgggaggatcaggaaggagggggaatgtatcttaagaaaagttgggggaagctcatatctcttctcgttgatcctgagaagtaaagtctttcctcctcagagagatgcgggtagacatgactcgcctagatagaagctcattcatctccctcccttctgcctctgcaggactcttggaagtctgggtccccgggagtatgcggctcttgctctgtgctacaggtttccaaagttcacttgataacagtacaattgtgctgtaaattgtgcagtaatggagactgaggaaacaattagtctttcatcttcattcatgttaccagctcacttcctatggtgtgaaaagagccagactttggagttaggagacatctgaatacagacagaactggcaagattatggggaagaaaagggaaaagtaatgaatattttcaaagaggttaagccatttggccaggacaacactgcttgcaggtagcagaactgggattttgactgtccataatccctattctctgcttgttttactccttccctctcttctttcttttttcattgtctaatgacctacagacattctgtcagctgctaaagaatgagggactcctttataaagattgataggacagtgtcgctacttaaggagttccttccatgtggaccagtgggggcgctgttgacgcatggggctggacttctctttggagcagagtcctgttccacggatcgctgtgacaagcagaaagtgccccaccccacctccatacaattcctaatgctcctgggtgatacaaccgccccagtggaagcacggtggtgcatggacttctagagaccatttgaagccaggacattgctgcttgttcttaggaaatggcagaatattactttcttgttttttgtagggaagcctgccatctcaccaggtggcagcttgtttataccttttatcctaacctgaagcaggtgatgggacagaggtcatcgaatataatgaaagtgccacaaaggtagagtctgggtatattttatttatgcaggtagagtgacttgtccagatcccttcacacagagcaacatttaatatggtaattgttactgctgaagttggccatttctcggacctacagctgcaaggaattggtaacaaaaggataaactaaacattgttactattttaattttcaaggagatgaagttaaaatcatatatgtcatatctctctggggcttagccaccttttctgctgggcactttttgaagaagtctgaatactgagataggagagtaaaggggggaaagtaagtttgcccacttctcatcctttttctgaccatcagcctgagggaagtaactagaatccgctaagaaaattcacttaatcagcagttgattgattgttatattgtccacattgcaaaattctttaaaggatatttgaagatattatcacatttgttctcttacaatctattgtattgtttatttgaaggggtgagtgttaatagttcttaagatatcgtactttatttccggtagcatatccaagaaataatttagaagtattgttaatgggaatgatgttaaataatttttctatgactagtagttgggacatatatgatataaaacatggtatctttgttacttaagtaatttgaactctaaccccatatatcttaggtagacaatgaaaatactgaattgttagtctaaataatatacacgtactcattccgcaaatatttattaggtatctacacaccctaggaatctttcagggcatgaagctgttttaatcttccaagataatgcagcacgtatcccccttgagggacatttgtttttcaaattgctcctctgtgtctcctctgcttaggatatgagttcctctaagactgtattttaatcttttgtgtaattctgatgtctagcgccatgcctggtgcttacgtaatagttgctcagtcagtttgagggtgagtccattaactgccctctaggagcttgatatttaatataaactagtctgtgatacatgacaatgctgtgacagtgcagatgagaaaatgtgacttctaactggggtgctcagagaggatatcctggaggaactgccattttaactagacttttcttttaagcaggtagattttgtttggttcaggcttcagctggaagcccaagcaatggtgcagatatgagctggactatgacagactattgggccagtggggctgacaaggttaacttgggggttgccatagagggccttcagtgctcatgtgcactgtttcaagtttgtacagggcatctggaaaccatggaagaagattctggaaagggcagggcaggtaaactggatgtggataggaagttactgtggcaggtgaattggaagatggacaggttggaggcagggagatggtgagcgggctcctgccaaggtgtaggtctgagcattgttgtgacggcttagttggtttgacatcagcacacagattgaggatctgtcattgtaactctaaattgtatccttgttagacatgtaaaaataactttttagagcctccgtttttaaggagggaagtggattgtgctcaagcttgcatgctccgctgttcctgtgctttaaaaatactcatccaccagtgtggtcactgatgaaaggggaggaaaaactagccagaagttgccattttgcttaaagaatggattcatttcttcctcaaggtggcacagagagagtttctctctttttgcccctctcttagattgatttactatttttagtaaattctaacagtctgatccttgcttccaattacaatgattagcaatatttgcccaagacaagaaaaaacaatttcctctcttttctctcctatgagcttttcctgtgagccccaagcagacagatgtggacatctagcaatgctgttaacaacagctgcagtccgttggactctctgcaacactgggcacggtacaaagtgctctgacaaactcttctgccctttgcaatccttactacgccctgtgaggtgaggagtattcttcctgttttgtaggtgaagaactgaggcaaagagaggttatgtcattagatttcacaatagggtgtgtttccgtttcatcatctttagattgatgttactgtgacatcatcttcctagaattaacaaagtgaactgggcacaggaaatagcacatggcacaccttcagcaaatggtggttgtgatcattttcatcattccatttcttcttgaaaaaaatccctttttttttttttttttgagacagagtctcactctgtcgcccaggctggactggtgtgatctcggctcactgcaagctccgcctcccgggttcacgccattcttctgcctcagcctcctgagtagctgggactacaggcacgggccaccacgcctggctaatttttttgtatttttagtagagacggagtttcaccgtgttagccaggatggtctcgaactcctgacctcgtgatccgcccacctcggcctcccaaagtgctgggattacaggcatgagccaccacgcctggcaaaaatccctcgagttccagtgtaaacactcacgcccttttttgctgtttgctataaacctctcattctccttggtcttcttgtccttgtgtgaggtcctggttgttgtggagactgaggtcttctgagacagaaaaccaaccccatagcaggcctggtgtgtgccctagaatggcagaggccccacacgttgccccggctcctctggaagaccctccagcctgtctgctggattccttgtacttatgaggattgttaaaccatctcataggattcctttccagactcagcccttcacttgtggcagcatttcttactctgaggttctgggcctagaaacccagtgtccataggcaaggtctagggacagagagagtttgtagaaagtgggaatgcatcagtggaaggctaaatccaaacaggaactgagctggcctgggtggctttgtccttttgccatcttcgtaaccctttaaaggctttaagacacttcttttgtaataactaccccaactaaatttggccagagctgtgaagggaaagaaaatctaagacccttgagggagatgacagccgaacgttttacatttttaccacctttgttgttgccatgcacagctgatacataaacaagtaatggcctcatcttctattcttttatttactggttagacccagaaccctaaaaggtagatgcttctcatggtcatttggcatttgcaacaggagctgaatttattaatagtactaatacctcatccttggacatccttgggttgtccgatatttttaaggggcatttacatcctttgtttttcatatggaaaacttttccgtaagggctggtatcatcttggccttccattgcaggaacagcacagggaggttcggtggctaggccacagttacccacgcagctaggtagcagcagaggccccacctggcaccccctggcttcctaagcacatcgcactgtgcagcctccctgaggaagcctcgagtggataggaactctggttctttaagataaacctgagttggatctcactgtcaccatttatcagatggggcgatgtcttcaggcaaaagtacttaacctctctgtttttgtttccttactccaaaatggtaatgatcatactactacccacctgggtggattggtgtgcatatgaaggaggtcatggggacaagtggttggaagagtgttgagcacatagaaagtacaagataaatggtggccattatgttactacttagactatatcatacttgtctttatctgggcttagaatcttgacactgagatctttcattctcagatcttaatatgaaagcttaccaggtaaacactaccccaacataattatttagtgggttcatacatgtgaaagcagttgaaatacaatttctgaactccgggttaatttatatccttagttggaacaggtagtaccctcccagcacctaaggcctctcacttctatccattcttcagatgacctttgcaataatcatggtaattgaatagcatctgcaccataacattgttgaataacatcaaaatgatccatttagccatcatgagccttcctagtaattcagactcacaccagttctttcaggttattgagtagcttttacaaataattgctaacagtacaaatactgtctcaggtattttggaagggtgaattttcccattgatttcagtgtatctttaggaggtaatttgcaaaaccgaagagtttggttccgtcaaagtcacccctaaggagtgtggaggaccacattgtaggtttatactgcactgtccctcatgcttgaaatttggctcatgcaaccaaggaactgaatttttaatttcgttaaattttgatttaaattttaaaacagaaatagtataaaatatttttctgttaaatataccttgtagtgttggcaagactacatttcgtgttaccatgctgggtaagatttcttgtagtgtgtattgtgttttgtcacctcgttaataattttcttattttggttgcatgttaaaataattttggatatattgggttaaataaatatattgttaaaattaaattcacttgtttatttttttgttggtgaggctaggctactaaaaaatttaaaattacccatgtggattgcattatatttctattagtgctgctttagctgcaagtagcctatttaaaaaaaatcattattttcagacttatggacttcatagaatcagaggtatttagaggaaaggatcttgggggtcacctaatccagctccaacattttgcaagtgataagaccaaggccagaggctacaataaaatgactgacctcctcccagatggggactggatcccagtggctttatagcctttgccttggatcctggttttacttggaaacatagcagacatcagagctgcagagaacttctaccagatccggagtgaagaaaatgccttatttatttatttatttatttatttatttatggagaccgggtattgctgtggcctaggctgtagtatagtggcagaaacatggttcactgcagcctcaacctcctgggctccaggatcctcatgcctcaaccttctgagtagccggggccacaggtacgcgccaccacgcctggctatttttttttttctcttttgtagagactgcgtcttccatgttggccaggctgatatcaaaactcctgggctcaagtggtcctcctaccttggtcccccaaagtgctgggataacaggtgtgagccatcatgcctgttttggcagtttttaggggcccacgctaattttgagccaggtttgcgcttgataatgtaatgctggaggctgggcaggggacatgatctgcctgaaagggctgagaactgggaggctcttattcctatagtattgagagcaaaggcacagtcttacagaaccacacaatattcagagcttgtgggttggagaaggaaagtcctctgaaaaataaaaaaaagagtacagaggccagaggcggtggctcatgcctgtaatgccagcactttgggaggcccaggcaggcggatcacctaaggtgaggagatcgagaccagcctgaccaacatggagaaaccctgtctctactaaaaatgcaaaattggccaggcatggtggcgcatgcctgtaatccaagctacttgggaggctgaggcaagagaatcgcttgaacccgggaggcggcggttgcggtgagctgagatcacgccattgcactccagcctgggcaacaagagtgaaactctgtctcaaaaaaaaaagaaacagagtacaggtcagacattgggcaattttctcataacaatttcataggccattaatttggttacagacttgaatagcacacaacagttctctaagggtcagtttccaaagtaattcctaatatttaatgaatttttaagtgatagaaattgcagtaggaaagtctagcttgaaatctaatttgtgttaggttgaccaggtgacaaccacccacccctggattctgctcagttaggtcagacctggggccagttgcccatttagcatctcaggcctcaggatcctcatttataaacctggggtttgaactgcggtctccacgatcactgtcagctctccttagtcagttggttgttctaaatgtagtttagtggccagtaaacacctgttcctgagtgatacatctttaaggagccggtagatgggtcaacctggctggacttgctttttcaagtctgccttgtctattagaaaggctgagcttactgattttgcctgtcacgtttgagtgttcctgagactttgcccagcctcggtcttatctgcgggtaccccagcctctgcattccttgcccctacaaaatgtgctgccagttccaaaggcacaaatgaaaattagcttggctggagcatggctaggcacacaccagtggttaaagaaatgctgtttgctggctgacacttctggagtggaagtttattcttttttcttttttttttttttttttgcggggtggggcagagttttgctcttgttgcccaggttggagtgcaatggcacgatctcggcttggagcgatcttgggtcaccataacctccgcctcctgggttcaagcgattctcttgcctcagcctctggagtagctgagattataggctcccgctaccacgcccggctaattttttgtatttttagtagagacagggtttcaccatgttggccaggctggtcttgaactcctgaccttacgatccacctgcctcggcctcccaaagtgctgggattacaggcttgagccacggcgcccggcctttattcctttctttggcctcaattttattgttaagagatagtgggaagggcccaattttgaaatgatcctggaattaatgtaggaggccttgtataagcagttaatgtgtatttattgagtgggtaccctgtgccaatatgatacaaggtgtgaaggacacatgagttgggaaaggcatggggaaatgcacgctcacactgctggtgcgagtgtaaaaggtacagtctctatgtagggctatttggcagtatatactctttgacccagcaactccacttttaagtatttatcttagggataccctcacacatttatgaaatgatttatatacaaggatattcattatagcaatatttgtaatggcaaaaagaaacaaaagtcagatgggggactgattaaataattatgttattaagtaatactgtttcagtacatctgtgtaatgaaataatgtccagtcattaaaaatagtgaggcaaagtctgggtgcagtggctcacgcctgtaatcccagcaccttgggaggctgaagccggaggattgcttgagaccagcctgggcaacatagtgagaccctgtctgtacaaaaaaaaaaaaaaaaaagtaaaatattagccaggcatagtggcacatgcctgtaatctcagctattcaggaggctgaggtgggaagattgcttgagcccaggaggttgaggctgcagtgagctgtgattctgccactgcactccagcctgggcaacagaacaagaccctatcttagaaaaaaagaaaaaaaagaaaaagggacaacttacaactctgtgccctgatgtagaaccatctccaaaatatattaaatgagtgtgggatactatgcttatatgcgattgtgtgtatttaatggcttcctaagaaaacaaaaaaaaacctgatactagtgattgccttggaggagggtaactgggaaattacttttgcaacttttaaatcttataccatgtacacctggtatctatttttaaaaagccattttcatgccctaaatgagtttagtcagaccatagtaagaaaatcctgtaagacatacaaagtatggggtaattactggctttatgggaagactgatttcaatgcaaaactctccctatgcaagggagttgtcctgatttcaatgctaagctctctttaggcaagttacgttggcctgatttgcctgttaagtcgtatggggcaggcaagtctgagtgtccagagggcagacctttaactcttagtttcctgccttgggagaaggcacagggctaaagtggtttccagaacgtgtctgttgtggtgtgaacaccaaggagcagtggacaagcttcccaggctcaaggtcagaaggtctggactggagtcctgcctctgctacttggtgaatatgtgatttggggcaggttgcttaatccccgaagcctcaacgtgttcatctagaaatgaagattacaggctggacgcagtggctcatgcctgtaatcccagcactttgggaggctgaggcaggcagatcatctgaggtcaggagttcgagaccagcttggccaacatggcaaaaccccatccctactaaaaatacaaaaattagctgggcatggtggcaggtgcctgtaatcccaactactcgggaggctgaggcaggagaatcacttcaacccaggaggtggaggttgcagtgagctgagattgtgccactgcactccagcctaggcaacagagtgagactctgtctcaaaaaaaaaaaagactacaatacctggcccaactccctcatgctactgtagtgaggctcaaatgagatagcacccatgaacactcctgtaaaccatgaagtatgcaaacaccaggtgtaatagaagctgttaggtacctgtgaggccagcagacaagagcaagagatgctaatttaaaaagaattaaggtgaagcaaagatcttttccctctgccaaataacttggcaagagttgtaaaattagaaaagtagacccttagtagtttgataatcctttgacctctgaccctgcacaaatgatctcaccctttagacctgttcccttatttgcaaaacaagaggggctgtctgggtgattcctgtggtcccttccagttgtagcgttccgtgacagtgtggcattaacagtaattcccatcttggctgagatggatgagtcatactaactgaaaagtcaaaatacgaggaagaagtctctttatgtatgagaattttccttgagctagagactcagagcctcttggggaggagatgagggaaaacattgccaccaccaagaagggagacgaaggatgtataaagagaatggagatgtatttacttttttttttttttttttttttttgagacagagtctcactctgtccttctggctggagtgcagtggcacgatcttgggttactgcaatctccacctcccaggttcacgccattctcctgcctcagcctcccaagtagctgggacacaggcgcccaccaccacgcccagctaattttttgtgtttttagtagagatggggtttcaccgttagccaggatggtctccatctcctgacctcgtgatccgcccgcctcggcctcccaaagtgctgggattacaggcgtgtgccaccgcacccagccgagattatttacttcttgtgtgttcttgccatctccatagcctcctttgctttcaaatgcccacttgggctgggcctttggaaaatagatttaacccttgtttattggaaggatattcacacagtaggccagttatacactttgtggcagtcgttacctcttctgtgaggtctttctgtgcagatttagtggcacctcctccatgctgcctgggcttctacttgcttctcatcactttgtctcataactcagatcagagactgtgtcttactcatctttgtatccctggcatctgagggggtggtatctgatgggtagatggattagtgatccacttagggtatttacactaatcttgttgatcttgactactacctttataaccaccaccattctacaagttttaacttttttttttttttgagacagagttttgctcttgtcacccaggctggagtgcaatggcgcgatcttggctcactgcaacctctgcctccccgggttcaagcgattctcctgcctcagcctcccgagtagctgggactacaggcacccgccaccatgcctggctaatttttttgtatttttagtagagacggggtttcaccgtgttagccaggatggtctcaatctcctgatcctgtgatccacctacctcagcctcctaaagtgctgggattacaggcgtgagccaccgcacccagcaaggatctttttttttttttttaaagctaagtgttttatacatataataatattgttaataaaatgtatctaaaattcataccaccagcacacaaggtctccggctagcagcagtaaatggcatttagtacttacttagcccccaagcctggatgactgactatactgacttattattacttttagctatttgtaggtagttacatctgaaaattgaccaggcacagtggttcatgcctgtaatctcagcactttgggagaccaaggcaggaggatcagttggggccaagaatttgagaccagcatgagtaacatagcaagaaccatctctacaaaaaataaaaattaaccaggcatggtgatgcatgctacttgggaggccaaggtgggaggatcacttgagcctgggaattagaagctgcagtgagctaggaaggtgccactgcactccagcctgggcaacagagcaagactcttaatctcttttaaaaaaaaaatctgaaaaggaccccaaggattgaactttatctttacatttatctttacaaatccaggatcaaaagagagggtaaaggatcacttggggagtttagaagtggcagaagtatctgtagaagccttacggtgtgaatgtgctggattgtgtgtgcccaccctcatgggggacttccttggaggatgagggtacaccagcatgggcagcaaagctgtttgacctcaaggtggagatctgagccacctggtcagtccatgcccagttaatttctatggaggtttggtaaagtaggttagggagttggatccaatgttcctgaagtttctgttggtaatatggcaggggtcgggtcgggtgtggggagggttggatcattctaagggcagtacaagacctaatcccaaaggtgagaagttcctctctgtggaggacagcatttagaactcaatacatacatggcttgttcaaaaatggggaagagattagaaaaatttatcctaatgtttgcttgtcaaaccaagccattctctcagcaaagtagtgaaacccttacataagtcctttgaagcctagcagcagtatcctactcaaacacaaaccaccaaaaaaaaaacaaaaaaaaaacaaaacctccttggggactcagatgtgaacctctcatggaaaattcagtaccatgtgctttttgtagcaggtaggatcacctgctgttttggaaattaactttttttctgacatctttttgaccgaactctgcatgtgcctcttgagaaaataatccaaattcttgctttcttcactttccagttttgctttatctttgcatcatgctctgcagtttacagacaagcataatgggtgagagttccagtaaattggctggatcatatttcttagattgagtcatgactgaggaacttgtttgggaacaggaagcagcccatgaaaatggctgcacatagtaacctgccagattgaagaaaccggaccactttctagtggaaagataaaagggcagaaaaatggttctataactcagggaatggtaaatttgtgaactagggttttaacttgttgaataatacgtctttgtgtgtatttgggcttttttatgctgttaaaagtctctagttattcaagataagggaaaggaaaacttggattcgtggtaactgttgctacctcttaaatgtctctgctgatgtatacaacatgttgctaggccagttattttttttaaggcactgtagttacatagaaataaacctggcaacatttacacttggcctcgataggctgtaaggccccttttgtctccagtattctgtgtttctgtattttaatcacctactttacacttactgtagcaacacaatcaagatagcaaatcagtctaataaaaccaaaagtactggaatgtgggaaatagaaagaatgacctagaattcttgctgagaaaacaattggtattgctatattcttgtaatgcagtgtgagagaagccagagaagtaaataggcagatacatatctatgaaatgtaattagtcatcagcaagatgtattttaaaaacacatctgcttggtgtcattttgctttatctaataaggattacgactgcaaggcagagatttgtaaatgaaggagatctctgttgtttttgttttgtttttgcttttgttttgttttaagacagggctggagggcagtacatgatcatggctcactgcaaccttcatctcctgggctcaagtgatcctcccacatcagtttcccaagtagctgggactacagcagtgtctcaccatgtctggctaatttttaaatttttttgtagagttgaggcctgtgttgcccaggctggtctcaaactcctgggctcaagtgattctcacacctcagcctcccaaagagctgggattacaggtgtgagccaccgtgcctggctgttattttatcaattcctcaaaattcaagcatgccctcaaatatttttgcagcctcatatagctcttaatttggtttatattcatccagatggtaggatatgattcatgttccacctggttttcttcagaaatacttagacagtgtctatggaaaaaaacattgaaccagatttagcttttaggtaaataatataatcacctgggaataatatgaagaatgaaatgaaagaaagaaaaatataatcaagtgtaacttagactctgaatgctggtaactaagatttggatgaaggaaggatctcaggggaataacattaaaataagattttttttaaatggaaatacatgattttaagaaggaataacttaagacattccaactttatactacatgaaagtaaaaagatcaaggatcagttttctctttggagcaaggctcagtttcgctttctgttgagagttagtagtgtgtataattaattttttttaacagtttattgatgaaatttatttttagaaggaaatctcccaccaccttcctgtcattctcagggcaagatagagggtaggagagggaagggagactcgggggaatgggaggtgcaagccttaattagacatttgagtgtctaaaagattacttttcatttcaaatactttgtctcagtttactgaatagctttaatttaggacagggattgtattatctttgctttatcttttccaatattttggatcatctaagcatgatagatgctggtttattcaaggcactaaaattgacttgcaaaagacatatttaatatggattctgtgttcaagtcctttcttctttgtttatcctggtacaaagatgtttgttttaaagtggtatgagttaattgtccaacttcagatttccctaaaatgtgtaacagattacccagttggcaaatgatgatatatattttttaaacatgaatatttctgttaggccagatggtgatttaacatgaattgtccaacatttgtgtttcttatcaaattgtcttcttttgtctaagccaagctagcaacataatttggaacacactcaggaatcactaaaggacaagagcaaaaaaaattcagacaccaagtggcagacggcatttgctccatatgccatgcaaaggctcctggccagtgctcgcatggcccttgggaagctttctcacccgttgtaagaaagtatctgtgcagtgctgtgcaacccatctacctgctttcctctctctacccaaaccctacttatctaacactttgtactgtggccttcctccatgggggacttgcacttcctcaaagccctggatttctgtgcagaagagcagttttagttcttccttaggcacttccctttcctcctgtccagtgtcatgttcttgtttgttatgggctccacccagacgattatttcctcttagatgatgtgtgagccttgcagagagctgggtcatttgtggaataaatcatgtgcccagtcacacggctccttacaggaaatggttggtgcatattagcttagcacaaaatacagtagtgagcttgtggtccccaacagtgagtcttcagttaacttctgctgtttttttttttttttttttaacataaagctttgaatgtttcatacagtatcaaatctctgcaggattttgcctgctgaaacagatgtgaaaatctgagtagcacagagtatgacattaaggccataacaataaacctattgttgctgcattctaaatttgatcaagatgtctgtttttgggaatccaaaatagttgcttcaaatttagcttttttcttttatgaagcagttttgttttgttttgttttgagacctctcatagcaagaaaaaacattacataaacttttttttgagacaaggtctcactttgttacccaggctggagtgcagtggcacgatcttggctcactgcagcctcgacctcctgggctcaagcagtcctcccaccttagtcccccacgtagctgggactacaggcacatgccaccacgcccggctaatttttgtatttttagtagagacagggtttcaccatgttgcccaggctggtctcgaactcctgagcacaagcgatctgcccgcctcggcctcccaaagtgctaagattataggcgtgagccaccatgcctggccacataaatataaacttaaaaatacacaggaaaacctttcagaacactttgaaacctattttggtcctattacgattgcactgaatgtcccccagcctaatgaagagcaattagatgtcatttggtggcattcttggtggagacagtaagctagggccgcaggagctgcttagtctcccagggtccagcattgtttcaggtaacgtgaacaggatgctcaagagctagtctaaataatgcttcatgtcttatttttcctgtttgttgataaggattcataaagatgtctttttctggtcatgtcaagggaaattcaaataaaaaacattgaattggtttggagctgtccattgaagggtactcacagcaggaattgagtggcaattgaatgtgtgtgtgtgtatgtttgtaaacatttatattagagtgtatgcaaatgtatatgggcgtgcccactgccatcaccattacccccaccaacagtaacaaaaccaccatcaagagcaatatccactaaaacttctaatttgcttattaatttgctttattatttgtaaataattcagaatctctgagatcaaaatccttttttattacaacatgttaatagtagtctaattcagacctgccctgaggaagaaccaagcaatgaagctgtccatgattttagaagttaattggctcattctttctgaccatctaggtagtcccaacattattttaggctccccctagttaggtccacaacctcattattatccattggcctggactttggtctcgcttatacagcaagtagtagagcctatcactgtcaacatgtaaacatttgcatattttacatttatagagagatacttttcacgtgcctcatttgatccactaacatctgtatgcttgggtaggatggaataattaaacaatgtatagctaaagccatccaaacccctcaaatattatcatctgatgggaaggaaaagggggggaaaggaaattaaatagttatttcaattcttggcatgattgacactgacaattataaattccattcaatattttcttccagctcatgagggttggttgtaaggatactttgcaagtcagatttatgagcagaagatgtttgcaacctaaattgcttcagttgcatgaaaaagtcacaaccttttactgatttttatcctgggatctccttaacaagaaaaaacctcaggcccaggaagtctagggtgaggcagggatgtgtcaaagtacacttttccccacgtacagggacaagtatttgagtttctttgattgactttgcaaagagctttgcacactttgcacatcacttcttgagatgggtgggaacatggactgcctattttacagagttcaattaagatcgcaggatcatgcattcctttcatttttggtgctagtacctagaagatgggaacatattgaacacttaataccttgcttgggcagatagctccagtttgcagaaagtctagacaggataccctgctatgtatctagatttactgagaagaagcggcccaagctaatcagaattttaaagtaggtttctcagctgggcgtggtggctcacacctgtaatcccagcactttgggaggccgaggcaggcagatcacttgaggtcaggggttcgagaccagcctggccaacatggcgaaatcctgtctctactaaaaatagaaaaattagccgggcatggtggcacgcacctgtaatcccagctattcaggaggctgaggtgagagaactgcttgaaccctggaggcggaagttgcagtgagctgagattgtgccactgcactccagcctgggcgacagagcgagactccgtctcaaaaaaaaataaaataaagtaggtttctctatacctttgaattttctgtctcccatgataacctttgggtaaacatgtccatcagaatggaaacaaatcattttttaaaatagaaattattctcatacctattttagtgggaatccccctgagaagatagccatgtatagtcgactgaatgctctgtggttgctattttgttgctcttggccaggaaactgatctaggtgacctacagacttaatctgacctgcagactggccgcttcatactaccaagattccaaagccaagtgtatatacagtcggcccatgcagcctctggttccatgatgcaaccaatggcagattggttcaaaaatatttggaaaaaggccaagcacagtggagtggttcatgcctgtaatcctagcactttgggaagctgaggcaggaaaatcaatggagcccgggaattcaagaccagcctgggcaaaatggcaagacgccatctctacaaaaagtaattagctgggcttggtggcatgtgcctgtagtcccagctacttgggaggctgaggtgggaggatcacttgagcccaggtgaaggctgcagtgagccatgattgcatcaccacactccagcctgggtgacagagtgagaccctatctcaaaatgagtaaataaataataaaatttcaaaaggaaaaaagtggaaaaaaaacccgaaaaaataacaatacacacataaaatacagtataacaactatttacacagcatttacactttactaggtattgtaagtaatccagggatgagttaaagtatataaagggatatgcataggttatttgcagcaaatgccatgccattttataatagtgtaggctcatggctaataaagcatgaacccgactgaagctgcctgggtatgtgtctttgttcagccactttctggtagtatcttttttcttaacctcagtattcttatactgtataacaggaatgttttctctgtataaggctgttttgaggaatagtttctatatgtaaagtacttagaacagtgcatagcatataggaagcccttaatagatactggcttaaagataattaggtatgtcctagtgaggtatacctaactacaagtgctactttaactatgcctactttgtgtgctttacaatatatattgttcaaggctagaataatgagccccatgagcagggtttcatagcatttaagattccaacgccaaccttcaatcatggacacaggtggcctgtgccatctagctagctgcgctgcctccaggctgggtggcctgctcctctgttggataaaaatagcctgactcctcactgaaacaaccaccatgttatttgcgtccttgggaagctgaaagtaatagaactctaagtctggcgttgccagctgtcagcagaatgaaatgcaaagtgtgacgtgtctacactgtacccactggccttcaagtcccaactcccgttcccccatcttgatttttttccattctcaaattaattatttcccctataggtgatttgtggaatggaaacagatttagatttcctacctatttagatttttccaaagactaaaattacaaatcagaaaaactgctattgacacatttttggttaggaaaatctggatgtggttcctatgcctagcctagtcatataaattctctccccatgtatctttttgtgtgtgtgaaacagggtcttgtcacccaagctggagtgcagtggtacaatcacagctcaccatggccttgacttcctgggctcaagcaatcctctcacttcagtctccctaatagttgggactacaggctcgtatcaccacgtgcaactaatttgttttgattttgggtagaaacaggtgtcactatggtgcccaggctagtaactcctgtgctccagcaatcctcctgccttggcctcccaaactcctgggattacaggcctgagtcaccaagctcagcctctcctcatcaaaaccattccctctttgtaagattcttcctatgtcttaaaacttaatacctttaatccttccctggagccatagttttatttatttatttatttatttatgagacagggtctcactttgttgcccgggctggagtgcagtgacacgatcatagctcactgctgccatgacctcctggactgaagtgatcctcctacctcagcctcctgagtagctgggaccacaggtgtgcgccaccacaccagttgttgttgttgttgtttgtttttgttttggtagaaacagggtctctccatgttgcccaggctggtcgcgaactcctgggctcaagcaatccacctgcctcagcctcccaaagtgctgggcttgtaggcgtgagccaccgcacctgtccctgtctgcttttattttatttttttttgagatggagtcttgctctgttgcccaggctggagtgcagtggtgcgatctcagctgactgcaacctctgcctcccaggttcaagccgattctcctgcctcagcctcctgagtagctgggattacaggcacgtaccaccacacccggctgatttttgtatttttagtagagacgtggtttcaccatgttggccaggctgatctcgaactccagacctcaggtgatccacccaccttggcctcccaaagtgctgggattacaggcatataggtaagccacagagataagagtagcaagcagtgatggggagaagataatctagtgtaggaaagatggaaagaatggtgatatttcacaactgctagattgacactttaacttgagagttatccctctataaactggatatttgctgagcaaagtttaaagaaaactccatgtattcagtaatgttttccagaccccacttctcttatataagccagtggcttagagtgcttgctctaatttctatattccattaaacaagggtgggatttcttctcattcaaaccatttgtgactttgccctttagtgacctctaccatcaccctatcattaatgatccaagtgattagaatggatggctatgtgtttgtaggttgtttgttgtctttaatgaatagattcattgaatggaattaactgtgctcttctagaacattggatctgtgttctcatttagattgtatttgtaatctccccacttcccaccatcaacagtggcataatgtgaattaatttatgtggtatctgtcatttaaaaaacatgagctctctccttcctttttttgtcttaaacataggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggtacagagtactcagttcttgggaaagttatggcaggtttaaggaaacactgagcaaggaattaaaatatctggatttgagttccagctttgcctttcttttacttaaccttgtcaaatctactttccaacctcagcctcctgatgagttcagtacctaacctgagttcagtacccaacctattgatcttaacagtgttattgtgaggattgggaagacttaagttacaccaaagagttttgtaaagtatagaaacatcctgtaaggatcaagtagcagcaacagaagtagtagcaggagaaccaagtagcagggattactggcgttactgtgtgtggcaagcactgttttaagaacatatactgactgatttaattaacacaactatattaattagttaccattatccctgttttatctacgatgagcaactgaagctcacaaaggttaaataatttgcccagatcactcagaaaattggaggagctaagatctgaacccatgtggtctagttcaaattgtgcatcaaagtgatctctgaaataagataaatatttacttaacttgattataaatattttatgaacatcaattattgaatatttagcttggcaatggaatatttaaccatttttgttttcctttgtgtcattcccttttatcaggttgcccacattcccaaatcagatgctttgtactttgatgactgcatgcagcttttggcgcagacattcccgtttgtagatgacaatgaggtgaggtataaaataacctggttaatagaaaaactccatcataactataaaataacaatctattctatgtaagtcccgtcaatgaatctccatttaaaagaataaaaacatttttaggaggaaattttttaaccaaggaaatactcttgtcaaggaaaccttagcctataaataactttacaattaagaaaaaaaaaaacccttcacacaatacaaaaccaaaaccattgactattgcatagccagaaacatggacagcataaccatggaaacaaataacccatttgctgcaagtatctaagaggtttggtgagtaaagagccagctgggcaataaacgaagacttgttcagttaacaattttaataaatctgttttatctagtaccactgtgctagatattatataaactaaatcctaaagattgtacttacgcattttaaagtttactttcaaatgcttaagctgaaacagaccagcaaattataaatttgagtcagtggggtaggaaaaaaagatttgttatttacaaacggggtcatgactggttagtaagtagagagacacagaactgcagctgattccattttgttttgtagtggtgccttagagcttactcatcccctgttggtggaagactcataaatcaatgccttatcaattttaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacaggtaactaaaatagaatgtaatactggagattttttttatattcagtgcctttagtcattctgattatttatataccacctatttataggaaggattggagggtgctattaacttagtcatgagtactgcccatgctagttaaattggttggacatcttgaggatagaatgttataaacctgacgtctgatctgggaactctgaaaataatacataacgcttaggcgtaaatatgtattggaaatgagaattatctctgaattatagataataaattatagagataagcctgaagataatgtgggtagggagtttatctaaatttatcacgtattatcatggattaactttgatttatatagtataaacttccttctcatgcagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaa

SEQ ID NO: 35791 - DNA, 62226 bp, Homo sapiens
ctgtggcttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctgcaaacagcagatggcttcccatatcccagagagtaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgcgccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcggtaagcgctcctggtgccccgcccgagccccacgctgcagccaggactgcagcgctgcttagggaggcagggcgagccccactcctttcctctgccccaggagaggggcagacggggttggggcggagtggagaaactcgatgtccttgggcgggggcgctggcatagctgagaggggaagatgccctgcagaggaaactcacagtggctgagggagcccctggccgcctttgctttcctaacttaggtcgtgaggttcctaccggtccttttgacatctggaaaatgtccccattcactactaacggaggaagggctagaagagaagggtggggaaagggttcccaaaacttggaatgctaactaaagtgctgggaaattgaatagttaaaaaaaaaaaaaaaagttgcccgccatgtgcacggaaagttgcaggagaaacttggagtactccgagtctgcatcatctcctgcgcctatgaaattcattcttttcactgagacccaacccagctgcaggcttcccaggcaagcgctaaccgagcttctgggactgccaagtttgggtggatttaagggggaaaatgaggagaaagctgtggcattgacccacgccctggaggcactgtgtttgagagtgttgatagccagcagaaggtgcgaggggtcactcaccacatagctgtgaaaattcacaggaaggctatttttttcccccttgaatgtgtgtggggagggggagaatgggtagtggaaaacagatttgtcaccaaaagaacaaacctgccaagggtcacatcacggtgacagttccagactggacttagtgtcttgagtagagagaccctgtaaagagacctcctactccttagtgtgtatggagggccccgagagcatcctgggaggcttgtctgggagtgtttgggacacttgtgtttggatggctaaaggtggagtggcatctgggaaacatctctctcctcctttccagcccataaagcgtgcaagtccagtggctctgctgggagagtgtgtgtgtgtgcactgggctgggctgggcggtggggtgggacagccttgccgccctctgcctgtgtcgattcagaggtgaagaatggagcgtgtgtgttttaagtacagtcataaaggagaaggaaattttccactgagtcttgggtgagggactctaccagcgtgttgtggtgaggagggggaggaggtaggagcttggcaggggaggcagtgagggccgggaggggcactgctggtgggctgggctgagcctagaggtcagagtgggggtgtggtgaccagaatgtcagtgcagttggcagctgagggtgtttgtgtgacctgaggtcacccttgtaagaggctccctggggcctgcatggtacatcctcccctctcctgggggaacccagctggcccaggatttgtggattgcttagaaagatccttttgggcagcctgaagactggggagggttttcctccctcctccacctccacccacattccacttaccctttccctcctcatcccagttggtaacattcccacctgattagtgtggggagttgctgctgcagctgagttctggttttgcccagcaggatcacacacgtgcggccaggaggctggcaggtggaatcagggtgtgcaggggtgcagcccaagtccttttctgctggaaaatgggctgggtgacttcacttgcgtttttttggtatgtagtgggagtaggtccccattcttcccccttgccctttgctttggggtttctaccctaaaaattgaccacggaaaagtgaaaacaagcatgagtagatcctgcttccaatgggggccttcccgtctgcttactgcttaggtttcctgcggtgggtctgagcaatgcagaaagtttcttacaatttctctggattgaaacaagaaatagctccctcgctcctcttcataaatttctcagagaaaatctaagttaccaggaagtagccaaagaccaggagattgtggaatcaaaaagaaaaaaagaaacaaaaaatcttcgatgctctggcacggatcccaaattgttctgcctgggtttggtgagctgcactagtggcagggatgagctaatgcttttaaaatgggaggtgtgggtgtgagctgcttgcctgccgacctccctcgccttgcacagcaccctgctggcgtccagtacttggctcccaagtttcattgctcagagcctttctggtttccagtctgggttgaaactgtctattctcgccctcaaacaaatatgaaggagctccccattccttgggacccacacaaccccaccagtcaactttgtagccccctaaaggtgttcacatcagcccatcaacttcctgttttaaaaccatcatggtggttttctcttcatggcttggtgccatgttggcctagcaaaaggcacaggaggcctggcctggtcctctccggggggctgcccgatggcctttcctcctgtctctgctcatccacaggtgtctctttttgtcttttttccccaaagtcctagggcctggcatggcattctgggggaggaggagttaaaaggtgtttctatggcaactccaggccctgcaccctatggaagtgtttaggagaagaataaactacatgccggcttataagacacactgtgggggaaagaaagggacttggcagcaggcaggatgtctgtggtccccctccctggccagtcattgcccctgaaactcctgacaaaaccttgactctagaagaggaatgggagggggctggagatgaagaaggcggcctcggcccgggcaaatctgccctggcagctctgtccagctcaggaaggggtgggctgtgccaagggctttctgaaaatgtgcgtgtgtgcgtgtgtgtgtgtgtgcgcgtgtgtggcttctgcaaaggtggctggcagggctgaggggggttgcagcagagaaagagaattttgcttcagaatgccaagcccttctctccttctctcttgccgcctttgcatgggaggaatggggctgtaggatgaagtgtgttcggggcctgcctctgagcctgttgggaatttgagcatgaggctcagctggggggccggctgccagccccagaggatggcccctggatagctccaaattgttctgacaggggccagtgccagcagattctttcagtatcagatctgaggttgtcgttttagcaaagaagccattttcaaagaaaccagatccatcccctctccctcttacacacaattacacctcaacactgggctttgcaacttaaggaaaatagaaagaatcagactttggagaggcgccagcacttggtagggcaagtctgggggacccaggctgtggatgtcttggaaccatggaaggaggagagctgctatccagctggaggagggaagagacatgtcttaggcccctcctggttgcacgcacttcccaaatgccatctctttcaccccctcccccgaccccccacagcaaccttaagagtaggtattgcacccatttttcagatggaaaacactgaggctgaagagactgtgcttgtccaaggccacccagttgctaaatgataaagctaaaacgtattatcagttataccatgcttcaaaaacctttcaactttcattgacacatgacattctaaggtgaccaggagatggaatggatggttaacatttgaagaatgcttttcttctacatctgggttttctttaaaaatatgaagatagccaaaatggccagaggttttaattaaacatcatctttagggagggagagcttattattattctagtgtatcatagaggaaaattctaatgttctttggctattagatctggaaaagacccttgaaaccatcaagccacagtaataaaaggacttggtttgtctcactgtggcccaaggagaagtaaggttaatagagacaagacatttcagggcttcaagactcttcccttaaaggtgggatcagttagggctccccagtgggaggtacccggtctgccagtgtggtaggaggaaagccagggggagtcaggagactgggtcccagctggagaaggtgcccctctgacagttctgtgtccctttcacagtccctggatagataaggctagaaaagtggccacagaagtagcttgggtggagggatttttgtttgttttgcatgaacagcaggaaccattcagctccactgctgaatggcacattccaacaggttcattaattaaaaacaaaaacaacaacacgattctccatcgcacttggcttttaccattccagccagtatggacaaggaggccccttcttctaccttttgtcatagtctactcctgggtggccttgagaggcagggtggagtggtggaaaggcaatggggagggcagatctgagctccactccttcctctggggcttgttggctgtgtgtgcctaggcacatatgggctacctttgagctttagttttcttatttatacaaggggaataacaatttgtaccatcttggcctgttttatctatattttaaaagctacaagtatatgaatacattctatgtccatgtatgtatctctctgtatatctatgatatatccatttctatttatcatttatcatctatctatctatctctctatctaaaatcggagaagagtaaaatcctttctgattactttttctaactctagtcccttctccaaatccttttcttcctatacatttacatacataggtatccatagcaaatttatagtagtttttcccttagaaacatgaatagtagaacattaaacatcatggaataccacataataccacatatagtattctgcttgtttcccattcaacaatgcgtactagagatctttctacttaatatatatataaaactgtcagaggagcaccttctccagctgggacccagtctcctgactgcccccctggctttcctcccaccacattggcagactgggtagctccccctggggacccctaactcatccccacctttaagggaagagtcttggaaccttgaaatgtcttgtctctattaactttacttctccctggccacagtgagacaaaccaagtccttttattactgtggattgatggtttggaggatatatatatataaatatataatatataaatatataatttatatataatatataaatatataatatataatatatattatatataatatatattatatataatatatatatattatatttacatatatattatatatataatatatatatttcttttatgtatttcatgaggttataattttaaacagctaataagtatagagtgattactatgtgccaggcattattctaagtcattaacttacattaactcatttaattctctcagttttatgagggaggtgtgctattgtcatctccattttacagctgaggaaactgaggcttagaaaaatgaggtaactcgtttaaggttatactgctagcaaggaatacagcctgtatttaagccccttcaccctggctctaaaatatatttaacaactatactataggtcacattataccatatcatattatatatactactacatactcttatattattataattatataatatgcattttcaattttaatagttcctgccaatttggcctccacagtggctgtgttaacacagttcttttcatatatgcaacatgaggggatggaggaatgttagagccctgtgcttaagagactcccatgcttctctcaaatagaaaaacaatttataatttttattgacttactgagtgttttttttccttctttttgtctctttgaaagggagcaaaattagggccacgaagatcaagttaatgggagtattttcatagggagaggaaggctgcaatgccaggaaagctgtgacccttgacttgttgcatgctggagtaattcggttgaagatagctttatgtatttattttgctttcagaataagcagtggaccatttattacaccaagttgtttgactttgaggacttacatggactcaggttcaaaggtatatgtggctgtgttttgaacacacatacacagggttttgctttctgactcaaagctgtccgctggccaggctcatggtggcagcaagggcactcactcatctgtctcccttcttgttgcctatggatggcacttgggtgagagcagtgggatggtcacaaggaggaggatggactgccgagagggaggctgggtggaccccagccaagaaggacgctggggtctcattattatgggagctagaaggcctggtttaggaaagaattcctgttctgatgaaagctcttcagtggactcttaggataaagtatcatcaaatggcttttacaagggccagtgtggaccctgcctacctcatcctcatagtctcatcactggtctgtcctgctccagctgttcatactctgtctctctggctcttggcccatgacaccccctcggttttgaacagtcctcattaacttctcattctctaggtctcctttggttcctttccctgatcactccttggcattggtacagacgaacagtcataaaccttgcccatattttaagcatgctgaaaaacaccatctctagtaaaacccaaattctccaaagctgcatgggaaactcccagaggggatcattcctgcgctgggagaaagaacttagggctgcgtgccacccagagggataaacctaacccactttagagggtaagcacccactatgctctctgcattacttgataagtctagtcctgtcttctggtggacatgataccctagcaccctcccagagaagaaagtggagatttctaaatgccaaccctgcaggagatcacaaacataatactgtaattttcatagtaagtttggtgcccttactatgtgccaggcactgtaccaagctccttacttgcctatcagtcatcccagctgcctgatgagctgtctcaggctagggaagccaaatggcttgcccaagctcacaccacttgcaacctatacttgcttagcctatctccaaaacctgtgtttccaatcagtctctcatatagaccaagggctacaactttttagacttgggaagattctacccattttgcgacctctccacatgagtctttggctccccactgttggggtccccgtcagtctgcttatctttggttttcttcctctccagacatgccttccctgctgcccccaaattttattactgtatagtcagttctgggatcctaacataaccaagccttacctcctaacccagtgccctttcaactctctcagtggttcccagacttttcaacactatggaattttttaaaattaatttttccctccaataagttctgtgtttggaacagttatccgacacaatttcatgtgttgagtgttgattaactttccattaaaaaacaaattaaaatataactagaactgctgatactagccagtcattattctgacacaatcagctaatatactaattaattatagccgaaagcaaggacggttggtgttttcataagcctgggaagttttctcatgggttcctgggtgattgcattgtcggatttgggttggcttactgatatgcctaaaatagctcctggcttctttggtatatcgctgtcctttgcccctcctgagaatctttagtttcatgccagcttagcatctcttctccctgtgggcaggtcccatgcatttactgccattgtcacttctccctgttacccacagtgctgccaccatgcctgggatagacagcaggtaactgatgtgtcctagttgaggtccctatcctttcagaggaggtgacatgggttcagatattttcctatgttcatgtctggcatccaggggtacacaaagtattgattctagctaaagggacttactaaatactgtttgacaggaggcccacaggtgtctatgtgggctgcagtggaactaagaggtctttttgttcagctgttaaaaaattagtgtttgtagcttcagaggggccccagagaacctttcctgacccatttagaggccatctgtgtggctaggatggctttgctgtcacagaagggacagtccacactacccaacactcaagtctgatttatgttcatgtaaatccgatcacctaatggtggcattcacggcttggagacaagaaactataagtgtttccaagcctgcagccacctggctttttgtgggggtggggaagggaaggaaagctgtacgatctggcctcagagagcccaaggtaaagttcagttagtggaaaaacagagccctagatgattgggcggggggtgggtactggggagtggagaggggaagtcctgagctgaccaagcctccaagagccattccggaactagagatcttaaatactacatggtaattatcccctctgcctctgcccatgagggtgtcaggcacagggccgcctggctgcctgcagagaagagctgtttcattcagaaacttcagagctcctgcaatgcctggattaggatgtggggatggtgagtttcgcaaccagggtcagatttcatgaagacttggtttcgtgacttgaggtgtttgactaaggtgtttgcatctcatgtatttaggaagggctcccttttgacttagactttatcatcatgaataagctccctgccttttcgatttggaaacatgatagctctagtgagctctgctactcccaagcttgggcaggttctttgcctcagtttcctcatctctaaaatggggggaaatatattatgtaccacgtggtaacttcattggcaattaagtgaaatacttcatggaatgtttagcactaaatattccttagtgttgaaaaggctgggaaccactgagacagttgaaagggcactgggttaggaggtaaggcttggttatgttaggatcccagaactgactatacggtaataaaatttgggggcagcagggaaggcatgtctggagaggaagaaaatcaaagataagcagactgaggggggccccaaaagtggggagccaaagactcaggtggagaggtcgcaaaatgggtagaatcttcccaagtctaaaaagttgtagcccttagtctatacaagagactgattcttggcacagaatagctcaataagaataagcatgagcttttagtagtagtgttgttatagagcagagctgatattctcacttcactttcggtgaggaaaatggcgctctgtggtgtgatgtgatgttttccagggtcatatagagagagctgagtttcaattcaaaatcgtggtttgatccccccgcctccaaatctaatgtgttccattttgtcacagtgcttcccacagggcagagaaagaaacaacaaagttcctactctattttcacaactcttcacattttagagtcttaagtccatttgatctcatttgatgacaacttcgcaacgaggaaagcaggatggtgattggggggtcggtcatagttcctagttagtggatgtcagtattgagaatggcggggttctgtggcttagccatatagccaatacatggaatgggattggaacccatgtcttctgagggcaagcccaacacttgtcaaggatctggtgctgcccttccctctttagacagctcccattgataagcagaggtagaagtcactagggtagccaaagagagggccctagaaatggaatggtgacaatgaacttggctgaagagtcagcaaccgctcccctatccactgccagggctaggaggtgcagtgtggcatggaggaggagcactggctggagttaggaggcctaaggtctagtcctagttcatcatctgactctggagtccccttggtgatactgacctccctgggtttggtctcttatctgtaaaacagcaggatattggctctatgtggtgtgtatttcactgaatgcctactatggtcaagtttttctggctctaagttcccttggaaagggctctctactttagctgaataactcagcacctaaatctgtcaaccacacccttcagtaggtaactttgttagaaatatggtctattaaggtaagagccaggatttctgtggttgcaaaagtggatgcgggctctgaacaaaacctctagtgagctgagatactttatcagatgacatatttgaccaccaaacttctgttggagcagggctgatttgccaaacagacagcaaccttgcagacttagtcgatggctagaattaagactcaaggtcacttcagggcctgtcactgattgtgggagggcttggtaaaaattgaacctcattaacaccactgaagaagctgatagacaagaaatgggattaagactcaatactcatcaaaataaggctttccttatccacagcctacctgagcagtgcctcactctggaaaatgtggttcatggctcggctcaaacattttctgttgctgagaggacttctctcatggaagtctggctcagatgaacacatgtgtgatctgatggaacctttgtttaagtgaatgaggagggtatttggaagacttagatcaaacgtgtgccccattgggcagtcactatctgctcccctgacagggagaaaccccagtgacaggatagaaagctccaaagatcctgaggaagtttggaaggtcaaacttcaccactgcaaggactgagagatccaagaatctcagaatccaggttggtctccagggtgcagttctgaacaaatgagtgcagtggataaaaagcttatacttaaggtgggaaggtgggtgtgggttccagttccttctttggctgattctcttttggcctggatttcctcacttgtcatccatgccatgtcacaaacccagtgcctacagggaccaggcacagaagctggatatttgagtatcagacatattggaatattactcactcctaccaaatatgtttatggttccccattctcttggtttccattttggagagctaaacaggtactaaaaatgatttctttattataagacaagcaataaaacagtgggcaagtgtgatgataaacagcatctgagctttggctttggagttggggagacaatagagagtggcagtaactgtggtgaaccgtacagtccaggtcccttctggaggggacagctgctgtccagctccagcctatcaggatgtgagtctagtgatgccagatttccagtctcttaggacaagcaagaaatccaaatttttaatgtaacatcttctgaaaagatacacacacacacacacacacacacacacacacacacacacacacacacacgtggaccaaacaaaacatgtccatgggccagattcagccttgtgggtcaccagttttgtgatctggaatccattttatttctagaatctcctttcaattctcggatctctgagtgagtaacacccaatttttttttttttggcaaaatgtgtcctgcatttcccacactttctgagctggagcacaggttctggagttagaccacttggctcaaaccttggcctcgttcatggctagttgcctgtccctggacaagttaattccctggtctcatttttcctatctgtaaaatggagtatgcaataatagtactcttaacctcataggttgtggaagaattcacagacacaatggaaataaaaggcctggctcattgcctggcatgtagtaaggacctgataaatgtcagccatcatattattactacatggtattactgcctccccttagatgggagccaagtcttgctcaccagctcattgcctgatgttagtaggcattcaataaaagtatcatgaatgaataagaacatttgagaaagacagcattccagcctttccaggcaatactcgtgtgtgtgtgtgtgtgtgtgtgtgtgtgtgtgtgagagagagagagagagagagagagaaagagaaagaaagaaaagaaagaaagaaagaaagaaagaaaacaaagaaaggaaagaaagaaaaaaaaagaaagaaagaaggaaagaaagaaagagggagggagggagagagggagagagggaaggaaggaaggagagagagagagagacagaaagaaagaaagaaagaaagagaaagaaagagagaaagaaagaaagaaagaaagagattggtttgaaacattgggagctgagcttaatgagaaaaggccattcctaactgctaagctaccgtattaaacagtggcaagtaccttggaaaataaaacagaaaccactgcccatctttttctaacggagaaagacaagagatggcttgaccagagtggagatttagaacttcaggtgctgataaatatggtaacatcatggggtgctttggcagctggatagattttatttattcagggctcctttaagccagaggagattcctggaggctgctaaaatagaatgctccacctggatagttaacatctggattttattttgtttcaaaaagttaattacaaatagttcgaattccttctggtatccctctgagaagagtttcttactgggtggctcacaagcggggagacagaaagggaaaaaaactagattgatattgctcaggagaaacaggattgtggctacacgtgagccatgtatgcaattttgaattttcccatagtcatgtttaaaaaaacgaggaaaaagtgaaattaattttaatactaaacccaatatgtataaaatatgaccatttcaatatgtaatcaattttacacttattaataagatcttaatatttttaaaattaagtttttgacatccattatgtattttacactcatagcatatctcagtttggactagttgcgtttcagctacctgtggttagtggccgccatgttaatactacagcacaggtcaagataacatttgcaaaggcaaggcatcttcccctccccatttctagtttcatgaactgtgcacagggatatggggctgttcgaggtacttttgggctgaccaaggctcagaggctactgacagctttgctgcaagtaacttctaggccttgtgggtcccagtgcagggaacccatgtgcggtgacactggagaagccatctgatccaggtctctcacttgacagatggggaaactgaggtccaaagaggtacagcagcttggtttaagagatagagatggaactggaacaaaaataataaccatttgataatattttaacatttattgatttgtttttatatgccaagaccttttaaagcattatctcctttaaactctcataaccactcattgaggtaggcactcctatttctactttgcagatgaaaaaaattgggacttaagaggaattaaatatgaaagcagctactatttgttgacagctattttaagatctttatatacatatatacatgtaataaattctattctttactataaacatacatgtcagaaattattagtgttatcatccttgtcctcctcattccactttgcagatgaaaatactgaagctgagagagactaggtaacttacctagtatgtacctacatagtgaagccagatttgagccggacctcctgactccagagtccgagcaatctcaccaattctgcccacggtcaccccactgcatgatggcagagctagtatttgagcaggtgtgtctgttctgtggtctgtggtcttcaccgccccactagacagcctggatttttctgctcttgagtctcaacactttctgccttactgtgccactagtaaggaacagaacagggaggtttttgaccccagcactgattgaagggcccaggcaaagcaggctcgtctcctctggcttggctggttcccaggctgccctaacccatgaagccagattcttggccaagttaagcagggtgggaagaacacttgtccattccgccttcccagttgggcgaggtcagtgtaccaggttggaaagtggtatgtgtctaattgcaggggcgggggtaggggggaggccagaggattaacactctttaaatagacatcagaaaactaagaatagccttgctgcctggtaattgatgggcattcctgactacgggccacacactcagtaggtgctcgataaacatgggtgaaatacaggaataaacaaatactgaaaatgggtcattgggtgagcacttagccagtaaaaatctgtgctttgtataaaaagaactttggactgaggttatatgagtcttcctgcaggctggagacctctgttacctttacttctctacttttgttgtcttgagaccagcttttttatttttggtgaggagaacagcaggcagttcaaatgtcagggaaagacaagttcagcttgctttttccttatttctgtcttgttacctgctatcctgccaggttagaaagatggaatcactcccttttgccctatcatcaagacttcagtgttccctggagcactctaaatttgccatcagacttggatcatcctctaataccaagctcctgggtccttcctgaaggctgcctccttgtcttgctgagaagaattaaggtcgcttccctgggaggaattcagcagcacctcttgtaagtcatcaggtgtgctgtaaggatggggcaggcaacatttctttgtactgtgggaaggcctaaatcagtgtttctcaaggtgtgatccttgcaccaccaatcttaagaaatgttctttggagccgggcacagcggctcacgcatataaccccaccttgggaggctgaggcgagaggatcgcttgagcccaggaattgaagaccagtctgggtcacatagtaagattccctgtctctactaatttaaaaaaaaaaaaaagaaaaggtggttgggcctgtagtcccagttactcttgaggcttaggtgggagaatcgcttgagtccacgaggttgaggctgcagtgagccatgattgtaccactgcactccagccagggtgacagagcaagactctatctcaaaaaaaaaaaaatgttatttgggagagctgtttattgtattcccctcttggagagacatgtggctattagcatagtaaaagctctgagaagtcctgctgcatggtgacctgtttagctctgtttaatccagtgttctctgaacatatctagccaaggaactaattttcccaagaagcacctacaaatgcagttggtgagacactgcccagatgaggattctgaaaaccccttttgcccacttgcctgccattgtgattgctgagtagggaagaagaaattaggaagtatcatctgcattacacagggaagctgctctcctagggttgccaaacagaaatggctgtagtggtgccagtgggtgctttgtagggaccagaagaaaaaggaggaagggaaggctgaccttcaaggtcacacatttgccagatttaaagttccttcctgtggtcatgacttgttttataatcttgcttggctcagttctgggcacacatcagatttttaaatcctaggatcttgtttataccgttaaggacatgattgaaggacattgtggtgagtgtgaaggtgagatgtttctgattgaaggtccatggggcaggcaccctgcgagcaggtaatgaacagtaggggacataccggtgcaaccccaccctggtcccctggtcgtctgggccagatctctcccctctctgttctatacttctcttacatcaccgtcctacctaatcattttaccgataggagcacctttgggattctgattaaagctatgcatacaaatttcaagagcttcagaaattctcctaaaagctatcttggatcattagaacacttgccctagagtatcactgagtcaataatggtgttgaaactaaacagcaacaaaatccccccaaaaaggtaacctaacttagtctgaaattgtctgaaaattaatggcactgccagttcagtggctgctcagagcgttttggtgaagaaattggctgatggatattttgcagtagtctacaggatttgacgtgggatgccatctttatggacatggctctgctgggcaaagcaaggacgggcacatccagcctatgcggtccatcaggggcactcacatttagaatgggggagtcttagttagcccaggggctgggggcagcatggtagtgtagaaaaaggggccagtgcctccagaaaatgggaccccaggcctggctctgctccttctgctgtgtgattctggttgagtggccttccctttgagtcctctggatgaagttaaggagaagtcttgggttctcaagtagtcactattcagactctcgctttcagagtatttaaaggaggaaaggaaacagaaggatagggctggtggacttaaaaggccgtgtgtttgccgccaccccatttgctcccagggctgggtgtttgtctcccctccggcgctgggcctcctgcttggcctccagctcttgcaccattaactgcagtcagaaaagctgatgtcactgtggccggcctagggggaaagtctcaggataaaactgcttccacctggatctggagaaggggaagtgactggcaagagattcgcaggtagggctcagagaccaggaggaatccagtctgggtaagaattccctgtcatggggctctgaagccacgggccaggcaggtagtggatttcaagccagccagcggggtcacttggcccctgcagctactcctcgccccctcctgcataatttcctatttcctgcctcctcctcctctgacacagttataaataacctcgaggctggcctctgcgcttaagtataggtgagccagaggaaagtggaggggatcaaggtggagctggatctgccacttggccagggggtcacagggtttcagattgctcaggggaattttgttttcttgttttttccactagggagtgaggtagtgaaagaggaaataagctgtgttggcatggggaggcttggccttgcaggccggtgctgggtttcacccgcaaggagctgcctctctgctcactgcagatccccaggaccaaaggtctggaaagaggcttagtgagaaggcatctcaggacacaaagaggacacgatgccttgctggtgaggtcctgcggtctccttctcgaggcccagcccggccccatattggaggccaaacatgtagaagggtgtatctcattttttacctttttttctcaaccaccagccaacgatgggtatgtgatttctaaggatgtccattgactataaaggtcccattaatacatatgctatggacagattctctccttgaacacaggtttatggagcacctactatattccaggtgctgggcagagtgctaaggtcacaaaaatgaatcagctgtggcctctacagcctgttcccctcttggcatagatctgcccttccccctccacagtctggacaatcaaggacctggagtaagcacactctaggggccgcgtctcccagcatatcttttgttttcgaaagttcaaaaaacagaagaggaggattctgaaacagcaaacttgctgggtcatccatagagtatattaactggctatcttgctatctgtccataacttgctacctgtccatagtgtatattaacttcctgggagcccactcactgcctgacttcctgttctgcgcatgggcccaagggaagttctcgcaaccatagttttctgtgatatccatcctaccacatggcttcctgggaaacccattagcttttttgtttgttttagagcccaagggaatcagggccttgaggggattttttggtgtggggggtggtgcaagcttctaacactgagagtgggtgcttttctgattcctatgaaggtggagtgtaggtgtcgttcctggctcagcagagtcagccctctcatcctattcaggccgtctctgaggctggctcctgtgcccaagcccttcctcactccctcagggcatgatcacagggcatttccttagcattcctcctttctcccctgtgtgtgtgtgtgtgtgtgcgtgcgcgtgtgtgtgtgtgtgtgtggtgtgtgtggtgtgtgttctactccgtgtgtgtgtcatcctctgctcatccacccattccactgcgtgtgtgtgtgtgtgtgtgtgtgtggtgtgttctactccgtgtgtgtgtcatcctcctctgctcatccacccattccactgcagcacctagcatcacctaggggcctggaaaacctgcacctgaaagccgtaactccccggcacctggctggttgacttcttcccccttaaccccatttactttgaggatggaggtagtctttagggtcaggctgagatttgtcctgacccatgcttagttggcacatcttgcttctgcaacatgcttgcttagggttgggcaggggcccggagaaaacaagtcgtggcatcaccaggacctgattacccccaggcaccaaggagcacctgggaccaaggggaggtttggggcttgggatatgttttagggtgaaggatcacagaagcttactcatacctatttgaaagccaagtcaacagatgtgggttcttggaaggagaaaaggaggttaactgcttacttattagattagaagtgatgtatgaatgataaagagcagagtttgccagatattgctaattaattctctcactgcttattttatggatgataaagggtagggagagacatgttaattggcttcaaggtctctgagccaagcatgaccaatccgagaaacccaggtggcttcatgctctttcaatatgatctcatccctgcactagagaatttatatttttgagcataaagaatacccaccggtgcaatctcccaggctcttctgaagggtttggagagacagtggaggatgtcaaaagagatgaacttagagtcaaaaaaagcagagatggaatcccgtctctgccttttaccactggagttagttgactaaaatgtaaactctgagccttggttttcccaattgcaaaatgggaaagaccccatttataatgcaggtgggtgagagatgccagcagtgacagggactttcagtaaaggctgagctgaagctgaatttgaaaagcacattctttacgttccattgaagatctgcacttgctcttctgctaaccgctaaggtgtcatcagtgctgtgctattaaaatcagaagtcaaagaaggtgggtgtggccctcatagccagagttgatagaaatggatttattaatataatggatggtccatagaaaggtgaatgacctggttaacagacagggatggagtggagacctgtctgccctggtcttcaggctggttctgaaatcacagaattaagatgatctcagctgaggggcaaggcaaatcggatggaagagcggaggcccagagaagcgaagccctttcccaatatctcacagcaggtggggagtgggggaaagcagcttccagggggtggattcctgaaccaggtatttgtcactgtcccacgtagctcctcttgtcaccatatgtcccactcagtggagggatacttcctgcaagacaaagagggcctcatggttcccccgtcactcactgccttccactccctgcttctgattattctgtaagaagttgaggccgagcgcagtggctcacgcctgtaatctcagcactttgggaggccgaggcaggcggatcacctgaggtcgggagttcgagaccagcctgaccaacatggagaaaccccatctctactaaaaatacaaaattagccgggcgtggtggcgcatgcctgtaatcccagctactcgggaggctgaggcaggagaattgcttgaacctgggaggcagaggttgcaatgagccgagatcgcaccattgcactccagcctgggcaacaagagcaaaactccatctcaaaaaaaaaaaaaaaaaaagaagttggagctctgtctgtctgtcctttccccaactccccatctccgaggctggctcctgtgcccaaagtcttcctcgctgtctctgggtatgttcacagggtatgatcacatttcccctgcatgccctgcgtgggatgtgctccatgtgctgatgcctctggggatttccagatgatgtccctggacttggcagagcagtgtggggaatctgggacttgcacttcctatcctcatggagtctggtctctcaccttcacaggccactaagaggaaaggcaactggtgtgacgtctggggagggaagtatgttcctgtgcatcgaaagcctcaaacatgtgcatacactttaactagcaatcttacttctagaaatttagtcctaagaaataactaggcaatggagtccattgctacattgtttatccccaaattaatctaaatgtctattgcaaatagactgcttagattatggtgcgttcatacagtgaagatctgcacttcctcttctgctaaccgctaaggtgtcatcagtgctgtgctattaaaatcagaagtcaaaggaggtgggtgtggccctcatagccagagttgatagaaatggatttattaatataatggatggtccaaagaaaggtgaatgaaagagtcataaaagatgttgaggtagttctctattgatgccagaatagccctatggtgcacttttgagtaacagaagccaatttgttaaaaacaacaacaacaacaacaacaaaaaaaaaacagagagagagagatgaatgtgcatccagatgcttagagaagagtctgaatgtctgtatactaaatatcaacactagttactctgcgctgtgggattttggatgattttaatttgatccagtgttttctggaaaataaaatttcactacattgacacatcatttgataatcagataaaagaacaatggtgggaaagcaaggactcaagtgacccttgcttttgggtctagagcatcatgtaggaagccagcacagcccatccctttcctaggcgccaccttctggctcctggtgggacttgtaagtcccgtggtcagttacctgattgctcttacggacctgacgctggaaatcctctctctccaaggtccctgcaggagatgggacctgccacagagaatgccgcaagggatgtttctgttgggagctgtgagtggggtggatgtcctctgcctctcttaaatagatgagctagatttgaacctggggctggccaaagggagtctcctctcagaaaccaggatgcagtgggccgtctgtgtcccagccccaaagcagccagggtccagtggattagcacagagccgaccaggcctggagggtggtggtctgggattgggtgagcagccaccagcaggaatagcaattggagggaaggagaagcattgccaagagcaacttagggggccgtgagtgcaggtctctggacagacagcatggtaactggctgaggcaggaagaagcttggtgggctcccatggtgctaataataggccgtgtaggagcaggggaggcagctccagacttggagtgaaaagacgtggggtgcagtcagaatgaactccccagccatccatgtggtctcaggcaagtcactctgcctccagagccccatgtccactcctataagatggtacatccccacagtgccctgccacaggtgattataggtgaaggtcttttgacacctatatgtctaagggtcatggagtgacatcttatgaagtcagcacatagaaagtcaaaaaacccttacattcctgtaaaatacagtgcaggccaggcgcggtgactcacgcctgtaatcccagcattttgggaggccaagggtggcggatcatgaggtcaggagatcgagaccatcctggctaacacggtgaaaccccatctctactaaaaatacaaaaaattaaccaggtgtggtggcgcacatctgaagtcccagctacttgggaggctgaggcaggataatcacttaaacttgggaggtggaggttgcagtgagacgacacctcgccactgcactccagcctgggcgacagagcaagactccatctcaaaaaaaaaaaaaaatacagtgccatctctccataactccacctgagccagcagttccatcagtgttgtgacagattactattttttttttgttgtcaagtaccctcaggttgagcagctgagatgcttttagggagtgagacaatctcaggatctgtctttaaaccccgtagtcatatagggactggcaccaccagagacaacagcagatccctgtctggagctcactgaagaatcaggggtgggaggaattgcccttttaaaatggagtgtatatatgtatatattttttgcataattaaataatatatatatgtcattgaactcaggctggttagaggcatgcatgtatgatataaattctctgtatacaaataaaaggaagttacttgtattcgttgaatgggttgttatgatgactcccttcataggaaacatttggatccatttcctctgctttcgatgttgttctttcgcttctgaaccagtgtttgaggcagatgtctttgatactgagtaaagacatggcagtttgcattcactctctgaccaaaagagatgctccctactcttgcagaatactgattgcccatgacaaccagagtacttttataagaaaaggagcacacagaaggcagaaagggaccttgtttggggaggcggctttgagcagtgactttatgacataaacgattaggctcttcctggccccgcctgtcttgggatatctactcagaccctggaactttgaaatcgcaggctgggtccaatgagcgcagaaaagggacaggactcaggcagataggatttctttcgggtttggtaaacagctggcctctaggggtagggacaggggcagtgggtgggaggacttgggggagggatgggtgagctcgtgggaactgagaaactgtgtctagggcttccttagttatactgaatgctgcatgtagaggtctgcagggtggccagctgatggctggcggaagatctgctgacttggattcagttactactaaaatggcaggtttagaaagaggagagaacttctagatccagaggaaataatcaggtaagtatgctaagatgtgtgtatgtgttagccaggcacggtggctcacgcctgtaatcccagcactttgtgaggctgaggcaggtggatcaccaggtcaggagctcaagaccagtctggccaacatggtgaaaccccgtctttactaaaaatacaaaaattagctgggtgtggtggcgggcgcctgtaatcccagctactcgggaagctgaggcagagaatcacttgaacccgcaaggcagaggttgcagtgagccgagatcatgccactgcactccagcctgggcgacagagcgagtttccatctcaaaaaaaaaaaaaaaaaaaaaaaaaaaaaaaaaaaaaaaagatgtgtgtatgtgtgtatgcttatatatataatacatatttatttgtacatatgtgcatgtacagatataaacacacaaggatgtttatcatagagttgtttataaaagcatccaactaacatttctgtatctatgcaattgaaaacaacatagccattcaaagggatgaggcagagctatatgaactgatatattgggattgaaataaaccagatcaccaagcacattttggatgattctattagcaggggacgtatccacaagtttatagtagcatagggaaaagtcttgaaggtaatataaatataaagcatagttataactggacagtgggagtttaggtcatttacacaattattttataggtttttgtttgtttgttgacttctttttttcccaacctttctttagtgaagttgtattacttaagttaaaaaggaaataatgagcctggtgtggtggctcacgcctgtaattccagcactttgggaagccgaggcaggagcatcacttgaggtcaggagtttgagaccaggctggtcaacatggtgaaactccatctctactaaaaatacaaaaaattagctgggtgtggtggtgacacctataatcccagccattcaggaggctgaggcaggagaatcgcttgaacccgggaggcggaggttgcagtgagctgagattgtgtcactgcactatagcttgggagacagagcaaactccgtctcaaaaataaataaataaataaataaacaaaatttaaaaaggtaataatgtaagaaaataaagagcatggagaaagtagaaaaccagataacctcggtcctattttgttaaattttgggaaatttcagtatctgcattgtacagatgacaggcagaatcttgagaagttaacactttaaaagaaagaaagaaaaaaactagatattcactatgtgtcatcttgttgactattctcttctctgaacttcctggcatcttagttagcctatttgagctggaataaaatgtactacgtgtcttcagattctgcaaacatttaccaggcaccagggcgtccactatccagtcccaagcctgccactcaggagttcatgggggagtgagtgcatgtggcaggcattaggcagggtttttgcattctgctctcccacttgatccctgtgacaaccctaggagcctgctgccactgatcttcttattccacttgagggaacctagaggcagagacaggatttgaatccaagcctccagctccaaaccccagctgaaggaagcaagctggaacccaagatgctttcaatccctgctgctctgagcactgagatttgttcactggaatgctggagttttgctgatcattgacctcgcaggggcccactctgaagttaaaaatccccgagtgaataaatctccagcctctcctgctgtttccttcccagttctgaaagtgagggcaggagagatgagctttggccaggaattcagcgagtgactttgcgtggagtgtcagcttctccacattgctgggtgttagcttacccctgtctggcaccagcagcaaaaacagagccaggcgtggcctatagcaaagctcccagtttaaatatgtgaattcatttgggcctggacagctgcatagctcaggctgggcagaatctgccaccctaccccgtttccttgaaatctatacaggaacacagttccaaataccctggtgccagtccctgcaagctcctacttgtacaaatggattttaaaacatgtgatgatatctacctcctcccgtacctctgggcttttctaggtgtcagcatgaatctcatgtgagctttacaatgaccccagagtgggtgggcaagggagaggtggttatgactatcatgaactcccttgcttttacaagccactcccctacaatcctttctccaacaagtagacagtgaactttaaaaaatgtcagtcacatctctgccaatgccctgctcaaagccctccagtggcttcttaattcctcaagaagctctagaagtttctacgggatctggcctctgtctcccttggccttgctgttgccacatacttctagctattcctcaaatgctccaggctccaagtttgtcactgtctcttttgaacttgctgtcctctcttccaggaacacctcatcccccagatactcactggctggccccttctcatcatggaggtctcaactcaaatgtcaccttcgtagagaggccttccttgcctcccttcccctcctaccagcctccttgtctattcccctttgcctcctagcacctgccatcatattgggtatttgtcttattgtttggcctgattcctcctccgttacttaggcaccaggagagtagagaccttgttggtcttgttcaccatctagaagatacttgaaactctaacatttgttaaatgcaggaaagaatgcccttttgacagctaggaaattgaggctgagacaagtgaagtgtcttgccctggtttcccagctagtgagtgtctgtgctggattcaaacttagctcttatgctccagccttcaagtgggggaaactcaagagggcaagttcttacggggccacttaggagcagacagcttcttaggacaacattcttttatgttgatgtgaagtagcaaatctttcagagatacaggcctctaaaaaattctgccatctgccggctgctgtgttagagccagcctcagaaaaaggtcagagatccaatccctggctgggtgctgtgcacccaggaaagaaggagcagaattgaaataagtcttttccactcttctagatgagccttctaggccacaggcagggcatacccatgcatagactttaagggcctttatttggtctgtttgcttcccagttggggaaacaggcccagggacaggaagtgacctgcctgatgctacctcatgagttagtggtccaggcagttagaaccaaggtttcccaatccagcgggagttcttacctacccactatagacttcttggccggttctgggagactgagctctttccttccctgtgtttgcctcatcagcacgctggactgagcgttcccagattcagtgctggagccagcggtggggaggggagtaggggctgaagagtatatcagccaagcttgggggagacagtcacataaggaaattcacactcttcctctctcattagggggccccacaatgaggaggggaaagacaaaaaacaaggatcttgggtacattggtccttacctccccactgccccaggagcggtcttgagggttggaggagactaccagcctcctccctatagcggacttgaacttggcacatggaaccagctgaaactggcaccatttctaccctcagagggtaccgctgaagaagacgggcagagatgaaagaggaactgcttaattcagctcggcacttcttagcagctcccccatcccattgccggctttagtcccaggccagagacccatgaggtgcgttgaacattactgataccctctttgatctaaaccctcctttcgtgatcacgcctggtggctcaaagaattgctcccccagcttactgttcctgttggtgctgaaagaatgctcgtaattgttaccaaacagtggacggagcaaggcaacatgtcccctttgcccagctggctcccagttggcacttcattatggcaaagacagagggggtggggtccccgggccttcggcatttcatttgcacccacatgtaggctcacttcttggcctgggaattgatcggtgccagatgctccatctagccagcatccccaccgcagcagggctgcccgcctcctgtttcgtgaaaaacggcccggattttcatcagaccttaattggcctgggtctggccttcattctaccccagcctcttcacagactgctggccactggctgttccctcctccagccaggacaatgccggtccccgggcactgaccctggcccaggcaggcctgccaactccatagctctcatttctcactctgcacatcagtgctggcttcccacacccacagctcctccagaaggaaggtttgtcagcgggcttcaccatgcactctgacgtaccacttttggcccaaccaaactacaccccacccttgggtagaatgggaccaagatgcgaccctgacagacttaaatgagaaatgagcattttccagtgacgcctcctcttcctgcctcttgctgggcctctctctgcattgctctggggtgttcactgcacttggactgataccagtcaatgtccctcgcttcaacctgacctgaaactgaaatgctccaaacaagagtaagtggggcagccgacatttcaggaggaggaaggttggcagccaggctgctgtgagcttgcacggcccatatgggtcccagctagtactttgcattttcttttctctcttcttggaaccccttcgtcctttttcccgctgccctctagcctcttcactgtcttgggaaagggggcctctcacaaaacagtagtcaccgctgctgttcactgagtggttactttgcaccaggcactgtgctaagtacctcaaggggagtatctcccttaatgcctgcaacatcctatgagccttgtatgattgcatctcccttttcaagctgaaaagaagttacatgctttgcccgacagtctatagctaggaggagctggagctgagattcaaccccaggttctctggtgcccaagtgctcatgtctttgccctgtgtgcccctctttcacagaaacagagcttcagccaaatcctggaacggaagctcttgggaagctgcctgtgacctttcttattgtgtcccctcagcacaggtcatgcacaggcagctgggaatagatatgcgagttaaaggaattctcgttggaaaacaccagagggatccacagggccacccccccgcccccgcaataccactgtgtgtctgtccctgcagggccctggaatcccacagttgtttcctgtacccaggcctggggagccagccagtcacatggaccgtgagtgtatccgcctcacgcttctctgtggcccctggcttctcccagtggattccgcaaggtgtttcctgcaaatcctgctgatggtcttcgctggcacgtagcaaaatccacccagaacaccgcgatctgctggcctcagcctggatggggttttgtttttgtttagcttttaaaaaaatgtgtgtttttttttccccaaccaggggcacaggggtgggggaagaggagaaacatgaaggtaaaaatattgacagagtgaaaagtattgaatattccttctatttcaaaaatagcagcttccatggctgggatgcaggctggctaagttcaggttgggctgaggttgaagttgagatcaaggtggcagcgtgacccttatgcctcaagcatgtccttcaggagggtgtgggagcctgaggcagaagagagctccttcctgttttaaaaacacctttttctgagactctcaaagaatgtttgaaatcagccatccaaggtgctctgccatttttaagagggaggacggggctggatggtgtccctgggaattgaagggacccagagaagaggtgaattgtttaaagttaactcagagcattagagtgggctgatatcctctgaagagtctacttgtctgtgagagctgtttcagctacttcaaagccagatgatcagggcagcggggctggattttcatcttcatggctgtgcacatctccacttgatatgtgggggtcggagttggggggcagtaaagcctggtccccatggagatgctatcctggaagcatttttattaccaaggactagcatataattggaagattgaaggcagaagcccttatcttctcggcattctttagaattcttctgtatgtagatttcagaacacacagagccagagcaaaagaccttacttggcattaacaccaggatccacctgcccctcccttcctggcattaatgtccagtgctcccctaatgcactttaagctgtgaagttatcccaggtttatttacactgtaactaatttactcttggctggactgtcagcctggaaaataggatgtcactgcaccccccccaacctccaccaaaaaaagacagtggctaatgaagaaaacagattgttgaagggcactaaaattgaggcaaggagctgaataatgtgccctcctcaggggcaggcagggcaggcgtggcaggctgtcggcattgttacagatcagcaatgtcccactagttagcaaatgggcccctctcagtttgaatgtgcagctgatggaccaggtggggtgattaggggccaactccgtacttgtttctgtccccagttttgttaagtgcagatcacccagacagatcccaggctgagaaagagactgaagacaaagctagaagaggcagctgaagcatcctaatgtcttaactcaagtttgacttttcagaaatgtgattttagaacatagcaaacaggaagcacgtgacaacttggaccactacaacgaagagaaagtggaacccaggggaaatgcatgagttagaaatataaagtgatgggactcttagattctagggttaattgggacactagaatatgtccagtccaacgtgttcattttgtacaataaaaaacaagggctccaggaggaaatgatttgtcaaactcacatagaaaatgaatggaaaaaaacagaaagagtatctagcttccaattcctggcccagggctcttcttgctattcaatactttctacgtaataagcctgggttttttttttttttcaaaaaaattattatacttggccacccagatgagtacagttatttagtagagtacgtagagttattcactaaatcacatcaaagttgggagacagagtctggtttgaaaaccctcgagtattttattttattttattttattttattgtgataatacttaacatgagatatactcgcccctctctttttctgagacagagtctcactctgtcgttcagctggagtgcagtggcatgatactggcttcctgcagcctcaacttcctaggctcaagtgatccgtttccctcagcctcccaagtagctgggactacaggtacgtactaccattcccagctaatttttttttcgtggttttcgtagagacagggttttaccttgttgcccaggctggtctcgcactcctgagctcaaggaattcacctgcctcgacctcccgaagtcctgggattacaggcgtgagccaccgcgcccagcaagatctaccttcttaacacattttttaacactagaagtacttaaatagatgatggtgaagtctcaagctgtcctaccagcagtaaaaagattccaagtggggaaggtgaactctcaaccttgtatactgatcggtggctcctgggaaatttgcatttatcccctaacaaagccattaagagagtcattggcccccagcaagactgagatggtcgaaggacatgggaccatgtcataagcagggagagaccatcctaatctatgaaaatatttatcctggagatgatttgggaaacatgacccttcttttcaaatatcttgtttttttgtaagcccaagatgtcacctaggtgggagaaagccacagggaagcagtccaaaggagaatttttttatagtcaaaaaaaatggcttgacatggaacaggctgacctaggtcagagatggttgcacactgggcagtttaaccttgggatgggactgtagaagaaattcaaaggagcttacactgagtgaccctgaaggtcccacccaacctaaagtctgtggcctgtgaaatgtgcccatgccactgtgccgtagtttaacatgtccttctggaaggcaggtaggacccagagatgagaagtaggggctcccaattcaggctgcctggactggcatgctatgtccaccacttccgcattagatgatctggggagagtcacttcttctttacaggcctcgatttctaaaagatgggctaatgacaacacttactttatagggccctagtgaggctcaaatgggaaaatccacggaaagcatttagcactgatcatgcatggaaagtgcctgatagctgatggcacctattgtaactaataatagtattagaattagtattgtaatcattgacaataggatttttataattagggaaagtggggaactacccacatgaccatcctcctgctttctgtgtcagtgtttgaccaaatgtgttcatccctggtactctcattgcttatcctccgagagcactggcatataatggaaaatgtattccaatttgttctgttattccagccaggaacatctaggaacaggggttggaggtgtgcttcagggactacctgagcccagcttttttttttttgagatggagtctcattcttcttgcccaggctggagtgcagtggcacgatctcggctcactgcagcctccgcctccaaggttcaagccattctcctgcctcagcctcccaagtagttgggattacaggtgccctccaccacatctggctaatttatttttttttttgtatttttagtagaaacggggttccaccgtgttggccaggctggtctcaaactcctgacctcaggtgatcagcctgccttggcctcccaaagtgctgggattacaggcatgagccactgcacccggccaagcccaccttttgataggagcctcccatgggcaggcagagtaagaagtgtcacatgcagccactggtcacttaggcaaaaccctgccagctttcagatgtgcagtggaggtggcagggggaggtggctggtgctgtgtatgttttgcagatactctgtggtgtggcaattgctctagaggactctagtgtccagaagcaggcatgtgcagtttatcattacagccctccttcaaagaggacagctggccctgtgctttgcagggagaggtgcactccgggtggcccataaacccagaaaatatgattcctatctggtacagggtaccatcctggcacctggagaggggtctgcatgagacccagaaatgactggatccacaacagacctagtttgtggaacagtcctaaagaatcctccattcaagcttatatctgtcacccagggaactggacattcccttcagtcagaatgaactagtggcctccccttctcttcagccagggtctttgcagtcctcagccatgtgacctccgacctgtcagtcttggtctgattgctgtacccttgtttgtgctgtttccattgcctggaccatccttcttttctttccatgatcaaaaccctatacattcttctgagtcagttcatgcagcggaattggcattggaatgttgcagctaattgcacatactgggtgacagagtgcacagtagagaaaggtagggtgatacactcttcttaggaagcaatcaataagggccaagatggaaaagatgtcttatttcacccactgagcacctactatgttccagacactgtgagatgttgcggttagatacaattgtgagcaaagcaagatgtaattccggcagaatttagtgagtgtatgggggcagggaagaaagaggatgagacatgattcaaatgaatctacgaacatatagttacatacacactagggcccctgagaatacaaaacaggggttctgttctagtcttatgcttgcaggaggtggttggggatggctttatgtgaggaagtgttttttgattttaaatgtgaagtatgagtggcagttgatgggtaatggggagcagaagagggtctcatgcagatagaatggtatgtgcaaaggccccaaggctttgcaactgagagatttagaccagggctgccgatcagatgtctaaaaaagtatacttgttcgccccttgccatactctttggtccaaagggctgagctccctgtcttcaaaccagggggcttcaggtcagttactggacttctctcttcctgccctttgtctgcaagccaaggtaccctcaatctggcattgagagccctggggcccacccagcttgtaagtggagatttgaatccagacttcaccattggatgagattcttagacattacaagagttatggagagttaactccacctcaaagttctcaccatctgtaacttatacaagcccttctctcataattcagtcttgggaattttccctatctccgcatttccaatgcatttgacttggtggggtgtttcagatttgttaaatatttagtagtagaaagaagatgagctttgctgctgggcatatttggattcctagctgtgtgacttctgacaagtttcttaactatcctgagacttgttttcttcctatactcagtggaaataaagctacacattttggggaatggttttaagagtaagatgtactgtttgtaaagtgtgtctgtcttgttcacttttctgtttctgccacctgacacaatgcctggcacatagtaagtgctcagtgaatatttactgaatgaataagaggtttaggcaccatgattgcacagacacgatgttcatagagtagttggtcttctccttctttatcaatgactccatctccctgtcacacttcaaggccagggcaggtggttcagaaataccagaggttggctttatagttctgccattacccactttgaccaaagagggcagcagttagcattctttacttatttattttatttaaaatgaaggtttccttaaaaggatttggatcttctctttaatcattcctccgcaccttcagtgctattgattcctgataatggtcttagggcttgaagacctatgtatgggctcgtttttctcgtacctgttcctacctgagtgcccactatgtgagtgatgtggttgtgagctggaagggaggtgctgagtgagtaggggaacacccgctgcagcaggtgggccttccaaactatggccctgggtgtccacaaccttacagaatgaagcttgtggaacttaaaggtgaggaaagcctacactattttaaaagccacatgaagggtaagttatagatgtaccagggtctccttggcatctgtgctgtataaaatccatagacagagcagccattggctcttgttcaaaccacaagaaagtctcctgcccactcctggtgcattctgggaacagatttgctgtctgcaaaggctgcatctgcgggtctggcgtgcaaaggagggtggttctttggctaatggtggacttgctcctaggcctatcccagagtccctcagctctcctagcaaacaaaatcccaattaggagaaaaataaaatgctatagatggctcctgagatgttgccagctgtttgggcttcaaaaatgccccgacctgaaagctggaagttctgagaaccgtttgagggcatggtatttttctgggcactgcttcaaaggggctgtggttgaagaccatgctgctattctggtggccacttgtgtgggataaagtttcccatgggcccccgtggagaggctggagcactctcaggggatagggggtggtctcagcccccctcaccgagtgcacttgcatggcagtaagcaagtcggcgcctctgacccctgagtgggcttgagcttttgagaggtcagcatgcccccttaaacttgatgtctcctcagagcacagcacagatgcccagccaaaacacccagggcgaaaccactccaagaggtgaaagggcttgaggggagacagggtacggcgggagacagagatgcatgaaatactaacgttgaagattagaaatgggatgtgcactggaatgagatcatttgtggttctgatgcaaagacccaggcttgtttctaggggtttcttggggcttcgggggcctcctgtcaatggactgtttggacacccatttggatacatgcaatcctaaagtctatgggcagtgacagagtgataagtctttatcactagcctcagggagtagaagcccacctaagaaatggcactgtcccatgttggagcaagacccaacctaccaagctgggagttaccgcccactgcaaggcacccctgtactttgttggactctctgttttctgtctctccaatgggctggactctccagcctccgggcctctgcccaaccatgaccagaaggtcctctcctttctctttctcttaactgtctctagtgattctctgatcccagctcaggcaggatgtctccctccggcgcctccaggctggctgggtgtgtctgctgcatgctcctgtggctccctggactataactccctgtcttcttgtctcacaagagtaaaataagcttcttaaaggtaggaaccttgtctgcctgcttattactgaatccccaagacatggcacaggatctgagatgcatagttcctcaaatacttctgaataaatatcagatgagtgaatcaatgaatttcaagtggacttgaggagaaggagggggggtggcaaaataaaacaaacaataaacactatggcagagagggacacaggacctggagatggggcctggataaacagcctgccatgctcttcatatttcctgagtgctaccacaaggaagaggggcagctggaggccagagggcctgcagaggagtcagcaggtctagcaaggagtgccttgggtggagactccctggggctaattttggtgtcaccactgacttccttgagggtgctgagccttgggatcttcatgtgttggtagcttttgggtgctgtccttccacagacacatcaacaagttcatgggggtctcctgtaatagggtcctgtgacttgcctctttttggaggtcagtcttcaatattttggaacaatgtcggtattcggcctctccagatcacatttttacttgtcccttccttttctgagtaactctatggaacaaggactcctgacccagcactccaggaagccaaacacaaaaccatccccgtcttcgttattgtattacctttggttccctcccacagcctcattcattcattcattcaacatttttgggaaccctggccacaatctaggctctatgccatgtgctggagtcccagatgcagtccctgccatccggtaattagcgatgctagtgagtgtccaaggaaccaatcattaaagaacacgtgctggaagaaagagaggaaagccaagcagaagagaggtggactagcttggcctggggtggacagaaggcttcctggaggaggtagcatttcagctgggtgggtcttgcaggaagccaaaggtgcaggcagatgcacagggaggaagtgattctcacctaggcaaggggcatcataggacaggttcatatagtgatgggggctggaagcttcagagtgatagggtttgaggtatggtcccagctctgaagagccatatatatgccaccgagctatgcagaataatcctgtagatactgcaaacccaagggaggtgtaggtgaggatgtaaatgagggttgtggatcccatttgttcctgggagaatgtgggggacttaggggagaaggactgtgtttcccactgtctatcctttggggctttgacatttcccacctgacagccatttgcagagtaaaagcctcagggattctaatcatgcttggtgaacactttgaggtagtcgcctcattggacccttagaaacccaggtcacagaaacaccatcacccttctgagattcacagtcctccctccccaggtaagtcggccctgaatccaggaatcagccagccctaggacttttgccctgtcccaggccaaggtatctgtacctttcttccaaattgctggtggccccaggaagaaatcaagagtggctgactttaagcagttagattaaacatcaaatgcattcatcccaagtccaggcatatacctagaaggagcgactcttaaattttgtcatttcattgtgtaaaactgaggttgccccttaacacatgaaggccagcatgggatgctaattttgtgttgtgttcttttgggtaatctcaaagttccaggaagcctgaccttcctaagcctgtgtttccttgcctccccttcccggccccttcatttcatctacaacagacgtcagcaggggccctgagtttttcccagaccgctcaagcagaaacccatcctgctcacaaggtgaggagagccaggagctcacaaaggcccctcctccccttccccgggaggtccaggacagggcatccccaggacagacctgccctggggaccccggaacacaaggcaggtactgagaaacaggaatctctgggcagggaggttttcatatcctccaggtttaatagctttccctgagatggaaacttgggttgaaatgatttgcagctttccagattttctgagtgtgtgtctttgggtttatttttagccacaggcattcatttcttgccaaaaaaacctgcttaaataaaaccaagattaatatttttacttaacggaaagagttagtcaggacaggctttgaactgggactccttatcttgatggggagtgcatgttaacggtctggccttggcgttgacatcaacgaaaagggcctttgaaacggacaagagagaagggccctgggggaccagggtaggatgcaggaaaagcctatttgtgggacttctctgaagagagagagttcctcttcactcaggctgctcgccgctccccacccccagcccccagcccccatgctcttgcagtgggaggggggtcatcatcttcctggaaaggcgggagatcggctctggctttgctcagagcccggctgtgattctgcctcacttccagctgctctccttaccgccgccccctccgccccccacccagatcagatccagacttcttcctcctctggattcagacgcagcaaactgagtctcttctgcaggatgggctgaggctcagatctgatgccatctccagggcgattccctgacacccctcccctgagatggacttcatctcttcttggctctgtcctggctttccgtccttgcttatattgctgagcctgccttacttgagtgtcattgctggtctctctcacctctggcccttgagttcctaggagccttatgtatctctctatccctgtatacgtcttcacaatactgaaacaccttcctggttgctgaagagttgtgtatctgaccctgtgaaccgagaattgctgttacccccttttgattgaataagacttagaaagactggtcatttgacagagcttgcacaggaattatttatctgtttttaaatcactctgtgtgtggcactttatacaagaaatcacacgtagcttcccatattcagcaaatacatatgaggtgcctgttatgtgccaggcactcttcgggcagctttggctacagcaataggtaaagcaaagaacctgctgcccggggaggcttacattttaatggggagagatgatcagtaaagaagcaagttaatgtataatgtcagatggtggccagtgtctgatagagcacagtgtcaggggccaagggattgcgaggagggggaggaatgtgcatggatcaggatcagggaaggtcccccgcccaagtgaagaaagagtgttccagcagagggaactgcaaggtcagagaccctgagagcatgcttgggtgctagggtgtgcagtagagtgagctacaatttcctgagattaagaaggccatgagagccccgggtgcagggaaggcctgttatctggagctcagtgttggatgggtcgaatttgagatgttttattaggcttgcaggtataaatgtagactaaatgtagactctgggatatataagtaaaaagatcatcagggaggggaacaacatacactggggcctgttggtgggtggggtaggggagggagagcattaggaaaaatagctaatgcacactcggcttaatacctcagtgatgggttgataggtgcagcaaatcactatggtacatgtttacctttgtaacaagcctgcacatcctgcacatgtaccccagaacttaaaataaaaatacaatttgtttaaaaaaaaagttcatgagagttctaggttggcggtggcaaaagcgtgggagctgtcagttgtgcagatggtgctgagacccacaagctggaagaacatagcaggaccacgagcctgcacctcgatgaccggactgagcaccaagaaggtcatgggtgacttcgacaagcactgctttggagaggttaggggggaggctgcctaggttattgcaggcacctttggaggctggtaattatcacccacaatttatctgctgggatgggaagtgacttgcccaaggtcacagagaaacagggcagcgacttcacccagaccccacgtgctccatgcctgtttttcattccagtacgccgtgatcacttctccagttttcttgatctgtcctttcagcttctgagtctttcaggagggtttttttgggagttgggattgtggtgatcaataggctgggaatcagagggacccagtccaggcaggcccctcaggcctctgcttttcacccttagttccgaaggccctttcctctcacctagacatcatcaaagcatccccagagaggcagcagatatctgagaaggaccttgggaagggtcactgaggaaggttctcaagatcctggggggatgaggaaatgctgaatcacaagaatctttcgggttcctcttgctgttttcctctgattagtaaatttaagaatctacaagtcatcaccatcagcaatataacagtgtatcatttgtctagcttcagggttacaaagtacctttgtacatatacattgtctcatttaattaatcaatctaattaacttcaaacttcctgtgttgggagaacccttagggagcctgtggttttgtggtttctaagttatttgtttttattccatgaaagccttgccggggagcacaaaggtctaaacagatgatacgatatactgttatactgctgatggcgatgacttctagatttttattactaatcagaggacatgtgtttgtgtgtctgtgtaagtgattgggaagggtggtgggtgggtgatcaaagggatgtggggctcactgggagcttatcaagggtccttccttttaggtatcaatcttcttctctgatcctctgcagtgaaagtggggaatgcagtaaaattatgaactattttgcaaccagtgtgaaatcccatgtaaaggtttttaggtggtctgctgtcctgggggacctcccatttttttttttcccccactaggatgcaaaactgcttacaggctacctgatcctcattgtccacagttggaaagtagggacattaacagccacaacagtagccaccttaccagcttgccatgaggacagagttaaagaacatgcacacgttgcttggcacctaagaggcattcgataaatggtagtggttgttatcagtatgttctagttcccttccttctcctctagattcactaatgtgatgctaagaaaagcaagcagtttgtaattcttgaatgggtgagcagctggaagagtgagagagcctggctctgccctccttgggcaggctacattgtagagtgtccaaggtgggcaggaaaaaggcttgcttggcgggctccaggccgacctccctgtgggtccctgacctattgcctttgccatgagcactccggcctcagcaaggccgctccctttgtcatcctgtgggagatgataaaatacacacgaaggggccgtgagacaagctgggtgacagggatccctctttcctcctttttggtgtgttttcatgggtagggcatcattccaacacttccagatccctcttttcctccaagtctaggccgaagatgcgagcccatggtccaggcttttcttcctacctagagcctgcctgctggggtcccatcagaagagcagccccttccctgggactgacactaacagtgacttctgcatttgaagaaatgcagtctacccactaaccagacgtcccttacttatccttgctgtccttttaaaaaccatgccttaaagcagcaaaatcattctatggggtctttggagagacaggaatgggggtgttgtgtgtgtgtgtggggtggcggtggtatctcacctgctagatagcatgaatcaactcctaagtcatggagaggatttgtactgctcttccgttgatgctaccatgggtggaacctggactcctaagttagtatacattaattagttaaggagtccttgatccccagaccagccaaatgggtagcattgttgctcggccttctagtctgccagtaggaaagtccaaccattaggtcggggaagaagggtctggatttggttgacaatggttggatgggggatagaagcagagagagagagggagggcagctcaagggtatcttgccccactctgtttatgctgatgaacagcacatgtgcaatttctggagacacaccagtaagcttttctggaaactcaatcccaattgccattggaaaattgttctttgttcaaaacttgtgccactgtggtccatactgctagagctggaggtggggagaggcagcatgaaggtatatttatggaagaggtgtgccttgtttgccttgcttttgtaagctcttactagcactcttgcccaaacaaatattcaaaggaagcaaagacagttcaatagagatatatgcctctatgcctggcttctcaggcgcatgatatattcaagagggccccatatatatttatagatcaatgtgcccattatataagttcacacatcctagttagtttcttcttagatacttttacattgaaatactgcttattccttaatcaatctcttccttgtttcttcttcttccttttttttttttgctgagacagagtcttgctctgtcacccaggctggagtgtaatggcatgagatatagctcactgtagcctcgaactcctgggctcaagcaatcctcccacctcagcctcctgagtagctgagactacagatacacggcaccatgcctggctaattgttttaaatttttataattttttattttttatagagacaaggtctcactgtgttgcccaggctggtctggaactcctgagctcaagtgatcctcctgccttggcctcccaaagtgatgagattataggcatgtgccaccacacccagcctcttccttgcttcttttgaccaccagatccctagaagcccagattctcttcctaagagcaaaagaaattctagagagacaagagaggctcagaggctgagattcacactgagcctcacctctcccttctctgattggtgcttctgtaccttggagactagtcctctagccataaactttttttttttgagatggaatctcgctctgtttccaggctggagtacggtgatgcaatctcggctcactgcaacctccacctcctgggttcaagtgattctcctgcctcagcctcccaagtagctgggactacaggcggccccatgcccagctaatttttgtattttagtagagatggggtttcaccatgctggccaggatggtctcaatctcttgacctcgtgatctgcccacctcagcctcccaaagtgctgggattacagtggtgagcctccacacccggccagccataaacttttaaaccttatctccccactagactagccatcagtggaagcgggaaataggacttctatttcttgttgtcaccctcaccagcacccaacccaatgttccagacaccaacctagttcatgcctatgttggtttgattgttgggggcactgggtagacagtgtaggggccatactccagcatgaatgggaataaagacaacctgtgtccagcctggcccatctgtaaagctggcttctagccaccacaacaaggtggaaggaatggctagacatgctgccagttaccagtttgaaaagtgtcttctgttgttggaaaagcacaacctcctcccaccccacttcccttgttccctgtggcccctgggccagcgaatgcctcgggagaaccctgattgccaaacaggagagtacaaaatagcacacatttgaattacagaggagaaactggagcaaatacggacagattaatgcacaaaccaaataggtggatctggggttggccagcaattctactttggaaggactttgagaatctatttggagggcagaatgtaacttaattttagttcagtttagtgaagttttgtttttgtaaggaaaacactgatgtggcctcttcactgggccatctctgcctcagacttttggaaccatgactgtgatcttgtttggctggtcttagtaggcaattcttgggttacacatgggtgataaggtgggatgggtacatgtgatagagtaggcactcctgatcccaaaatacctcctatacttgttctgactacttcatctgtgcttctccacctctccctgaagttctgtaaggctagaatatttttatgaggttgcctttcttctcatcctagggagaactcccaggccttagcttacagtgcatgttagaagtctgaagatggtatgccctaagatggaataaaaatagacatcaccatagtggtgataatgctaataacagtggtagcaaacacatgaggtttgggatggactacatactgttctcagcgcttatattaatacgaccctcacagcaactttatgaggcattgtttcatcattcccatcttacagattgggaaaccaaggcatagagaggtttagcaacttcctgaaggtcacccagcaccagggctgggatttgaaccctggctctcaggctccagagaccaggctctttaatgcaatgctatgttgctgctccaatagtaataagcaaatcacttgttagccacatgagaggcactgggctaagaaagccagagagattcaggaggaaagagccccagagagatcatacagtaatggtggaacccaaacttcaatgcagcttcctgactacaaaaacgtattcttttcactgaactatcctcagatgaaaaggttccaagctcaggctatttggggtaaggaaggagttggctggttgtatgtgcagaagcttccagcagtactcagctttatggggcaggtctgcttgtgacatcttctgtctaaatcaagtcaagccatttttgaaccaggatgttgctatttaaaggaatcccttttgccttgcccctcccacaccccccggccaagactcgctcccttgtttaccttctgtgttaatgaggcagagaagatgggtccaaatcatttcaggaagaatcagtggtaaaggctggcagacatgcctctgcacggaggtgaagctgttataacctgcctgtgagagttaatatggaggaaacagtccccggggcctccgggaggctggcttgtcgccgagaatactaccgcaatgttagaaacagaggtggatgcaggatcttgacagacattggcctgggatcttgccaacctctcgtttttacagcagacttggaaacaaccactcgcctcctcctaatttgagctgcctccgctaaattgctcactttgccaatgactgtgtgttttgccatcgccggcagggaaggtctgaaggggccattgattcatctgaaccctgacttcatgtctgactgcaagggtaggatccaagctcatttggaaagaaacaagacagaatccagtatggatgaggaatcagttcttagtaaagattttttaaaaacagagattagagtcaaataactgggatacatagtggagcatccacaatgaggaaggataatggagctaccaaaatgtgtgtgtgtgtgtttgtgtttgtgtgtgtgaagggtattttacttaacaagcatttattgagtatctactcctttttgggctaagtgcaacttgagataagaaagattgataggatctcagggctgaaggagttcaatttgtaattcaaagtatgactgcataagcaagccccattccaattcctgttgaggtcttagcatggaagtatccagcaccctcatcacaccccctgatagaggcactctctgccctaatggcagcccccctgccttttgttgctggttcttattattagacgatttttttctttggttgagccaatgaatgttactctctgcaatttccagttttggtattcaagacctgtccatttgctcctccatgtgccaattttacaaatacctgaagacagctcttgggtgcttctttttcacacaacgtagaaagagaagcacaaccttgtagaatctaaaagtcaagtcctctcctctttctgttcccagtgcatgtggtaaatgcctctctttcagccctcaacccactgggtgtaattacttttgtattcatagttaactagtatctactgggtaaatcctttctgccagacattgtagtgggaaatttcataagatctttcgttcaatcctgattccaattccctgatgtaaagagagttataccctctttatagatgagaaaattgaggctcagaaagaggaagtggtttcacttcttggtctgttaccttatctagatcatgtggatgctaatactgcccttgtaagacagttaagagcagtaaataagtgaaatgtacatggcacatagtaggtgtgcaataaatgggagctgttttcattggaacagcccttccatggttagcccatttcatttttggtgatgataatgatgatgatattaataatatttgtctagtgcaaactatgtccaagacagtatcaagagtttcacatttgtcatcttgactaatcccttcagttcaagagattagtatcattatgattcctgttttatagaagaggaggccagaaacaaagttacttacttgcatacagtcgcaatagccataaacagcagagctgagattggaacagttctgtctggctcctgagccccgactcccaattgctccttcttctaaccacatccccatagagctcagactctattgcatcccttgctatctaagcactggataccaagggctcaatcagaatgctaactgggggcactgtgggaagctagggtgcaccacaaccctgtagacatgtcaagatgtggtgaattaatgcatgcaaaggaagagccccaaatgaggtggttagaaaggggtcctagtggaaagagaacagatctgggagaccatggcattgtcagatggacaagggaggggggacaatggctctaacaggagaagtaggttttggattatggtaaagtcacaaagtcaagaaaatcctcagggtcggcgggggttgactatagccttggaagttctggagctggcaattgtgaatatttggggtaattaacttgaatggtggctgtttctttttcctccaacctccctctcaccccagggaattcccactcttgtaaacacaatcatctattccagttggctccaaggtaagagtgcaattccaggctccacagaggctagcgtgcccgccctgagatgctgttcctgatgtggttcaggccttcctaacctcttattgtctccttctgtctctgcagtgatccgggccaaggtggtggggaagaagctggtaaaggaggggcccttcggcacgctggtctacaccatcaagcagatgaaggtaggtaatgtcatcaccctggctccgggaaggtttttgggtttttgccagaagagtcctggctaagggaggcaaagtgggttggaactggggtgtgtgtctaagcaccagccagacccagcccttctgcctgctggagagggagctgctaaggctgcataaagggatgggtagggagggggcatggggctgccttgtccaagagcccatgcaggtggagtcactccaaggcacttgttaggaagctgagctctggagccagatggcagatagccttgttagctcgtaaccatgagaccttggtcaagtcactgcccctctctgggctttaatcttcccaattgtgaaatgagggggttggactagatcatctctatgaactcttctgagctctgactatctgggactcaacagtgcttacaggtttcatgcagccactgaggttacagcttaggtttacagccctcaaatctttacatggaaactgtgctgatcacaggaacctcatcccaaggcaggaacttcaccttctttccctattttcccagctgattgtcttcttgcatcctagatagttagcaatgtttgctaagcatattcttatcattaaacatattactgaggatatgaacatcatgaagtacaggaaggaggtatgcccttaagaaaaagaacaccagatttgaaatctagagaacctgcctcctagtctcacctctactcctaaatagcctgcttaccttgggcttgtcccttttcctgggccgcagttttgccacctgttaacagtgtggggttgggcttggtgctcctaacatcctctctagctcaggcattctaagcaccctgggatgcgggccatgttacttgtaaggaggagcgggtggtatacaatggaagggtgtactggtgattgccttagcacagaagactggggcttcaccttgaataactcagcaactggttcatcaccccatctttgtaagcacctctctacatgcagagctcccagctaggagccagggaggccgtgagggagatacagtttccatctttaggaactagagtcaggttgggagagaagaggcaggtatgtgtgtgactcatcagaagttcaatgtggggtgtgctgaggtccacaggaactgtccagccctttaacttattgctcatatttgcatccctagcaattagggtaggacctggcatgcaaaagtgacttggtgaatgcttatctgtctaatacgggcatgagggtgagaccccacaggcctggaaactccccagaggagacaagccgcaatgtccaggtagaagggagtggaggagtgacgcagcccacggtggtacccaaccatccccaaggccaacctccaggctttcttattcctgtgtcctgaggctggatgtactaattttgtggaacctgttgctttggattcaattttgcaaacatccacagccttctggttatgtaatgtccagagtcagccctggccagttgcccttggctgcctaagcttggtcatgagaccagcttatgtcttcagacagccctggggagagaaaaatgggcaggggtggggaaccagcaagagcaacaacaacgcaaaaagcccactttgcaacctctggcagacagcgcgggaatgccaaagcatattagaccaaagcagaggttcagaaaacacacgaacctgcctggtctggaacaatcctcattacgagacactcggtggtcagcagagagctgagagggaaatagctgggaggcagcagttcctaagcctgcctggtttccttcctaccatcagggcctggagaccagggtgaccagaggcccttcctgtggacataatgtcccattcccccttgctggtgtcagaccagccacgggtggttgtttagagaccaaacaacacttgctagcctatcagcatcagacactcccactcccaggctggtgggcttagaagacacactcccactcccagactggtgggcttaggctttcggttcaccatccttcgcctgagctcatgaatcatggtgctgggaattagatgtaggatccctcgtcttacttctgacagaggcgcaaaggggaaatgacttactcagagtcaagcatttaactaagggcagatctgatccccaagctgaggcatcggaatttcttcccaatcctgtgttctttatatgactcccaaatctccctgccatcttaatcatcagtcaccatctcatgcctttcattcactctgaccctccatagagggtatcatgatccatagaactggtcagtgcccttctatccagagacaccactggaatctgcttgtctctaggtaccagcctgcaagtcagacaagatacaggctagaagtaatagtccgtccatccatcctctcgtgcttccttcccaccctctctctgtgcttagtactgtactatgaactggggatacaaagataacactgcttataattatgataagacttggcatcagttaacatttactgagcaattgcttagtgccaggcattctgctaggtctttgcatagatcagtacttatactaacactgtaaaatagataacaccttgtcctctgtttgacaggtgaggcaactgagacctgggaggtcatataactgttaagattatatggccacaaagtggcaaacctgagcaaaactacagggtctttgcctataaggagataatacagtatggagcagcaggctgattcatcattcctacccactttggggtatataaatgcccactccatatgtttttagttcccagggaacaaaaagaggtcagtttgggtttgttggtttatcatccagcagtgtagggctggacttgtaatatcctgcaaagggtgtatcagaaaaatctttgtaggagggaagagagagaggccagagaggcaagcctgcatgagttttggcactggtccctgggagactttgttctagcagattagacagtctaccctagagagtcagaaggggtgagcaagggcttccttagagcaggactaaaggaacttggagaacctgagactccgagccgccctgtctgacctctctcttctctcactgatggaaggcaggcagaccttctcccgtctgctaactctggagcctctgacccatctctcaggaacacttcagtacacagagacctgcgatatgtgtgtgtgtgtgagggagcagggtgttagaatgttgagagagcttattgcaatcccaaacttggaaattagctgggctgtggggtgaaggtgaaagtttccagaactggctgctctaagctgtggggaccttatctcccatcaggaccatgagaaaccgatccactgtgccaggagttattgtttatgtagcggagacatgctctccagctggctgcaggggacagaacgtgggggacattatgtcccagctggtcctgggagggtcccatggggagacccgctggtcatgtgctttgcatgtcctgactgtaggcagagcagacctccagggacttccttcctttagtggtttgtctaaccaaatgagcaatagcagggtctcgcctttgaagctctagctggaagcatctttgacccccagcccacagggaaccattcttcttgcaatgcccgtggttcttcctgccttaggactctcatccagccctctgcagagactggctccatttctacattctctgcctgtcctgctagacaaattgctgtatagagaaagatcatggccgtgatagctcggtcggtctgtaaataagaatttgtgggtttaaatgagtccgtgatgtacaccagcatccagaacagtgttgatctttggtaggcatgcaagacatagttggaatcattgaggcaactcatgctgtcaatgtagagtgaaggccagacatttcataagaaatatgcaaatgtccccagactcagaaacttcttttttactttatttgtcccttcactccaagggaagctaacatcttggaactttgtgtagatgctaccaagaagaagaagaggggcccagaggcatgcagaacccagctgaaaaagaacaacccacttatgtctgaagttctaaaccagctttaactactcttgttaagagctgaggaagggacttaggagaaaggggaccaaactcattcctcctctccttacgaatttcagtataacttgttctaagctaacttttattgaatgttgtgggctgactgctattctaagtcatttgcttctctcaaacaccctaagaagtgctttgacccattttacagatgaagaaactgagacccaaagaggttaagtaactttccaagtggcgaacacaggtggcagagaagattgaagattcaaactctggctgtcagcctccaaaacctgaatttaccactgatctccatggcattggtttggattagattacctttaacatcttttccaactctgagattctaggattctctgatgtcaggacattataaacctattataactctcctaaatttgtcaaaccaattctagatctctatgattacagacatgatacttttagaatcaatatttaaatcaaggtaggattattacacagaaaacacaactgagtagaatctacctttgccatgttgttcttttcagaattgaccctaaaacacagcgctatgtttgtcagagccagtcatttgtaatgtgtcagaatttcgactctaggcaagtgctaggagctaaaatgcaggttccttcaaacttccaagtagctgcggtgccaagctgatttcgatgagttgagttcttactgagcagttcaaatgaccagactgtaaccaggggcttcattctctcacccacgaagcactagggcagtcaaggggaaagactgacgcagaaggaatgaggttcccatgggctgggtccaaaagacctagagcgagtgcttagttgaaacatttgccaaaacctcaaggaacacccacacaaaaataagaagttgctcggcacagaagtcagggtaggggatgttcttcgaaggccacactccatggcaggcatacagcagcacgcttaaacatggttcctgttaaggctagagaggcaccattcacatagaagaagtcatcatcgtgactctacccaccccgcgcccccaccgcgtaattgaatgctgagtgtggacggcacttcttccagcacttggctgcgttaccgtgctcagttggcaagccttgggggagaagagaggttcagaaggaagaccatctgagtccatcagaacaatgtgtgcttttaacaaggcaggggcgcccaaactcagtaggtccaacagaccaagttatgctatgaaggtcttgtggaccacctacccccgccaaccagtcaccacttaaaagatgagaaaacgccagctcacaggccaaatgggaggcatttagaagagacaccaatgaagagatgtctggctttgtattaattactgtaggtaaattaataccaaatgccaggaagtaaagtagaggcattttcctattataaacccttgggacaagcccagagaccaccagcagtccagggcttgtgtacgctgagaactgaggggataacagaattgtgcaacaccttggtgccccaccgcccccgttaccaaatctcacagttcacagtatcgccttggcacactgggcttgtgtaatactcatggacttgacctggaatcacaaagcggactcagcttctgttacattcattcaccccagtgactctgggcacacactgtgcctctgaaggaggcacagtggccataaatggaaatagcatttgcctgcttctggggaccttggtcatagacttctgaggctttcctgggagccagtctaagataatgggtaagagtatggactctgaaggcagagtcctctgcttggaatcctagccctgccatttcccaactgtgtggccttaacaagctacttagcctgcctgtgactcaggctcctcatctataaaatgggcataatagttcctacctcatagggttgtcatggtgattcgtgggctaatattaaaggagatttctcaacctcagtaccattgacatttggggccggataattctttgttctgggggctgtcctgagtattatgggatgtttagcaacctccctaccctctacgaactgttgtgacaaccaaaattgtctccagacattgccacatgtcccaaatatttcctaggggggcaaaattgcctccagttgagaaccactgtattagattatgtcgtagatacaaatagccaaatatcagcaatttcacgtggttcaatctaacaattataaagtatttaacagttaaaactctttgaactttgtagatacatttatgtgcttcatctgggataaacgaacccaatgctttcaccagacgctcagaagaataaaaaacatggagaatttctagcttgaattcaacgttcaccagccaaatagaatttctataaagtggggtttgtaatacatccctcccagggctcttttaaggatactgcaaggagaatgtgagtgagaatgtttttgtgggctggaaagtgtcacagagatatcatgagaatgctggctgagttcacgggactcaggtcctaaggttgacaaagaaaaaggacctttgtcacagctacttctctggatttctgaaaaggtgctgggatgtcagacatgtgtagccgaaggagtgttgtggggcagttggaatggggggtatggctggctgcacaggaaggtttctctgggaaggcaccaacctggctagtcaagaggatcggtggcttcatctggggtgaagggggccctggggtgggtagatcagtgaccggccactggacagctgaataggggagcgagattccctcagatccaatgtcagcaagccttctgggtactgagactcctctcctgtgttcctcttattttattgatacataataaatggacatattttgagagtccatgtggtattttgatatattcaaaaatgtatagtaatcaaatcagggtaattgggatattcataaccttaaacatttatcgtttcttcatgctgggaacatctgaattatcctctactagctactttgagatatacaataagttattgtttactgtagtcattctactgattcaatgaacactgggtcttacttgttctgcgtactcgtatttttgtacccattaattatatctctttgccccaatccttattacctttcttgcctctggtaaccaccaatccactgtccatctttatgagatttactttcttagctcccacatgagtgagaacatggtgtatttgtctttctgtgcctggcttattccgcttagcaaaacgacctccagttccagctgcattgccacaaatgacaagatttcattcttttttctggatgaatcatattccattgggtatagataccaggttttgtctatccattcatctgttgatgggcacttaggttgatttcatatcttggctattgtgaatattgctgcagtcaacatgagagtgcagacccctcttccatattccgatttcctttcctttggatacatacccagcagtgggattagggatcatacgggtgtccaaactgggaaagaagaagtcatgatgttccttttgcccacagatgtaccgaggcttcaccaagatgccccatgtgcagtacatccatacggaagcttccgagagtctctgtggccttaagctggaggtcaacaagtaccagtacctgctgacaggtaatggccaactctagcttctaggccagggtttggccaaggtccactgtttcttgacttcagaagaacacatacggagtagttgactcaccaaatgtccagtaaattgtaaggagtctctaatgttgaattcatcccacttacccagtgctaggagcttgaggctcctacacttaggctggactttggaattagctccaccactcacctgggggaggaaatctcctaatttgtagcttctcaactttactgtaaataaaaagggagtatctgttcctctccacctcacactcgacctgttaggcccgtctttgaaagttattcatctttaggcagtcagtgtagtaaaggagaaaacaaaaacaaaaatcattataaagggagtgaagagttggcctctagtcctagctccagtatttaatgggcttgggacctttggcaaatcactttacctctccaagcctcattatcctcatctggaaaatggggctacagtccattttaaaaggtgttgggtagggtgaaataaaatcatgggtctgaaaagtacccagccacagtgcctgggctaagtgggaacatagtaggtgtgaattctctctgggctaggctctggacaaaacaacctctccttgttttcttctttcctcctgtaggtcgcgtctatgatggcaagatgtacacggggctgtgcaacttcgtggagaggtgggaccagctcaccctctcccagcgcaaggggctgaactatcggtatcacctgggttgtaactgcaaggtaagctctggggtcactgggggaaggaggggaggtgctgacttgcagccctagaaacatcagctcccaatgcactgggtgccaggccctcggctgggaagggtatgcatgtgttaggccagggcagaggggcaggtctgagcagatatagtaaggattgttgccccaggtggggcagtgaggaaggcagggaaggaagaatgcctttctgctgtaatcggctgcctccatgatgaccacttggaagctgctggggcatgagggctcttgagtccctggccccacctggcagttcaaggctggaggtataggatcctgacactggcaggttctcccaagtggtttcaagtgggctcaccctggtagctgactcatcgctaaccccaccccaggtaggcaaatgggcccaggactgcagagaccagatgctacagaaggtctctctttaccaggcccatccccctgacccaagtatagggccaaggtgcagcctgcctgctgtgggaggaagttgggccattctctcacttcatcttcaaaacagtcctgtgtggttttaattactatgatctccattctgcagatgagagctcagagaacttaagtaactagccctaggtcccacagttcactgaatctggtttccaacctagggcagctagactccaaagtttatgctctaacctttctaattcctcgattccctaaaacaactgagatctcccacctgagacgaaaaagtcctctcagtagtctaattctgctacttactggctgtgtgacctgcagcaagttacttaacctctcagagcctcctaaaactgtgataagaattaaagagaataatatcaaagcacttatcagaatgtctgttagacagcagatgctcaagctagtgctatttatattatgatcactgagggactgatgtggctaggcttcccatgcagtggccccagggtctgaatccaggctcggtagcctcaggcctgggcataccatggcagagtccatcaactgctgcctgttatctaattgcagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgtttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcac

SEQ ID NO: 35792 - DNA, 62226 bp, Homo sapiens; identical to SEQ ID NO: 35791

SEQ ID NO: 35793 - DNA, 62226 bp, Homo sapiens; identical to SEQ ID NO: 35791

SEQ ID NO: 35794 - DNA, 62226 bp, Homo sapiens; identical to SEQ ID NO: 35791

SEQ ID NO: 35795 - DNA, 197740 bp, Homo sapiens
ttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggtaagtttccattttcacagtttccccgcgccgcttcattgttcggactccggcgggtctgcccgtggctgaaggaggaagtgcgaggaggtgctcgccggccgcggttctcccgggcaggggcgggccgctcgcggtagttggtttcgcgtccctcagcacctcctgcccgggggaaggcgggagggtgagccgcagccgctcctgcgcccttccctgccgcgggctctgcggacgctgtcacggcacagcccgcgcacggcttggcagcccagcgggacccagggagaaacaggggggcgagaagagaaacaggtgcgtgcaagtgtactcacaacttaatgacctttgtcgggggaaggtgtgagtccctctgagtcgagcggcgcgcgggtcttcccggcggctcccgcatccctggccccggggctgccatcccgcccggttttcatctgggccaaatatgtgcacgcaaaggttaattctctgcttgctacccataaattacgcatgacatgtttagctgggctgccttatatggagagtgctgtatttcaggccagtttgccttttgccaagtttacagggcggaagacgccctgtaggagagggctgcctcctccttttcttcttcttcttttttttttcatcgttttgtagtgcgtcactcaaaaactgtaagaaaagtaagtatagaagctctttgggtggagccgcagttggttgaattgctttcatgaaaggttgaaaagaatgaaaagtagttagtacttgggttctggtttttagacaaaagcaggacaaatatgtagccaccccccaacttttttttttttttttaaacggagccggaatctgttattggtagtaatgtgtcatgtgagaatactttgattccagagcctgtaacacgagcaggtatatggtggcgcttatgccttcccctcgcacagcactttacaactacaggggtgttgctgccagagtaatattgtattcttaaggctctctggggccgggagagtatgcggctgttgggattctggggtgtatttccgtggagtatgtctccccaggattaaagttaagaagctgccggaaaggttgttgccgctgacttcactttgtgtgcccaccagcacaggcacaagtcatagcagatggatggcaaactctgccatatactctgaggagtttcttaaattaatacgctaggagagaagtcataattaatgcttttagactttcgagccctctgcagcgtgctttgaaatactacaccggtggacactatgtcccttcctcctgggtttgaacacagtgtctgtttatacacagagggtgtttagtacctaagtattctataccagcacaagagagccactccacagttatctctctgtgtggattcctaagtgtgttggtgtttctccttgctgttgagataaaatattatcacccagagagaaaatgaaagttcaacgactgtaaaatttatcccaggaatgtgcagttcaatacttagaatgtcttagatgtagttatagatagaggcactgaataagttattttgtagcctgagaatgcacatcgctgtcacttgtatcttgctttcttaaagttggtgacaactaaggctaaacttctttagaaaacctaatgttctagtttttatctgttttgtgtatttgcatgggagttactttattattattattatattgttaggtcttctttgaaaatgtaggcatagcttttttagtcttatttgtttaatggggggtttccttgctgaagactacaaaagttgccttttgtgttttaaggaacaggttgggtcagcaacagaaaacctgttcatctataattatagtgtcacttaagacataataatcagatttcattattactaagagactcagaaaaacctcacatatgcctagtttaatttttttccttatgtaactgtgaacaaatttgtgtgtagatacacatcaagtgtggtactctgcgcagtcatgccaaagagaaactgaagtgttatatggtttgagatattattgcttgtgtttacatttccacatttgaggcaaagttagactccaagttgaattcattaaattttgattccaacattctgttcttcctttgggcacagaattcctatgaaatgaaacactgggttttgttccagaacaagaacagactaacccaaaatttctcctgggggaaaaaaaaagagtaaaattatatttctcattgaaaattgtatttctcattgaggaagggtgtgttactttattatataaaatgccttatcttcattataagaaaaaaatgcccttgcatttgtcactgttgccatacattaggcctgtatttgatagatctatatggaaacagagaataaataatcttgctgcaccttctggctttctgcttggtgatagatgtgcggattagagaacatctcaggtcttggttaggagaagctgaaaagaataggtgattgggtttttaaaattctgtatgcaaaggcattagggtgggtagtagatatgagagtcaaaagagtggaggaaagaagtgaaataggttcacgaagtgattggcccaaaataaaatcccatcaaccatatggatcatagagaatgtgacatagaaagattttaaagtgtatggtttttttaggccaaaaagcttcatatgtttggaaatctagaatgtgctgtccagtacagtagccacatgtggctgttgagcacttgaaatgtgtcttgtccagattgagaagtgtaaaatactaccggttttgaaaactttatatgaggggaagaaagtaaaacatctgattaatatttttatatttatgatatgttttaatgataatttttgatatattggttctaatagaagatcttactagattaacttcacctgtttcttttctctctctctctctctctctctctctctctttcatggtgtctagaaaatataacaaatgtggctaacatcgtatttattttggacagtgttgttctaggataaagcaggaaaacaatattctgggagaaagcttaaagattttgctggtcaaaacaataaaattggcttattttattatacatagaaatacctcgtctttcttatccattgtaaccaaaatttgagaaaacacaccacctaacatctatttttatttcctcaaagctgctatttagtttagagatttgatggtgaggtagtaataatagagaaaaacttataattagagaatgagtcttaacacctctcaaaggccaaaatagagtatgattgttacttaggaacattttagagacactgtagttatcattgtcctgaagttaccaaacataaacgagtcactaaaattattttaaaatagagattttagtaaatagcaattatcttcaaatacttaatatgtgttttcttttgctagaactttctttagaaagttaaaaaaaaaaacccatatccaaagtcctgagcaaatgttaataaaagattgctgcattcataagaatgaaagatttttacctgcagataggagggtattgttttgaatattagcaaaggtgaaaatgtgtttctaacgtaacattatgggctctgaagaatttctatacatggagacactgtctttataatttgaacacattcttgagaaggcatctgactggtaaacaaagcacaatggcataggtcctggaaacattcctttcagatattttcataactgaagtacattttgccattcacagtgagtgttaagctgaaaaaaatgtggttcttttctagccatataaagtatgcttactattattttctcgaaggatgccaaaaaatgtaaaatggatgttgtggattcttcgtggggaggttagctagtttgtatatagagcctcaagaagagttgcctcagcttggtgccatcttgagtctgtcttccactagatgaggcatagcttccattagtgtcagtgcgtgtgtggagggtgaggggaagaatgatccccattaactttgtatattgtttctgatgagtcatggagcatattcactaatggttggagaattattgattgcaaggcagaggattcaagaagagctattggcatatggcattaactgtctctagacatattttttatttttaaatttgaggtagagaaatcggtttttacgtagtgtttttcatattataaaaaataaacgtttatataagcattacagatacatccttgaggaaaaaaatagtaaatacatggttatagttttctacatattaccagtttttttcataacagatccagaacatctctttcagataatcgttcatgtttttagagaggcatctcatcatatgtgcctgtgaaatctgtaaaaatatgtgtaacacacatcttgaaatatttgtgttaggagaattaagtcttacacatttggttctttttctactgtttttgattatgttctctaggttactatgattatcttttgttaaaacagttcaggaaatattaatctcaaaacgaaatgtagccatattggacagagtagagaattgcttttccacagagaccagttattccaaaaaggtgaagatgtttctgaaataatatcatgctcatatgctccaaaagaaaaaccatcatctcttttgacattcttttaggaaactgagagatgtatgttttatataccaaaagaggtgaataatagttgataaaggtatgcaaaatacatactcctgtgaagtgtgaacatacaatttgtatgtaacgcatgcatgagcatataactttccccaagacaatgccaatttattcaaatcacctgaatgttaaataatatcatactattaagaagaattgtggtaaatatgaaatctaaataccagtgatgatgtccatgctgatgtcaactccattccagtcctgctttagctaaattcacaaaatgaagagatgtctttctccaaagtagttttccaaaaatttgtatttgacactggattttttcctacgttttcacttttaaaagtttagaagctattaactaaaaatgaacttgttttagagagctaagaagattctagatttatggggacatttagttctatgaaataagcattacgttgctgacttgaaatattattctatcatataaagttgatttataagtgaatacatattgtgaaaaaataccacagtagacttagtgaaatctaccaaacttaatcaagatagatatacgttgtcctcaaaaaaataagaatctggtagggaaaataagagcttcgaaaataactataaagtagaaagtgatatttaataaacaatggctgggtaacatggtatgaaagttcagataagggaaagtcttaagataactctgacttgacccacatacatgtaataaagggaacagtccttaaatgcataaataatgggaacaaaaggtattcagtatttttcagccttagcaaaatattattctgttaacgcagtattctattcagcaatggttccatattttccatatgtttatagataacattcagatatcgaattttcatatatgttttaattcatttatttatttcttttatctaggagaaatataatggtttccaaatgtcctatactagattattgatagattttgtcattagttttactattgaataccatgaaatatcagctgttgcagccactaaatagttacaaactgttggtactacagtttactagtcaatccatggttatatgcttgtgctatgctaaatataaaggattcaagatgaggacttaagcagttcatatttgtatttagaatattatcaaagatattttcttaacttgtctcagtattagaatttacagcccattttcagcttattgtatccagaaatttcaatcatatccaataatttatcagcatttgttgatgacagtaaaagtgacacattagcattttatttgtttctgtgttgtttgattacaacagtgacattttagcactctttgtggacggataactcttctagtagaaagaaagcaggagggtggtcaagctaagtgacagatacaaagagttggaggacatagggctttctgtgggtaagaaatggatgagaaaagctttatgtcactgactaggcttgcaattcagtattcccctatcaaaggcccccttactgatgtttctgtttaccagatcttggtttcaagatgccaggttctgaagagatacaccacgagttcttataaacactatatctaaatttggtttgaaagtctaatgtttggctgtgtgcagtggctcacacctgtaatcccagcactttgggaggccgaggcaggcagatcacgaggtcaggagattgaggccgtcttggccaacatggtgaaaccccgtctctactaaaatacaaaaaattagctgggcatggtggcgcatgcctgtaatcccagttacttgggagctgaggcagggggattgcttgaactcgggaggcggaggttgcagtgagctgagatcatgccactgcactccagtctggcaacagagcaagactcttgtctcaaaaaaaaaaaaaaaaaaaaaaaaaaggctaatgtttataccaggcaggtagaaaaacaaaaacggacctcattagaggatacatgaggtttctaaaagtggaactcctttgtaaatgtaagaagtgatatcaatattattattattttaatatacttattttgaagtaactaagtttttttgtttatttcttgaaagaaacaatagattggggaaaaaccatttactcttttcatgccctagtttctaaatctgtgacattataaaggtgtaaatatttatgaaaatagtagaagttgccactggctgtattcttttaagtaaggtatctcatttaatcttttctactgtaaagtagccgtaaagtaataagacttttaccttaaagatcatgactagaacaattttttcatttgcggagatatgaggcttgtcatttttattattccaatgttcatgtttttaaccaatttttcttgtcttgcctccactgattatatataaagaatagcgatgagaatatagctgtaattatgattactaacatctttgaatactttctgtgtgctaagctaaggtttataattaattcatttattcctcagaacaaccctatggtataggtactgttaatattctgattttacagataggggaactgaagcacagacaagtccaattaattgtgcaaaggtacttaattaataagtagcacaataaggagttgaaccaaggtagcccagctttagaatccatgctcctgtgtaaaagaataaaaacagattttaaaaatacttattttggatgctgataggagcttgagaacataaacgtttggaatactttaaaagacttgtactttctacatcatttgaagagattccagaagaatgggcagaaagtaagaggatagagagaaaaggcctggggtgaggggtgggaagcattaataggataggaagaaatgaggaatcaggtgttcaagggagattggtgctacacttttgaggtcattgatgaccagctagtaagtttaataatacgtagtgtggaacataaacagacacttggtgtttagggtagtaaccttacaggagttgtgttttggtgacattttataggggtaggacacatatagaatgaagtagagattgtggttatacagaacagagatgagggactagatgaggggagtggccctagaatgaaaaggaggacatgtatgctgagagaaatgtgataaggttaggctgcataggatgtaccagctgactggatgtggatattaaaggcaatgggggtattaacaattatttttaaaatacagcaagaatttaaaaaacttttaatcaatcaaaaattccttatttaagaattatataaaatatcagtaagtgaaaaacatttaaaattgtattttatcagggattataacttaagtagaagatacatgttaatttcttaaaacatttcatttctgtgctaagctctttcaaagcactggatggtgatctaaaggtcaccaaattctttgtcccaaattggtaattttaaagtaaacataatttcaacgttaggcctattttgttatttgctgagaaatgtctcaatgtcaaccaggcagttctcctctcttattaaagtccatgctcagaatgcctgtgtaacctatccttagtgataaacaaggtggcagatagatacatgataaaacaagtttgccatgtgctcaatgtggctgacatttatacttctcagaccttgctattttagggaaggtatcagtataaccagggcattctttttcctggaactaaaaatccttaataatcagtcactattataaacagaatgatttacatacaggaatcaataaacagttgcttttggttaatggttatctggagtaggaggatagttatatttcaaatagaatagaaagctttattggaatacttacatgtctttttagtttgaggaccttacaagctttttacaaataaatggtttaaaatagtttaaacagaaaatgtcagaacattgatagattatgttttatttaatatacagagaaaaattcccatgaaataaagacagttttcaagaaaaatattctatttataaatatttacaacttattagttatttagattgcccgtgtccataaaaataatacagaaattacactatttatgtctttaaatatagcatgtttctataaactagagaataatgttgacagtattttattttgcctttgttagtattatgtgaaagtcacacttattacatgcctttttctattattagactttttttcctatctagtttttgccttgtgctatacagtatggtgaaaatctatttagctatgtcattaagataatgcttagaaaatgctaatttttaagtaactaagattaagtagtattggatattctttgccttctttattattctgtcattgggctaattttaactagacaaatttattccaaagtattttgagccattatttgaacttcattgctgtaacattcaggaaaaactgcattgtctacctagtggcattcagataaggcatttggtcttaggtacctcttccaaaagacttttaagaggtttgataagcatagcaaaagtgaacgacggaggatacaagaaaatctttgatccaggagtagtctctctgaagcattgcatgacctttccaaaaaataatttgagaagtgcctaacaatagaaaaatatatattttttccttcaataggaaagactttagaaaaaatatactcaagtagaattctgcataatgctttctgggggaccacatttgctgaaaattgcctacgggaaatgactttctcagagtgatatagttttgaggactgagattttaaaagtaaatattttattgggagcaattaatttaggaagaatagtattatgcctattcctctgtagttgattaaagtttactaagtgctgaggtcttttcccttaaaacattactttgccatgttaacaatcaggtcatagaggaatgaattcatcttttgtgttttgctaaataatcagttaacaaacatattctgagcacgtttaaagtcaaaggattgtagtaggtcacaagagggagatcgaaagtataattacatagtgtctttccttctttgacatacaattgggttgaggagaaagacttgaaaacttaatgcaaggcactatacaagttagtaccaaaggaggaaactgaaagagggaaggaaattcaaagaaggaagtttttgtggaactgaatggcaagggaatgctgtggggaagagggggcatctgtcataggcccaaagattaagcactcttttcggaatatggagtgacatagtaagaataaggtggaagtagtgatgaaagctaccatatttgagcagcgtcttttctatgtgaggccttgctagcttatgttgtttttggaaaaaaacagatagacaacctggtagtgatagtagacaatgaatgaattgggccggtgagtcaggaatcatcatcctcttagaggacacagacttagagaaattatcttatttgcctaaatccacatagctggtgatcagccgaactgaacagaagccaggtcttttcatacttcaaaaccagcattccccaaccccatccctccccatcccatgattctgttgggaatgagtgtggcatgtttatgacatagtaattttaaaacttcacccatacaacaactgacataagtcaagaagatagaaattttatttaaaaggctgtcaaatgtattttcatcttttttgctttgatgatgggttacaaatagcgtatcgtttgacaaatgcttatactctgtttcttggatttgtaaaaaaaataaaacaaactaggcctcccatcttcagtagatatggtatggagttgcagtatcatgatgttgtaacagtgcatttcgcagtaggtagacccatttgggattccctcagaggaagcttgtgaagtttgaagataatgtactttctcaccaatagtatgaggctataaaattttcaccaagaaatgataggggcaaaagtttatagatcatggttgtttgattattttatgcttttatgttacatcatctaatttatacatcagtctctgctctctgtaactttacatgtgatgtagcctgtgactttaaaagataagctgttaattgtagagttgtgctgttggagacctgtcactttgctaacaaattcctctcttcatagagctatttagaacatatggcaaataaaattatgtgattatgtgtttttagagaaaaatttatttatataaaatgaaagtctttgcttttggctgcaaaagaaagcatccttaatagcaaatattgattgcagtgccagtgtgccatgtatcatgctataccctttggaggaaaaagaggtaagatgtgcctgttctcaaagtaatttccagtatagtgatagaaatattcacaaataatggacgggcaaaacaaagtgggcacaaagaagccaagaataagctgtttgtgggcagagtgtggaatttgcctaaaaccattcggtagacaggttaactctttagatactttgtatatattggagaagagacaaaatcaactcataatttattaaaatgatgtgatttgatatgtacaccatttagtttttctgttcaagtatttggtaaataagtgtgatgccagcatagtatcatcctggactagacagaagaaattaatttatttctgatgctggcagttttggagaaaggtgggcacatacggttcatctgaatcttcctcatgctaaattcttgattggaagcaggttaaaacactcaggttaacgtttatgttaacagaaaagaaaaatcagtcagagagaggtgcgttgtatttaacattaatgacagagaattttaaatatgcacatgattctctttttcctccagcttttctttctgcacaggaaataaagctgtattttgtaggccagcttccagactttgaaatggtgaaagtgcaactgtgcatattcttctataagaccccattcagctgtgacgtgttgttgtttccaagatttaatctgcattctagtttagaaaattcaggattttattgcttattattattcatttttattcataaatatttgtttaaagcccattacatataaagttttactataagattttaattgaaatttttaagacaaattaagaatatggtttctgattttctgaagtttatggcctatagaaaaaggtccattcataagtgaaataataaaagcaaaacaacaaaagactcgagctttagccattctagtaattattaaaatagctactttcttcgtaggaacttattattttacatgtgtgatcccatagctcttacacaattctgtgtgatttaggcattgctatctttctggctcccaagtgagaagattgaggcttggaaagattaaggttaggggatttgctcaagggtcatatgataaggtactactgtgagagctgagatctcaacccaggagttttgctgtttttctgcttgtttatttccatcagtatggtatgaattaggcacacaaatactcattgcatgtagatttgggacctactccaagttaattctggaaagactcagtgaagaagataagatgtggaagaggttttttttaagcattatggtcatgaaagagcagactatggaatggactttgaagtttcactagctttgaaaggaggggtatatcaaatggcctaatctgcctgtgtggtttgctcagtattagttctactcatacctaataccctctgccccagcactcgccaagatcagcaaaatctacttttagactcaaaatcattaccacctgtgaagtttctgatgtcgcttctgagtgacatagcactctgtcaattgctctgttggatggctttgctgaatggcaccttttaagaagtgccttgagccccaaaagagtttcaaatgctcttgtaatctattcagctgcattattgaagatattagggtaattcaattcattttttcatcactaaaacatagaaatctgttgccaacattaaaatagacaaacatatcattgaaaatttaatagctctacattcacttggagatttccgataaacttttctcactttcccccaaatccttaataattagagcatgtccatgtgtgtatgtgtgcatgtttttgtgtcatatccctatgtgtctatatatatattccataaatgattgtgaagtggtacacaagttgtagctaaaaatgaaatagaataaatgtatgaagctaagggatccattctccaactaatgcgttagttgacaaatttgctctgaaatattgataccattttgtgattccctgtattgaatacaagtatgggcttgtgaaaatatagtatccacagaccctaattagaaacaaaataaaggtattctaatatacctatgcaaatttaaagttttaacttattcatataacagttttcagcttgtcagtgacctgatatcaatggatttgaaaatgattttacctttaagtaccaagaattcttagggacatgtgtgtgtgtgtgtattcagattaaagattccatgctaatatactaattttttggcaagaaaattaagcacctgtatttcagtttaatagtactgtggtaaatgaaatatattaaacatgcagattctgttacattcacctaatattaatttgaatttttaatattctaggcactgtgctagatattgaatacataatggtaaacataaacagatagtaaacagttataaaatttagacatctctcaattttcaaattggccattgcagaaatagtgacattttattaggttttgttgccacaagattttcaataattaaaaaaaaattatttatagatgccagtaaatatttattttacagcatctagatgccagtaaatatttattttacagcatctaccaatgttagatttactatgcacgaaggaaggattttattttcatgtaaagaaaaatgccattttatgcttagaatcaatgctttacaattaaacaagagaaatagcatcacaaaataatacgggaagagaaaactcattttgagtagcagcaaaatattgtgagtttaaaaggtcaggccagtacaggaggctccagttttgccactcactatgcagaatgctgtgacagccagggctgatacagctgaaaatatctgcagctttggaagccttgtaagtttcagaaggtcattttggcatcatgataggagcacagattcacatggaaggtcaaactggacagccaggcaggaagataggttgctgaacccagtgcttgtagattttagagcaatcaccaactgcagtaactgagttttttaattcaatgcagccatctttcattgtaatgtttattggggaatgagctttacttggtggggaaattataaattaccttctctcttctgaaacctaagtgttgcatctacaactttccctggtatcaagacaaatgttactttaattttatttacgtgtgatatataccccatcaagcttacaaaagtaaagtgcacatcagataggactgttgttgttgttggtggtggtgtttttaatcaattagaaggcaaagaaatgaaacaagtacttatgatgaaattgagcactaaatttatctctcagcttcctggcaactgaagcagaagctttaggaagtgaaaaagtcctgagtttatttaataagatttcttcagatcccatacactgtcttattcttagccctttgggtgtttagttaaatatactgactctgcccttgggtgaagtcttgaatgggtgaattccaattactaaaaaagtgaaggctgaattctttagcctgcctttaaggcccttactgatttggcttcagcccaaagttccagggtcatcttctgccagccccattacatacaggtgttccatacagaccagttcttccagtgttgatatgcagtgctttcccacatccctgccattactgtctggatttctacagtttggatttctactcctttttgtctctaaccaaatgaaacttgtccttccagaccaaccttccatttcttatcccttttgaaactaaccttgacctctctctttaacttaccaagctttcttgttacctctactgtgtacttctcgcttccttttttatatatagttatttgtgtgttagttttatacctttaattaaacatcaaattcttaaaggctggatccaagtattctcgctatatctaggctacatataaaaggtggtcaatacacagttaatataatcaatacacatattttatgtgtattatatattgttaatgaatatattcatttaataaagttactgttgaatgtatttgaatttcttgaaggaaaacatttcttttcctaggatagtagggaacaaagaaagaaaacctaaaaaaagaagcacaattagagaaacacactcctgtaatttttctcaaaggaaatattttgagacagcagaaccaagattataattttttttaattgttttgactttgggttttctttttataagtcagcttaatatttgtgatttctctgtgccaaaaagtaaccaatattaatagagaacagctttagtacatgtaaaagaaaaaaatcctttatgtcatttcaaaccctcagtgctttctttctgacagatttttaatggttttatcagctgttaattaggttggtgcaaaagtaattgcagttttaaaaaaagatcgcaaaaactgaaattacttttgcaccaccctgataaaaaattggcctgactatattgctttgaaatgtttcagacagtattctgtctccttcattgctcttcagatactgttttagcagtttatctagatcagtcttactgtgtgcatagtcagcatacatcagttttatacttttaaagcggcattgcattttacctacgtggaagttttctgcagacatattttaagcttctctaagaaaagctctgaagaaaatgtaggctcctgttgctcggagggctgatgaataaatttaaaaaaatcatgctcaaagaccacttccttgacaattaatctttcaaaatcagctacggagtatctagaacttcataatctattcaaaattgattaacaatcttaattgagaagacatttgtatctgaagtgtagaattttcttgtctccaggtatacattattaatgtttagtgtctaccccatggacataaaagagcaatagcatccgttctcagctctgtaaaagagaccatcttatcttctctagaatcaatattcaggggtttctccttcacttacacacacctcactctgagctaaccacaagcaatgcagtagtggtacctccaataaatcccactcaccccctatctctctcccttcttttggcttctgttgtatatattagtagtcattgtcatttctaccaagtttggtattaaattgctagcatgtatcgtgtatcgtgaatgaagttttacatttgaaatcagaagagctgatttggagttctggttcttccatttatttagcatagggattttaatgggtcagtcacttaaccatgcaagcctcgcctcaatttatttgttcacaaatgagcaaaataatataaccaaccatctcttagagttgtgaggaacaaatagtaattaggatgaaaataaattgtatgtcaacatataaaatattatttgctatttttgaataatagaatgtataagttgttgggaaagtaaatttctatgcttggcttcttcagtggaaactttttttttttcaatttttttttttttttttgagacagggtctccctctgttgcccaggctggagtgcagtggcatgatctcatcttactgtggcctcccgggctcaaacaatcctcctgcctcagccttccaagtagcttgtactgcaggcatgcaccaccatgcctggctaatttttgtattttctgtagagacggaggtctcactgtgttgttcaggctggtctcgaactcttgggctcaagcagtactcccgccttggtctctcaaagtgctgcgattataggtatgagccactgtgtccatcctgaaacttttttttttttaattaaagaaccaaatgaacaccttgcagattttatgtataagccagaaagaaagctcagtacatgtatagaatgtagcacaagccaacttttcaaaaattaatctttttaaggggcattatgtaatgaaggagcatacatttttagttttatccaggataaaagtggttctttttcccccattaactttaacacagaggttttactttaatttaaattccaaggactaggtttttgttgtatatgaagaaaacgatttgactaaatccaatgtaaatgtttttccttattctttgggggcacacacatacacacattaatccttattttatattttatttataatacaaatatttaattatattttatttataatacaaatatttaattatattttatttataatataaatatttatattttatttataatataaatatttaattatattttatttataatataaatatttatattttatttataatataaatatttatattttatttataatataaatatattttatttataatataaatatattttatttataatataaatatttatattttatttataatataaatatattttatttataatataaatatttatattttatttataatataaatatttaattatattttataggttgaataggttccttgtttatcttttttgcaaaataattttattgttataaattgttcttattataagcaataaataaggaacctaaatatcacaatctgtaaagcattttatttgtgtgtgattttatatgatagttcattagacattagataggaaagtatggaaagttttgagattgctacatgattgctcttttaatttgtccaatgtattcctttaaatgttgtgagggatttttttaccagtgaagtagcttttgcatgctaagttgtagtgaactgctgggcagaactaaaacataaatggtttgaggcatgattaatagttgtatatggtggccgggcgtggtggctcatgcctgtaatcccagcactttgggaggccgaggcgggtggctcacgaggtcaggagattgagaccatcctggctaacatggtgaaaccccgtctctactgaaaatacaaaaagtagccgggtgtggtggtgggtgcctgtagtcccagctactcaggaggctgaggcaggagaatggcatgaacccaggtggagcttgcagtgagccgagatcacaccactgcactccagcgtgggtgacagtgtgagactccgtctcaaaaaaaaaaaaaaatggttgtatatggtgtagtatcttagagtgatgtgcagtggcatgcatgatttaaaataatattaataatcataacagagcttttttgtaacattttataagcatactaccttgctgaagtagtcgatggaatataatcaaagattgtgtcaccaaatctttaaacaggacattttatcagagaagatactctggtttcttaggtaaagttatagggtagaaacacagtaagcagtctctggtaagaataatattttagccttgattgattatggttgccaaaatttaatggaattaaaaataacctgggaaaacatagattcctggtttctatcctcagtaggtctagggtaggtcccaggaacggtatatatttttaatagttacccacgagtcactgattcagataatccaataatctttctggagcatcagtatcccagagaaacaaatgttgccgttaataaacaatttgcagttatttcagtttattagctagctacgattgcattctgatttgctgtggaaagctggtcattactttttaagagcatatgatgctgatggaaacatgtagagctttaatcgctgtctcattaaaaggatgtagtttattctttgtgtttccttatttgttacagcttttccagaatgcacagaaccttatgtgcaattaaaataattaagaaaaagatattgttttctatttagcaaaggaactaaatctcatgctcccttatagtttctgttcaatatgcattctcttttgaaagtacaaatttgtaataatacaatttttgatctcgtctcccaagaagcctaactttatttatactctgactacacggtaaaatcacattgtcaaaataaaagcgttggtaatgctcacattctgccaaccaaccatatttgaagtcttttaaaaattcactttcaggtactttattctgtagactgttatttaataactaagaaagagagtttgaggaggacaaagtgagggcggaatgtttttattttccaagaggacatacatgcaaaggcataatcatataagagtatatacctatcttggttattttaattagaagtgcatgctgcttcagggagactccccactcctgactcaggaatgactgcgagtggaacccccgcctcagggaaaattactacatgggaaaatatgcttgggcctacatgagttttccagagttctcttgtaccttagctagtttgataatgctttgcattatgtatagcagttgtcagaaaccatttcctttaatcagttagcatccaaaaaaggaaggggtagcagatattttctgacatttgtagatataatgtattaaaaaaagcattaccttactcttatgacatagtgttgtcagagatttcccaaatacaacatgccctgcagattcttaaaactacacattttccttttgttaataagaaaataacagtaaagtatttattgtctattttgataccctgtcaacccaaacatgtattccaaattccagcctctgtttctttgtaaataattacaaaatgcaaatactatgattgttttaggaatgaaatgccatgttttgatgcaacaggagttgaaaaactgattttacaaatgtttccattgattagctgctatatgagggctaacagttgaaaatattttggaaaaatacaaaaacaggctttcatttctatttatagaaaaacagacatactttttttgcatgttcccacaagagaaatttacagtgtagataaagtacagcataggcttaacaaatatagaaaaatatgttattgactcttggtggaagtacatattcgtaaaggttttcttaaagttttttattctagttcaaagttaatacatatatgaatacacttcatgttctaaggatttatattattaaaatcactcataagcatagctttttatatgcaatttcagcattgattaaaagagtgaaaaatgggcattaacttagttgactactgataacaaaatggacatatagtggagtaatatataattgttaaaaagtaattatattgatctgtttctattgacatagaaagatcattaatatattttatattgtggaatattaacataatttgttgtttaatctctggacctagttagatatgtgaattatgtgaaaccttcttccaaggatatttaagttacattgaagtgaaaataggagttgtcaatgcatgtctttgttttgtggcgtatcttagtcttttaaaccagggaaaaacaactgggtcttgagtcagtgttagtcagtgaaaacattattcttgtttgtgagcatatgtgaatttgttatttttttgaaaaaaagtcaagttaaactgatatatcttgttatgaagaatatatattattatgaggaatatattcagttaacattggtatattttttaaaagtatgtttgagattatttgttaaaaagtaatccttaaggtcagttgtataagtcaatagaaatatccataggattgtaatgttaaagtgtgtagcacctatgtggcttgagtatttgtaagtttggaataagaaatatgttagtgaaataatagggacttttactgattatatggaatggaggaaatatttgtgtattacgttgtgtcatgagaagttcactaatttgtttttttaggatacattcgagcaattccatactcattcgtcattggttttagtcattgtattctgaaaaataattattttggtctttttatttaattataggcatagatttttctatactttttttcataatgattaatagttaaatcacatattttgggccatattcaatataaataagctaatacaattttcctgattgaggttatcacaccaggtttaaaatcagacatttggaaattcaaattctatttgttaagataaagcttctgtggtcagatttagtgggtagtactgagggcaattatcacattaaatttttagaaattctgaacagtgtggcaactattaagtttgatcctaatgagatatgctttatattttgggcaggtttttttttaaattatatctgtcatttttttcacatgttgattttgtaatttatcctacttgagtctgctaaaataggaaaaaaataggttaattatggagaagatcttataactattggttgtgagaatgatttctgtgtgagagggaaagttggaatagaggggcaaagaggtacaaaatgcagcagatttcaccaatgtatgaggtgctgtggaaatattttcttagttctgtgatcaattaacttcatacttatttttgtgttgtgcaataatgtcattagggatgcacagatgaatttgctaccattatttaagcagtgaacatcatattttaaatgttttaggcagaggtgccaccaacctcagcaagaagcttggtgatgttcagaagatatagaggttaaatatgaaaactatgattttggcccttagttactgtatcaaataaaataatactcatttaagtaagctttaggatcaaagtctataatcaggacattgtaacgggaataacagtattactgtgtgttgcatttcatttagcgttcacatttttgttgtgttagttctacattgacagattcgggttgggtcactgtaccattcttcctgaaaattgccaagatgatgagatttgatttttctaccatttagctcttgagcacataacagcattttaacttttgctgtagtctgtgttctgattccctatttactattttgaaatattaaatgatatggacagatcagatatgtctacctgaggctaacaagatgatgtctttgtgtaatatataggtaaataaaacactaattaggagtagtgctttctcttgtagaacaattaagtagcattcacagttttatctcattataccttcttgtagaaggaaatgttaaaatacttcctctttgaatagcatcagaaaaaatgcagtgtttcttttgctggaattgaagactggttctgtcagaatttcacagataattatttaaatattttaaatttgcaaagccacataaatctgtttcgaatattccatggctcaaaatatctttcttcaacttcataatcaaggaggtatttaaatatgttgctattttaacttcatcgcctcatgttctctttccaatgagtgacgtttgatgctggtttcattcacttataaaggtgacatccccaatatactaaaccatatagcttaagcattgtaatttgtcgaaaatacaaactagtctgatatactaagaaaaatcttcagttataccacaaatattaattgttcgtttcctctgggccaggcattgttttggtgatctgtttctattaatggagaactagtgtaaccactgccttctctcatggagcttacatttttgtggcaaaggcaaatgataagcagatagcgagataagcgtgtaatattactctgctttcttcacagtactatgtagtattagatggggtttttttgtttgttttgttttttagacgaggtctcactctgttacctaggctagagtgtagtggcttagtcatagcttactgcagtcttgaactcctgggctcaagcagtactcccatttcagcctcccaagttgctgggaccacaagcacatgccatgccatcatgtgtggctaatttttaaaaatttgttttctgtagagatggggtctcactgtgttgctcaggctggaagtgtaatgttatgtacttctctcaaaacgagtctggactgctgttgggaggaacagaaggttgggtgctttggatggtggcctgaaaatcttctaagaagataactttgcagtagggacttggacgaaggcctattggggtatagagctagtatgcaaagtgcagtgattcattgtgataattatcttctagtgagcttaaaccttttacatttttaaaaattttgcctgatacaggaattaattcaaaattcacttttaaatcattgtctgtatagaagctttatgttctgttttgtcctaaatatgaatacttaaggatcaacaatcattttctaattggaatacagtttagttgccactggaattctaatctttggcagtagtgtgtcacctaaccgacactccttcattatccttcctacagtagaccactaggtgatttagggaaccaaactgttgaatggatcagaattctaaaagactgcttcgacagagcttagattacttatttgcgttagtaaacacaatcttcctttcttggcagcagctagtctgaaatgtggcagaccagcaggccacattggcagtctctatgccattccagaggatgtgtgattgaaagttatctttttctttgcagtattgttaaaacttagtcatttacatatctccttcatgattttcatttatgtgtagtctcttaggtatatttgtgtgtatatgtatctattctttaaatcttttttaaaaatttatttaattaatacttttttttttttcagacagggtcttactctgttgcccaggttggagtgcagtggtgtgatcatggcttactgcagccttgacatcctgtgctcaagcaatcctcctgcctcagcctcctgagtaattgggactacaggcatttgtcaccctgcctggctaatttttgtattttttgtagatatagggtcctactatgttgttcaggctggtctcgaacacctggcctcaagcagtcctccacttcagcctcccaaagtgttggattacaggcgtgagccacggtgcccggccctttaaatttgtaaattaaactttaatttcttcctaagttataatattgatgtaatcacagaccggacacactagttttagcattctaatccatctgttaaaattatgttgtttgtgcatcacctgaaattgccatgggtactgctggtagtgtgcttacccctcactgagaaatacttacctctgctttttgctatgtggagttgaatagtgctgaaggctgcattaactcgttcagatggcagttcttcccatataatgtataacatctttgttactctacttagcaccttagtgaatacagagatggctgtacagcctccagaaatgctaagttggttggttgtatatggaaatctctgttaatatttgggacaaaccctgggaataattgtgtgagcaaacttagtttactaaagaactgcattgctaattatggacttgttgacaccagtgagccaggggaagaagttgtggttttgggcaaggggttctttcttatcaactccaaacttacagggtgaagttagccatctctttcagttagattgaaactatcttaataaacaaaaatcataataaacgacctcaaaaaattacttagttaacttcctcagtatataacttatatcaacattaaaagcatattaaataaaattcttcaaaattaccagctaactactctgggatataactggactgattgcctatatttgctttagaagaacttttgcaatgattagtaaacatatgtgagcaagaaatttaaccttgctcatagaggccatccagttctccaaaagagaatttcattttcataccttgtaagcatctctttatcttctatagcagtaggtatgtgactcttaaataggcattcatatgaagccatatatatatatatgtaatttttaagaataattgttgaaagaataagaataatttcattcttctttatccttttctcggtttttattatctctgtcatttcaaattttatttctttcctttttattttctcccttatatttatcttaaagtagaatatatacatgatttctgatatcattcaaaaagaaattggttcttgtggcagaatattagtgttgtagatgatgtcagataaagcaagaaactatagcgtttggaatgtgatcagtaggttaaagagggactgctgttacctattattcagattttaaagtttgattctttttttttttttttttttttttgaggcagagtctcgctcggtcacccaggctggagtgcagtggtgtgatctcggctcactgcaagctctgcctcccaggttcacgccattctcctgcctcaccctcccgagtagctggggctacaggtgcccgccactatgcccagctaattttttgtattttttagtagagatggggtttcaccgtgttagccaggatgatcttgatctcctgacctcgtgatctgcctgcctcggcctcccaaagtgctgggattacaggcgtgagccaccgtgcccggccttaagtttgattcttacaatatttttgttgttcagagaagtttattataatgtattgaaatataggtcagatatttacctcagaagcaatgtacccattagtagaaatctttcctttaataattatttacagacaaaatttattttaggccaaatatgtttgcaagaattctcataatctggacattacccacatatctttaaacattatatctatctgtagaacaaaaccccattacttagttaatgttttgtgaattcagtattgatccaaattctataaaatcttaatttaccaaaagagatttctattttttgaaattctttttttaatatagagaaggaatataaaacaataatctgatatcagcagtttagtgaaattgatctataggatataatttgagtttgttacccacagtgccctatatcaagggcaggcacatacattatcaggtctagctagactaatgcataatggccagtatctattttaattgttcagtgtctatgcctgaactaattattaatactttgattatcatccttgtctatgtcctttacaattaaatggtacaaatctatgttgataatgctttcagtagcacttttgaagtaaatagaatttctctgctacagaaaataaatataatcagaacactgatttgcaagcattttagtaatcaaagtatattttgtacttgagggattgtctgtaacctggcaaaaaggaaaaataatcaactctagaaattaatttttagttgtatttagatatgactaccaagcaatgcagatatttcttggggtaccagtcttcttacatatattgtctggatgccatagatcatgatattaaataatctatttcatcagtgttgggaccacatcctcccatacatgtttatttctgtaagtgtgaatgaagtttactcatttatcaaacattttaaaaaaagatctgttatgttccaagaactgtgtgatggaagacactggacctacaccctgttgtcagggcatatataacattgagggggagaggtacgaagagctacaaagtaccagaaacattctgagatggagtaatgtttagcatagttgacccagtcctatagagaaggtgatttttgaacagcaatttaaacaaggagaaggaatttgccaagttgcaggggtgaggaagtgtgtgtcaaaccaaacagggagttagcatgtaacaagtcccaggagctcacacatgtcttggcacctgccaagaaccctcagcaactcctctccaggggagatacaagaggtacagcactgagagaagcaacaagataaaatgtatcagtttgttaaaagggaaaggttcaagaaagagggagttgtaaatcatgttacaggtcaagtaaaggcaagaacaaaacatagtctttggacttggctttcctgacagcattgatgaactttgctgagcagtaaagtaatgggtgtgaaagtcagactgataaggattcagaagtgaatgggaaaggaagaagcagaaaaacagcacggtagatgactctttagatatttgcttgggaaggatggattaagtgcattagggagaggaggatgctagccagggcagggtcctcttcctcctgccatgtcaccgtctgcatgttggagtttcttcagcacatttggaagctaagagaaggaactgctgaaagacagggcgtgcatgtatagaggaggcagaaaaagaactagatcttgagaatgactgagtcaaggtggaggcttgtggaagcttaactgtgggcaggaggagggagaactgggagaccaagaaagatacagaaagataggttaaagacttgtgagtaggaaggtaagaaaaagttcatgcttaagggctactgttatggctatgaaatattcgtgacgcataatattattatccactattgctaatgaacatggagaaagagtaatgaagttttagaaaggctgccgtgtgcaatgagatagggagctgtccaaggacagggctagattgtgaggcagtgaaagggcctatgtgaccctggaacataataatttatagaggcaatgattgtgtgtgtgtgtgtgtgtgtgtgtgtgttttcaaatgtatgtttcagtgtgttcatgtgttgtattcatatatgtgttcatgtgtgtgtgtttgtatattttgtaccctagaagtaatccaaatcctgatgcagcagttgataatttagtttaccaatatttttggaactccatctattttgcatcattatggctaagccatggggttactgagatgaataatatattttttctgtccttaaaaacatatggtctagtgggtcagatatataaggaaataaaacactgtatagggcataggtgcagagataattcagagaaggcagtattacgatatggatggatagagatggggataatgacatcttggtagctttttggaggaagtaacatcttagctggctttagaggaagaaaatagttacatgtgaggcacttgaagattctgaagagaaggagtaaagacattgttgaccatgcaggtggtccattctcaaggcatgaaatcattgagtaattcttaatgcagaacaaagtttcaggaagatagacacagcttacagtttatgactggacctttgttttttttttttttttttttatagaaactggcattaagacctaggaacttttttgaaaaccaaaatatttcttgaacactggggatgaggtttttttttttttttttttgatggagtctcacactgtcttccggcctggagtgcagtggcgcaatctcggctcactgcaacattcacctcccaggttctaagtgattccaggagaatcacccagcctcccaaggagctgggattacaggtgcctgccaccatgcccggctaattttttgtatttcagtatttttagagacagggttttgccatgttgaccaggttggtctcgaacacctgacctcgtgatctgcctgcctcggcctcccaaagtgctgggattacaggtatgagccactgtgcccagccatgggttttttaaattttttttagacagagtcttgctctgtcacccaagctggagtgcagtggtgcaatctcagctcactgcagcttccgcctcccgggttcaagtgattcttctgcctcagcctcctgagtagctgggattataggtgccaccaccacgcccagctaatttttgtatttttaatagatatggggttttaccatgttggccaggctggtcttgaactcctgaccttgtgatccacccacctcagcctcccaaagtgcggggattacaggcgtgatccaccaagcttgattgattttttaaatctctatcaaaagttgtagtcgtactgtagtattttccaaatagttttggaaagtagttttttaaacgaaatttagtgttaaaatggcaatattaatcttaaacaatttaagttctagatgttcgtgttttttaatgtacgtatgtatttatatcctatactctagtttccaaaaattataaatataccatatgccaatagagcaattttggctcatgaagaagtatcatcaaatactagttatcatactgtgtcattgcctctttaaaatgtgaaaattttactttttaaagccttgttttcctcattggcaacattcaaacaaaaaataaagaagaaaaatcctgatagaaaaagtaagttgttaaaagtaaaaatgccctgctctaagaagtagtcttgtggtgctgagttaactgatcatcaggcaacaggggatccctcatcccccaccctccagctttgtttggaattgtacttctgaagtgcatcacgctgctcaaatcaaattgctcacttaatatttaatgtttctgcgatggaatcactttctcccttgaggttgacttcagatttaccagacacactgacaacactgtactccttattttccccacatgacctcagcttctgctttaaaaatgtacgaataaaggatgcttttgttcatatcttgcctgcctgtgatatattgacaaagtgtctgcgggctcaatggaatagttttacagtatgagtgctgttttcagtggaggggcaggacttgggctttagaaggaagtgaattggataggtcaggagaatgtaccatttgtaaacacccctttccttttttattcacgtgtcaggacagcaggagcaggctgttcagtgcccgtccctgcgcagagccggagggaaagcagcttggaagtcagctgcaatttttaaaccttgctttttattccctggtaatgatcttcaagtgcttagacttgtctgagaagctgttttgaaactaacatggtttagtccactaactgcatgttgggtaaattcaaaacccacatgctcgtcctcttgcagtggaataagtcacatctgatggacattttctgtgcttatagcatagtaatgaacgtctgacaggcgcgacctttcataagacaacccacactattggctttctgcccagaatattgctgcaacactatctgtgattggttatctctctatcatgcattgcttcacaaggggaaacggcccctttttttaataaatctacgatggctggctgcaatatgcctcactgtaagtattttgtgtatgtatgtgtgggagagagagagagaggctgacttgaatattacttagtctggtatcacatggcaaggttgtgatactgtaggacatcagtgaagtgctacttagtaaatcttaacctatctcttttttctacaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaagtgagtaactattatattcttttaaggatattcaatgattgaatgaggggtatatggacatacagttctctgcatatgggattatggattgctttgttcatagtttagttatacagtgtgttgatgatgttgggctggggaactttacgagaagcagtagaatcaagtctggccaaactttgttatgaataactttatcagtcctttcactgcatgtttttttttgctagggcagaaagtgttgacatatttttcacttagtaatggcaaagtgtctgtctgtccctggaaatggtaaatgtagctacctgtgagtgtttagcatatgcatatattatatataaggccatggcaatagctgaatgaggatgatttttatttgttggtaaaggcattgtacagttgcaaaagagaagcagatttaaaatcagctaaacttggatagactttttactcttttaatattttgacattttagattttctttttattttgtgggcattttattttcaggccagagccacgcattttatggaaaatgtaactagaagtaaggtgctgaactgctgctacagcaccttacctgaggcacaaactttgttgcatgtgagttatataaataagtagaaactcataagtactattgtttattggatttttccagcttcaaaaattctaatgtgaattagcagtttattttctgttagatcatgatttttttttatttgtaatagtcttagctagaaatgttaaaagttagcttttgtgggcaccataatactaaaatatttactttagtgtttcttgacattcaaaaatgtcattggatttgtaattcaggtatcatatttgaaaatgagtcttttaaaagataacataaatatctttattttgacacacaaggtcaagactagaaatgtgttcctgggtactttcagcctacttggtttaatcaaattgcttttgaatatgaatgtcctaatttaattctttggacctttgaggggaggacactatcacttctacatatgtagagaagtaaaagtctcatagatccatcttgtctttaaaaatatatggtgctataataatcttttctttaataacatcagggtgagttatgagttaattgtttcagttcattgtttcctggtccattttaggctgttcattttgctaaagtttttgccaaagatttcgagaatatgatctttagagttgaacagaaaggaggtattaacaacaaaaatattttaaaatgttagattcttcttaatgtcatagtcctaaagatcaataagcaaaagttataaactcccattgagactttcttcaccctttcctttgagaggcatcagtgaagggcacagtggttgtacctccgtgaatgtgtattcctaaattcatgctggctgaattcaggtgtaattagagactgagacccataaaatgaggggcaaggagctaattactcttgtcggtaaccagctgtggccataagtaaccctgttttgacccaattaatagtaaatccaatttttaatcctacagacagttgatggtgcactcgtagctgcaaaatgaaggacattaaatttggctgtgacattgagtggttacacagaagacctgcttctacaacatttggaaacattgtgaaacattactattcagttgctatttttccatctcaaaatatttttttttagttgctgctcacttatggccacagaacagtccctttttgagtaaagcagcaaggttgcttaatgacatgctatgtggttaacaagattcaactgccacatcaaggactttaaataatttcaagattttaaatgtatttatgaaatgaactcattacagcagctaatcaatgcaaactttgtcctttttctttgtctttctaagagaaactgaatttaatttaaatttaaattacagtgtctaaaacttggtaaaatattttaaatttgaataagaggaaaaaaaaaacatgaatttatttatgatggagcttcatacccaggacagtagcttcttaaatgttagtaaaataattatgttaagcattaaaacaattttgaatatgtaattaagcatttatgttaaaaaacatgtttcttacgtgtgtgtgtatatatttataactgacacatgtgattctttgtacagtatttagaatccttcccttcagatagcagtcctcttgtattcagtcttgtggctaaaatagatcaaaaacatattttaaaactgttaaagtaactgtatgactcatgcttgaagttctgaaatttgggagcgttatgaggtttccatgccattaaccgctagatcatttgcattctctcacagagtaaacggaaaaaaatttagaaaacttgtaataatcctgacttctttaataaaatgtgtcctgtgtattgcttaaatccatagtccagccttttctgagttcttgagccatgagatggaggtggcctgtgtaatctactatttttagaaagttaggaaagcaaaccaaatactctctgagaggaccctatgaaatggctgtacccttcagctgtgctgcttcagactttggccaggctcccaggtgacttacgttaatagcagacttctagttagaagaggagaatttatttcattaaaaaaaaaaaaaataagtcaaacagttcaagaaagtattcatttatgtaaaagaagtcaattggtatgttactaaagataataggaagaaaattagctcactattttagttgcatactgatgattttaaggtttaaataattagatttaaatataccgtatgtaaatgtagaagtctgtatcgtaataaatctgttgctaagtaaaatgggaatacatgacaacgaggaatgtaggtattaagaatgtcagaattagaacgagaacagtaaaagagcaaaagctgtaataatgtgtgctagtatataaacaatactctaaatacttagtttctctaattttccttttacaattgcagttttaatttataatagtctaagagcgtattcaagctgagacttaaattgcttacgtgctatagatttaggtgtattagctatttcagaaatccagaacatttgcaaaggtgcattattttatgccaaagaggattatgttcccctatggcttgtgaaagagataggaaaaaagaaaagaaaaatattaacactgcaagccaccattagaaaattatatttcaaaaatgatgtttcaaatcaatgacaaattgcctattcagtcatgagctctcaactaaaatttggggagtcaatgtaaagaaagcctacagaatgtattttaatatttgccaagttatttataccctcaaaaaaaaagcttttacgatatgatcaacagaaatagacttattgtttactgaattctatttcaaatacccattcatttttcaggtactagggatgggagaaagagaatataacctttatatttactatctattttccaaaaatctagcaaaattcttttacctttgaaaactttagtcacttgttcctttatcaaattgagccattttatttaagataattaaaatttctttttgctatatacagtgatatctatctataaatagcaccccgatcagatttatcatagacacatttgagatcagattccactgcaaagtggcatacaatcaagggtgctgagaacagttttaaagagcctctgcaggcttagcagaatatatgaagtatggaaattaggtattagaaggcacacaaatatatgtacatacaggtaaatgaacaactaaagcactcaaaatcagtaaggcaaacaagtatccagatggtcacatatggattggatggcataactagacatgataaagtagtcccaaaggtggttatagttaaattttagaagatcctctgttgctagcatggtttatcctcaatccagaaattgcctgtgttgctgctgttctaagccccaagcatagacttttcatcatattttaaaaaccagtttcactgataatcctgataaaatatctgcaagttttagactaaatatgcaattttcaattaaaattttgatctattagggtcctaactggaatcactgttaccaggaagtttttttgtggtttgatttttaaccactggtatctcccatgtattaaaactttgacagattattatatatactgtgctggcacatatattcaatgtgtctttcagtgacagattgacatatcacttccttgttttctcctaataacttaggagatgaactaactataaggcataacctgcgcagcagtatgtttcatataaaaggtccctaaggagaaacttcacaactttgtaaagaatatcctgtgaatatgctgcagtgtcatcaactctgacataaacctttctttaatgaaattctcaatagctgcagttgctttggtgaaactagtaattgtattcatttgcctgtttatattagaacttttttagaaaacttttttttatgagtaaaggtttttttagactattagataaattgtaaaccatgtttcgaatcaagctacctgctgcagtaattctagaactatttattttgcttcatattataagattttggtacactgcgtctactttttttctcatgaaatcttgcttcactgtgtgagtgtgacaaactaaaaacaatttagacctcaagcaatgtggcacttacagctgaattcagtttcattgtaattcagatgtctgaagctaatcaaaattccacggagtacccttgaaacaattgcatatataaggctgtttctcacttaaaagagacaatgcagtgtggggtgaattgtcttttgaagaactgtatgacacatgcccagttcaggtgaaaggtgagaaatggaatgtttctcagacctagcacagacacctagggacctagtttgggaagcttatcttgtcattttccttgccaaggataagtagaggatttcagctatcaacattgctaatccgttacctttcatgctgagcaatgtctctgccttcccacagacttagacaaagcttcttattttcttacaaagaggtcctattgaggaaatttgaattttttttttttttttaaacttagcagtactacatcctgtgcttttagataggtgagcaattttccatgttaacagctaggccaaaaatcatgactgccagtagaagtgggtaactagatagatagatagatggcctttgatttagcactgatgatagttattagcatgtagcaacttaagtaaaagcaactggaaaggcttgatagaaattctgagttgtttgaagtataatagattattaggatagtaatttctttgtgaattttactgtaaacaagcttgattctagtgaggacttatgctaattgctcacttatactaacagcaactacagagtttttatttaatactgtttcttatacaaatatcatcaaatgcacatctacctacagcatcatccctacatttttggcacatgtttgaaatattttcactttgagataaagtttgatttttttgctagcgataaaactttctatgctatgagcttgtgttttgaaaattactgataattactaaacagtataacccctgatatcttctaatttggttgacaggctgtttgtcctctggattcctgagggccttggccatctctgaccattacatttcttcttttgttatctctgagttctttccagctttctaattgtccatctttagaactattggttccgatcttaaatatgtctttccatagtcacacagaagtgatttagacattttgtctgtgaagaattagattcagctttgcataacagagacacctcccctaccctccccagcatttggtataaacaaattaggggtttatatttcagtcgtctaggtctatttggcgactctatagtcattggaactcaggttccttctctcttagttcctaaggagcacatggcttccaactttaggattatttcaaaattgcaatgtggccactgcagtgccagccatcatatccttagtctagcaggacgcagaaaaggcaagacaccataactcagcccagccaggctccttttaagcaaaggttctctgagcttcagccagtaatttttcagtctcttattgactgattttggtagcagggattgctaggaagtatttttttgtatgtttgtttgttttgttttgtttttatttattattattttaaaaaactgttgccttgattgaaatcaggagtctggtaggtaagacagaaggggagaatggaaatggatgttcaggagggccatttctggaataaaagagtgtttatttttcctctcataaaactttcagaattaagtaaatctctctggaaagcatctgggtaagggaggtggttgaagagataccacttttgaagagaaactgaagtcttctcatcttgacaaacttgtcatcacttctgtcttgcttatttagtaaataaaacctggcatatcacaaatggatttatttttccttatagagaaaactaaaacagcttcattttttatcttcttataactgtacttatttatttatttatttgagacagagtcttactctgttgtccaggcttgagtgcagtggtgtgatctcggctcattgtaaccttcgcctcccacgttcaagcaattctcctgcctcaacctcccgagtagctggtcctacaggcgtgtatcaccatgcccagctaatttttgcatttttagtagagacagggtttcaccgtgttggccaggctggcttgaactcttgacctcaggtgatcagcccgccttggccttccaaagtgctgggattacaggcgtgagtcaccgcgcccagcctactattcatatttatataaacagtcacatttttataactggaatatagcagaaatgccatgtcattaaaaacaggtcccaagtgattttatatgacaaaagaatctgcactttgatttgtatttctgctgcttccacaaatacactttcttattttttccgtatggagtaaaataacaaggtgagttaatatttattgaaacttaatgtatgtcaatcagtgttttcagtgcttttcatttttttcatagtattttgtccctataaaatctcatcgagatagttactggtgttacttccatttcacagatggacacactgaaatacagagaagttaggtaatacatgcaaggtcagtcagccagtaaaatgtggacttggagcctcgtaatctgatttcacagcctgtactcttaattgttttgttatgtttgctggaaaacattgcttcttaatttccatatgcatattctaaggattcgacaaagaaaatataactaacagcagtacttaagaataaaaatgaatatccaagacaaatttatagtacagggcctaaaacagtaagtactcagaagtaatcactgtattttaagtcaacaaatgagtcaaggagtgaacccaaaatagcagaaagaatgctgccaccaactttcaaagatgttgtatctgttgtaaaatatatggccatataggaaaaattttaaatgaatcatcttagataactagtcactgtataaactatatagctgcctccccagtgcataaaaagccatattcaaaaggtttaattgtttagaaaatgtttttccacagaagcaaggtgattaagtcatcgggtcaaccctgagaagccaaagtagcccagaggatgcttgagttatagttcagtacaaacagtaccttggaaaccctggttattaattaaacccaagaggctccatagaagtgttatcttatcataaatcttgagaactcctagagtcacagaccccagctgcttttgtcaaactatttctgtggcaaagatgtattttaaatttcagtttagggttccagaaattcagcttgcctagtgcaggggaggtggcctttcccaaagtcctggaactcatgctgtgagccagtgtagttttccccagctttaactttgggctgcttctgtttcctgaagctagtctttaatagggcatttgcttagaatcagcaggatctaaagacagggtatgcagtgaggagctggagtccaaagcttcccacctgtgtaacctttagggtgggaaggtgtcgtcaatatgtcttccaagtgacccccatgtttctaaggactcagcctgcctgttttttgaatgtagtgctcattgatcctgggccctgtctactgcagagcttaatgaacagcttctccccattcttccccctctctgaaattttcagctgtgtggttgttgctgttgttttctaaatactagtagccatggggaaacaggtagatcataaaagtatcaaactcaatttttgttttgttttgtttttttttttggcattttatcataggatatggtcaagagaccggttgtaaaaactcagatgtgaggaagaaaaccattaggaggtgataaggattcaacaatttaagtaatataacttatgtacttcctatgtcaaactttagggaggcagatgttaacaatacagtcctcaaggagccggttactaacagggagactagtatattaggtggtggcggcaatggttaggagggggaagtttctcgacagcaattgcagggtcagtgaaagagatacttgaggaagagagaaagaaatggctctggtggtttatctttcctttttccccttccctctctctcacactattaattatgacatcacaagtgggaataaaagaactagagggaatccccagtaaaagacttcacatagccacaggccaccagactgtggcagctgtccctgaatcatcatgggtcagttggtaacgacctgtattttaaccctagatcacaattttaggcccagcaaaattgttctgaagctgtctagatttattaagctatatttatattttagtttatgttaatatgaggttgagatccaagaccctgttttctccagacctcatatgagtacagtatcttaagttagaatttatctctctgcataaaaatcagacctagtgcgtaggcttctggatctcagaatcacttatacttaagtccaggctgttctcaaataaggcaagaagcatctgctgttaatagctgacagtaaattacacaaagtaaaacatggaaaattaaagtcagaaaagctaggaagcttttctatcattttcaattttctgcaaaaatacagacataatcagtgtttaggatctgcttgtgatggataaattacatctgtaattccttcttttccatattactgcattcagacgataatttgctttcagatatctttgctcatctaatcgttcatagactggaaataagtagtaacatctcccaatcctaggaagcatttataactagtctttgcctttttgggtgttgatagactagtggtgattataagctttcgagcttctgaaaagcacaacgaagattaaaataatcataggataataaaatactttaaaacccttctagtctttaattttaaaatgttccagtagaacacaaatttgctcaggtaacacacaagtaagcattaaatgccttcctgtgtatctgagaagtttgttatgaaatattttggaaaccgctgcatagtcagtgtaggaggagcagatgaattttagctgtggttatgtgtgctgtaaaagactatacgtgcttgtattagtcagaatgagtacaccactaatttttgtatggtaagagatttatactaagctcatcatcagtttctataattcagtgagataaaactgagtcagattgatttttaggtagcacatgtagaaacagctaattttattcccctgatttgatcctcatctattgattatataaactaaagaagctaagaacaattaacccttacgaggttacacagtcaggagatgctgaactgagattcagtgtagaaagtctgtcttcagagcctatgcttttagtctttatgctaagtttaacttgtttaaatagcaagattatgaagcactatacagtgacctcgtatagacaaaaatatagtatattgattattagagaaactacatattagactgttgtacatacgtgggcaagtatttgttaaatcatttcagttgcctaaatttaagcaactgtgctgtttaaaacatgctcattcacattttttcttaatctagaaagtcacttctgaataattgcttgtttagattttctcatttggtgtgggaaatttatattaaaattttaactaatattctaacaatacagagtctgaacctaaagtccagaagaattttaagtcatgccgcagacaggatgaacagtatagcaaatcagaataatagactgtttgggggggttggggggaacccatgagaatttcaggatttcaagataaagcttggaattgaggtaaaggcatcagataaggaagtgtttcatttcataactttttttttgcttgaaatataatatattttaaatcacaaaagtagtataactgttatttttctaatgcacagaaccatgagactttttttttttttttttttttttttgagacagagtcccactctgtcgctcaggctggagtgtggtggtgccatctcagcttactgcaacctccgcctcctgggttcaagcgattctcctgcctcagcctcctgagtagctgggattacaggcatgcaccaccatgcccagctaatttttgtatttttactagaggtggggtttcaccatgttggtcaggctggtatcaaactcctgacctcgtgatccgtctgccttggtctcccaaagtgctgggattacaggcgtgagccactgcgcccagctcaaggcattattttataagaggctgagattttattcatcttactaggcatttatttatattatattgtttctaatatatgcctagtaagacagaaatatgcttaaaaacctttgtaaatctttacaagttgtactatattaagttaaaatccagatgaaaccattcaccacctctttgacaatgattcatatatcttattgtatgtcatgcttgtttgtgattttgagtattacatttcagaaattttctaggactaaaatttcagtagtttattttaattttttgtttatttgtaataattatcaataatgctgaaatatttagatctagtaggtagaatttttttcatgtgaatacattaattttaatgatgtatttaaaaatagctcacactattctttttaagacttttgttatatgtaattggacaaaaatttgaccatgtaaatataagaatcgttgattctattttgttcatgatatggcataaagagcatgtttgctctcaaaaaacatgggtttgagaagatgaaatttctgggcatactgggtatttagtagctatcagattgtaatcctgaactcttaagagatgtatctcggatgggcgcggtggctcacgcctgtaatcccagcactttgggaggccgaggcgggcggatcacgaggtcaggagatcgagaccatcccggctaaaaacggtgaaaccccgtctctactaaaaatacaaaaaaattagccgggcgtagtggcgggcgcctgtagtcccagctacttgggaggctgaggcgggagaatggcgtgaacccgggaggcggagcttgcagtgagccgagatcccgccactgcactccagcctgggcgacagagcgagactccgtctcaaaaaaaaaaaaaaaaaaaaagagatgtatctcaaatattagaattgatcatgttatttaaaatactccatgggaaatataattatttttatggaacagttcatttggatgaatggtagcttgaacagaaactttcgataccaatagctagtgttataagtgtcctttcctgaaactcttgccacgcattgtgttttggcgattttcatggttgtacgaatttagtcagacagccaattagaaatatatttttagaaaattaaaaatgaatttatgtggattcaatgagatcagttgggtaaatcccttaattcagtgtcatgctcatgtaaatactccataaatggtagccattagtattgattgttcttatctgaatgccagagtttagtctaagttatctttcttcttatgggaggaactttgtcttaggtcagaataaagattgttatatagattcaaacttggtatgtaattcaaacttattttatgttcaagactaaattgatcatagggaaaagtgactggtgttccttgtcctttcatttcatttctctggacgctttcttcattggtttacattagctatagtgtaactttttattgtgttttggtattttctgagtgtctagattggcctgtatgctcttttctttgggatgaaatttgtaataaaaattattttgtagcaaataaatactggcgacaggaataatgacaatgtgactaccagtggttttcacttcattcccagtgtcacgtttagaattttcatcaaactaggatcttcagaataattgcaaaaagccacatgaaaaaatgtgcaagtgaaaacttttttttttttttgagacggagtctcgccctttcacccaggctggagtgcaatggcacgatctcggctcactgcaacctccacctcctgggttcaagcgattctcctgcctcagcctcctgagtagctggaattacaggcgtgcaccaccacacctggctgatttttttttatctttaatagagacagggtttcaccatgttggccaggctggtctcaaactcctgaccttgttgtctgcctgcctcggcctcccaaagtgctgggattacaggtgtgagccaccgcgcccggccaacattttattttttatggcaaagaatcaagactttgttaagagcctaaaccgtggattcagctggatctgagtttgataccatagtgacttcctagtgacattgtgccaatcactttactgtcccaagctggtttccttatctgtaaaacaagtctagtatcatttgctttcaagatttgtgaggattcaatgagatcagttagatataaatcatttaatgtagtgtcttactccatgtaaatactccatagatactaacggtagccgtttgtattgttcttatctgaatgacagagttcagtctaagttatctttctcttatgggagaaactttgccttaggtcatagtgaatgttatttgtcattatgcacattgcactacaggtctctgtgttgtttgaaaaaattaaaaaggacttaaccttgaatgtatataagtgtgcacatactagcttatttatttacctgttatcaagagaaaataaccccttaacctcttaacatatgtatgacttgactactagctaaaccagtaggtattaatggaataattcagaatttatattgtctgtacctgaaaattcattttgtaaatgcagttaagtatgaatggaaaaatggttgtagccatctgttagcaaatctaaattcatttaaaactaatcctatttagctttatgctggtctacaataaataattcatacttgatatttcaaatgctgtattatttatgtaaattttctcctaaaagactcacctaagacttttctagaaataaaattgtttattcagcaaagtacctgcacagattagaaggttaaatattaaagtttattttttcatgattgcactattcttttctatttttttatacctatataaacttaattggtcaaatatctaccactcacttcctcaaatgtgtaaagaagcatccaaatccataatactctgtttatcacagctttttttttttccccctttcactgtcactcagaatcgatagggatccaattctagcctgttgaaatggtccgttttgctccaagactttttttttttttttgaggtgggagtttagctcttgttgcccaggctggagtacaatagcgtgatcttggctcaccgcagcctccacctcccgggttgaagcgattctcctgcctcagcctcccaagtagctaggattacaggcatgtgctaccacgcccggctaattttgtatttttagtagagacagagtttctccttgttggtcaggctggtcttgaacttccaacctcaggcgatccgcctgtctcagcctcccaaagtgctgagattataggtgtgagccaccatgcctggcctagctccaaaattttaaaaagcatttgcctcatttatgagtttgagacttttaacatcattagaaataggagagcatgtactttttccagcaagtgtaaagggggaaacaaacaccaaaaccccatctccctgatttttttggcttttcagaaataatacagcctagtcctatggccagttctgggtttttcttgacagcgtctgtaactgttcttgttatagtctaattctgggtatgagttatgtgtttacagtttgatttactgagccatgccactgcattcttgttaaggttattgattattgcccattctgttctgctgtgtattattgatttagtgtgtgacaatgagttaattgtattacttgatgttgaagaaggatcaaatatctgttcaaaggggatgcttgtagcctgtgtaattgagttggctatttcaggcttttaacatgttgtgaaacaattaggagaaagtacaggaggacctctgagggcagggaacataaaatttgttttcagctttttcgcagttgccaaaaatggtgccgtaaggctttcctggaattaagtagtcagttggtatttggttagcagatgctttgtaaaacctaatatattcccactatatttcctttaaaaatcaagggggggttaacacctttagattgtcatgttttattgagaaaaatccacttctctgaaactccctattactggatataagaaaaaataacaagcaagatgtgttgtgtatgttggtgcccacattttggaggaaattacagagatagaaaattaagctaaattattaagaatctgatgagttctttttgcttactacagttttgtttcgtatttgataaaaaaatttccatgtaataacatttaagataaagccagtattattttctttgacattattttgcagtttgaattttctaagctttagacaattcacacttaatgtaaaaaaaaaaattaaccttcagaatgagatcatggtgccatggttctctaatgaatgttaccttttgttttagcagctcagttggctctaatccatggaaaagtttttatttcccatcagctccaaagtaggagccaaaccaaagtttaaagaaacgttttccagcagacaagtttctacagataatagtgaaagcgtgtgaacacacacacacacacacacactctctctctctctctctctcactcctctctctctcacacacatatgcgcgcgcacacacccacacgtcttatggaaatattaaatcaggaagaatttctgaagttctcataataaaaataactgtaatattaataaagtactccttatcagttatttctcgtcacattgtggccccaagggtttgcttgacttttcaaaatgtatttgcttcaggataaattgaagaagtaccactctctccctgtattaatacctttcagggcttttgatctgtaacctcttgtcacctctggtttatctggcttagcatatgaattttgaagaatgagggagcataaacaattatgactgccttttaaaaaatgcacgttaaacctgcggcctcaaacttgtcagttctgaactttaacagtagaaaagtgaaaactcagcgttgaaagtagagagtgtaagagattttgccagttggaccactttgctgcaaatacctattagacccaaacctttcttttgcctagtgatcagctatactaatagcaagatccacttaattccatgtgagtcaacagcttgcatggcatgcccactgtgtgcaaatagcttctcaggtacttttccaagcgtcctgcctgcacaaagcagaagagacttggaatatatttatttattctctcaccccactgcttgctctatcacctagaccttcatgctccatcacctagtcctgcttgctccatcacctagttggaatttctaaatcaacagacatgggcagatatatattttaaaagctgtgtgcctctgattaacaaccattcctttaatactgctgagaggttctgggaacatagtatttttgccatgacttctcaatctatagagaagatgtatttatctcctaaggataaaaccatctggaaattttcacatgctccagactttcagatagagctggctttgccttctctttttcttcctcctcttccttctttttcttcttttatttatttatttattttgctttgcttattaaaactatggatgaatttttaaaaagattaagaagataaaataaccttctcacctgcttagtaatttcttattcatagttagaaggtacagtaactgtttcataactgtccccattaaatttctgattcaaaaaatatatatttttctttataaataccgtttcctatgatttttggtccctaaaaagcaaacaaaaaaaagctacttgatggtaccttggttgtagttagcaggtctccattttctacagatcttccattctgctttattaacttcctttattaatgacaaatcagccagttgataaaataatgtgttaacttttaaaagattcttataaatttatgtggagttctgtgactacctgatatgactttgtgactattttagttgtataaagaatttcaaattatttattcctttaaaaaaatttttttttcagagacagtctcactgtcactcaggctggagtgcagtggcgcaatcttagctcactgcaacttccacttcctgggtttaagtgattctcccgcctcaatctcctgagtatctgggattacaggcatgcaccaccatgccgggctaatttttgtattttttgtatagatgaggtttcagcatgttacccaggctggccttgaaatcctgagctcaagcgatccacccaccttggcctctgaaagtgttgggattacaggcgtgagccaccgtgcctggcctattttttgttttatttttttaatcttgaaataactccacagttatctccaagtaagtctaatatcttctctttgaatttctaactgattcttatttataaacccatagaatctgtaaacccacaaacaaatgattcttcatcgatcaagttctgttttcaaatagatgttcaacgagatgttcaaaaagacgataaaggatacattgtaacctaaggactttatttcgttcatttggtcatttaccttttaattgtagtggacttaaatgtatacagattttcatgtacaacaagtagtatcctttagctgcaacaaatgaatagattagcctatgtgaatatagttttgcaaaatattaatgtatgaaagtagtcctaagactgcaagtactgttgctttagaacttcatgcataaattgggtgtgttgttacaggatacagagaaaattgatggtcaaccttagcctgtagtatattttgacagtgtgaatgagtcaagcaagcaattttccagactgtttaatggtacaaaggaaagggctgctaaggaagtcattcttatgactagctgaaaaatatttttcttagtgactgttctagagaaaaacaggtcaccgttggaagaaaaaagcagtctcacgttacaagcattttgaaagtggtttgatcattaaaatgtatttatcttacgacaaaacttaaaacggatactgcttactatatttgcaatgtcttgaaactcaacaagaaattatgtagcatcattacaagttttaattcatggtagaattttggagattatatttattgagctatgttttttatttcattagtacaaataaaactgcattttatttgttctaatgataaaatgttttaagtttataaaattactgcaaatgtattccactgtgtggttctaaactgcatttgaattaaaataggacttgattgatggagaatcatttgtttgtgggtttacagattctcttctaggtagtttgaaaagattcattgtccagcagcaactgttcacccagagacatagtgcttagcatgagcttgatggattcaaaccactgggtttatcattactacatagatctttgaaaagacaggctgcaaatcttgtttctaagctgtgactagctattattatgtcaatttgaagaacagaagtaaaatcaatccagattcaaaaaaagacactctacaggcattcacagactgcaaccagttcaaattgtaatatcctgcctatttaaagtcccctgattattatgattattcaatatcatgttaatatttaaaacttggaatacaacctactaaccttatttttatttgtactactggaagttcctctagcatttttgaagtagcttggaaaaaaattgagattcagttgtggttctacttacatttttactagagtaagttggagagacaaatcagtgagtagtcaagtcttcatataatcaaagcttttaaaatatgataacaaaaacttcaggtgttagatttagcttcacggaaaacctttttttggggggcctaagtttaaaatgtgttttttctttgcattttaaaagattgcttgtgcagtgttcaatggttttgtttagcatttagagatgattttttcctttgtcactttccacattgaactctgctgatttagtgtgttagaattgccatcagaagagtccttagaaatgatgtcatgcagttcattagttttacagatagggaaccaaggagtggtgaggttagggtttaatcatatccataaagatcttgaggtcattaggaccctttaaatgtgactagttaaatcacagcaaaaactagaatatattgtcttcatttcaggaaaatggcatcattgacacacctgacagatgaaaactgctattaaggtcgagtccaagtgacaaaactttcttgactgttctgaggccttggttacggtggcattaaagttctatactgtttttttttttttttttttttttttggctggacaacagactctccaaaaaaatgcatgtgtatacattatgcttattataaaatttactaataaaatgacatggaagacaattaaaattataataaaatatacaatgctcaacatttaaattctatatggccaattgattcttacagaatgcctttttgatttttgtccaactcttgcatctgtagtcaacctgtggtcgcaattgacagaagagtttaattctttctttgtgctcttactcctgggtccctcattgtacagtgatcatcaaatgcaacatccttcatgaaaatgaatagcttcactttttggcatttccttcctttttatgtgtcatagaatacactacattattcttgattttacagttaatttgtaaattgtttctaacccccactagtttataaactccttaagaatgagaagcttgcattaatcacttctatatatatagtgttttgaatatccttggcattcattaaatgtttagtgaattgaatgcgatgtttcttccagactatgaccaataattgtgagaagattttatgtgtttttaaattcaactttagagaatttctttttgtgtaataggacatttgttggacagcaacatgtaattactcataaaatgtttctctgcggagtccagcatccttcatttgtgataggactcatccagttaaattgctcaggcactataatggactatttatgttctgttgatgtaaatttctagaacaggcctttccctggactcatgccatgttttgtatgttatcttgtgcaggcagcacatggggacctagtcaggcttcctgatatgatagctgtatatacagcccatgtctcagaggggaatgataaattggcctgtgcagtgacacaatacacagttattttggtgacagtattaactctcttttcataagggtgctttgttggaaaactattcagcttaacacagaatatttagctttcaaaggttgcatagggagaaatgatactgccaggatagaaacattatcagttttttctttctttttttttttttttaatcttttttgactctaccgagaatattgaaaagagttttgattagtattggtgtttattacgagaggaacattctgggaaccagactattagtataattattattgtttttattatcaaactaatagcactaacaaggacatacggtatttgtcaagggattcctatatctctgttacacctaaatttctctatactctaattttagaaaaaaagttttgtcttccaactgtgaatactttatagtgttgcaacttctgcttctaatctttaatctgaagtagaaaagagaatccaagcttccaagaagtatgtctctagactctgccacttattaacttgctccttattttttctctccaacaattattttaagatctgtatgatataagctatttttagaagaactgaaaagttctagagagtaaaaaaatgttccagattgtgtgttggtgccagtagtactgacaattaaatatttgattgaggagaaacctacatttatccactttgaagaggatcatcaggggagttaaaaatttagtacttcaggctcattaagagttagaatagagtaattatgtagctggtaacaaatgctacaatcaccacttgagcattgtgatatgttactcattgagacttactggccttcttcagggaacttcagattttataaaagtcatttgcttagagagtaaagttctgctaatccattattttagttctgtcatctttttctgcaaatagggtgagttttccgagagggtaagtccctggtaataatcttaaaaatgatacaactttacagaatatctccccttgccatgaagcaatacttaatgtcttgaacagtgagcctcttgttcatgcagcatttaaaagagatgagtgtagaggtcttccttctacattcattttattcgttagtaattgagaagcaggtctaattttctaatcttgcaagttgggaaattattaaaatgctcaagagacagtagatcaagcctggtgtccctttctccatcaaattttaaaggatttttttttcctcagtaattctgcctttgtgtatttccaatcttgcttcctatttgcattgcacacagtggcatgtcaatttcaaaagaaaatgtattcagatctactttcaaactaactgaaagagatagtggtatttattttatcctgaggttttgttgttgttgttatggttgttctttgttttttaaatctggacatatcagtaatctcctaagagaatctattccaaacacagagactgtttattcttgttttagatactgttttaaaagccaggttatgttattatagtatagatattttaaaaaataatgaaaacagagtttttttaaccatatttttgtactgcataaaaatgcagtgacaagagaaaaacattagaactctgtcatactcctaatatagaccattgctgttaggtttctaactccatgttccctgtctggaagctttataaggccgtgccttagtcttcttaagcctaacacattgtagccttccaataaatattactttatttgtattaaatttaaaatggaatagaatgtggtacatcaccagcgttcatagctcctgacccatgccataactttccttgccccatccccaagattaaaaaaacacaaactattagactaattatagtcattacagttgtaaattaggtcatgcatttcattaaaaattgacgcagctccctttttgaaaggctatgtcacggaaatgcaaactagccttgtatatagaacactaaaatcatttaacttgaattattctaattacgataccacaaagattaaaaaatacatctatattatctcagtctgataactgggctgggaaaaaatgtcagttttgatatgtaacaagattggtatgagttattttacgtgacagttttattgattgatttttttcatttataatcactaattttgtgaggttttctcccctgcagcagtggactgaaaaagttaacatttttctggcattttttaagcgctaagagtagaaatcaatagttaaattgacctaataaaagatctgtgcatcctactactgtgacaagaagagcaacagaaagcaacatgtatagactcttaacaaggctcaaggcacattttggatttgttttgcatatgaatttaataagcatgagacagtgctagtgaattacatttgttttattgagtctatttaagccaggatactgttaagtaatagactgacggtttgtgggagccagattcagtaacaggtcagcaacagacttgccacatgccaaaaatggggttatactggtttcagtttgctaactgcctaagtaaacttgtgtagaatttgcattttttgctttgcaattactggttacttctctttaacattacatttgcattctatgtaaaaaatagattttatatttaattcaaaatttatccaaatgtacttactcattggacattatttttaaatgataaaggaacttaaaaaagtgataggatcaatatagtaataattctaactcccttttatacccatataaaattcatttaactagacttattcattcaacaatattgttaaataacctaaaggaatttttttaaagaaatagtgtaaacatacaaatatgaataatttgaactcccttttatataaatatatctgtagtcactaactgtaaataatttaaaaaatatatatgtacacacacgtgcgtgcacacacacacacacgtcatgccttaacaatggggatatattctgtgtgtcattagggtatttcattgttgtgtgtacatcatagagtatacttacacaaacctaaatggtatagcctactacacatctaggctgtatagtacggcctattgctcctaggctgcaaacgtatacagcctgttatcctattgaatactgtaggcagttgtaacataatgttatgtatttgtgtatcaaaacatactcaaacgtagaaaagatattgtgttgtgctatgaggttatgatgtctacaaatgtcactgggtggtaggaatttttcagctccattgtaatcttatgggaccaccatcatatatgtgggtcctttgttgactgaagcgttgttatacagctattgactatagttagtgaaaaaatctagttctatgattggttttgttccctcctttcttatgatcactattcattcaacaccttttatatgacatgcagtttgaaagcacagggtatgcaaaaattatccccgttttcggttgcagtatctgttgctgacccagataacttcatttccttcagctgtgctttcattttcaacttctctagttggaaataaatcctcttgtgttgccccttgagggagaaatcgtttagcaggaaatcacttactaatcacagttcattaatcacatataaagaatactttataaatgtcaactgtcattcatagaaaatgtatgttaccttgaggaatgtctatgaattacttattcattttcattgcctttcacacattatattccttaggagtttattaatttcaaatataaattgactatgacttatacagagtcttgcaaacaagagagatagcagttttgcaccttttctttgatttacttgttatcttcctggtcatgtagttagtctgttaaagtcactctgcctgtatagcttgttgaaggttacaggcagtggagtgctggaactggtttatgtcgagacctcttcccaattccatgttcaatgatgtctttgttgatagcttaaaattggctatggtgagagcgtttacactttggaaattggcagatggcaaccatagttctctcctagacaaccacttattaaacctttagcagcactcactgtttatagtgttctttttcgttttttaaaaatacttttattatgaggaatagccatgtagaattttatttccagatattttgttgtttaaaaccctaagaacatcactcactataccaattgccaactgagtaactgggaaagttacttagcttttctgtgcccaaatgtccttatctgtaagacggggatgataataatagcacgtaccttgggattgatgtgaggttgaataagaaacacatttatttcagtgaatacataatgacctggaatgaatactcaaataatgctacctgttatctctctgtactttaattaatagatatttattgatcccttactaagtacttagcattttgccatgtacagtgggtcatctactgagactcagtacctcccacatcaagttattagccacattgacctgtggcaaatgacttcttttgatgttcccatgtaatgccacatacccgcccccccccgcccgcttttttttcatttgtttttgtttgttttttggtctttctgcctgggactcttttttcttcctacatgagttttgcagaccttttccatgtttatatatggctcatacattccctcctctagaaagcttctcctcactctagacctggccacataactgttttgcctctttgcttatgtagtttggagtatgaatcataataattatgtatcttactccatctctgcatttgattccacagcctacgacttacacctttgtgttcttaacctcttagtaagaaatgcctgacacgtagtagactgactagaagtgtacattgaatgtttgctggttaaaggaatggaacatggacttcactcatagagaccttactatttggttgaagagataatgcatacacatgtgacatgaaggtaaacacaaaatatattgaagatatctgtattttattttttttagtttatagttaatttttacatactatatatttttgtagtaggtaagtcaattattttcatgctacagatatggacatttatgtatttatgtacaaatacattgatttaggttatctaggccagattgtaagtagcaaagccctgtttgtaaaccaggttttgtgacttcaggttagaaatattaaaaaaaaaaaaaaatccttaattgctcttccagatatgaactcattctttttttttttcccctgtgatttctgtcttttttgtttgttaagtttaaaaaatttatggcaatttttaaatgtacataatattagagaaacaatataacaaccccctccatatatctatcagtcagcattttgtatgcatgtatccgtatgtgcatcagccaacattttgccctttttgttacctttcacactccttttacccctgtagcatgttaaaagaagtctcagacatcctatcatgtcacttatacttcttcagtagtatctctgacagttaagaacttattttaaatataactccatttccaaatctatgaaaattgacgacaattttattgtatcatttgatagccactttatgttcaacttttcctgattgtcacagcaatgtccttttttaataggtacgtttttccagttagcatctatggtgtcatttagcttgttcttccatcatccttattttctgtaaactgaaaattagagtcgagtttaactttaatgttatttattattatttggggggaacatttcctggaaggttctgtatactttctatttcatcatatcaagaggacataattttagtaatccctgcttttaatgatgctgcaatctatcagtgaatcagattggcctgggccaatccttataaagttctccatcagacttggatccaatgatttcacctcattgttgatcattttgtagccatgatattttttagagtttgcaaaaatggtgacttttaattatataatttctgctgcgtttattatcaagaatttttttcataaagatcttttcatagtaactaatggtcaacttcaaaacatagtttatatcagaaaaagggaaaaaatgcatgatatttatcaattttcagaatcagatattctcttctaacataagatctaaataagcttacacatataatcaaggatgccagtaaatttttctaaaaaatttttcccttgggaaaattatttatttatttatttatttatttatttatttatttattgagacagagtttcactattgtctcccaggctggagtgcagtggtgcaatcttggctcactgcaacgtctgcctcctgggttcaagtgattctcctggcttagcctcccgagtagctggaattacaggcatgcaccaccatgcccagctaatttttttgtgtgtatttttagtagagatggggtttcatcatattgaccaggctggtcttgaactcctgacctcaaatgatctgcctgccttggcctcccgaagtgctgggattacaggcgtgagccactgcgctcggctgataaattatttgaattgcttctcctaattttttttgattaatatgttttgataacattgttcctatggtaatattatcaaaaaagttttctttccttcctttttgtttatcattaatgtgcctctgtatggttgaatttatttactcagaagatatttattgggcatctgtctttttttatcaagctctgtgctagtccctgaggatgtagatatgagccctgcttttttcttttctttctttctttttttttatttgagacagactctcactctgtcactcaggctgagtgcagtggcatgatcttggctcactgcaaccgccgcctcctaggtttaagtgattctcctgcctcagcctcctaagtaggtgagataacaggcatgggccaccatacccagctaatttttgtatttttggtagagatggggtttcacccatgttggccaggctggtctcaaactcctggcctcaagtgatctgtctgccttggcctcccaaagtgctgggattataggcttaagccactgtgaccggctgcttttttcctagaatatatagtttgggtttcttttccactcgtgatgtgatttaaaaaattgaacctgttgtatatgaatgtggttttgtaaactataatatttggtatcatatactatatttttttctatatatatatatgctactatatagtcatatagtagcatttttttttatagctttctttggagttcttggtcttagtgtctaaaatagtggccataaaggaatttggaagttaagttgttcttgctgacccaaagaaaaatcagatgtttctgtttaggacactgtatgtgacaaacaaggaagtttttattaatttatttttttgaagaagaattgatgagagaataatgagaattcctccaagattaaaagtaaattataagatcctgtgctattttaatgtaagccaacatttgaatttaatttgacttctattttcagtaaattagagtgaaattttagggatgtctttatctcctatagtgtgtgttttgccaagatttattaagggtaattttggattttagaaaatgtacagtttctaaaggcttgtgaacgttttatattgatagaaaatgtaagtaagactagtaacacattattttctccaaaggatcctgtgactgacacaaaaaatatgatataatattgaatctgccaaaagatgcactgttaatctagggttatgttatgttgttattttattaggtatgtgatactatggtgtgaattttagaatataggtaattatttaagtaattactgtaattctaaacatcttctgagatgttttctctaaagcagaaactcagcttttactcatgtttagataatgtgatatagctgttctagatatttgagattagggttgaggcaaattgttgacatataattaaaatgtattttataactaaaatttagaagaatggaaaaagtttacattgtatttataagactttgctaacatgctttatgacattacggagaagtactaggaagaaggagatctttaaaaggagtgatattctgtttgctttgctggagtaccttatcaggaaatttgaaatcttagccctttaattgtgatatctgttaattctaaaacttacactgaatttaactttgaaggtcaacatatggatttttttaaaaacaatatttactctatcaaaagattagttgtatttttgacttgaggaaatagcttaatctgaacagcacgaaacttgacaaaaaagtttgctaatacataaatattggctattttaatctgttgaaaacggaaggctagtaccaagggagacggtagtaaaattatagaaggagctagtgaaaagtaaacattatgcaacatgaaaagaatactaggggaaaaactgacagagtagaataacaggaagattagtcacttctggaaggaaaaaagtaggtaggggcagggggatgaagtactttaaacaggaatgtggaactggaagtgctagggctaaaagacagatgtgagcttatttgggagctaaactgggctttgaaaaaggaataatactggtagcatttaatatcaaaatttaaattttatgttaacaataagaaaaaaatggagaaaaatttttgttagggattataaaatgcctgttaaaataaaaagacttatatttactcctttgtggagctgaattggtttcggtcagacagcaatgtcaaatgcaaatcaagaaaatacatttctgaggccaaggcaggagatttcttgaccccagaaatttgcaacaaccccaaggaacatagtgagactctgtctctaccaaaaagaaaagaaaaggaaaagaaaagaaaaaaaattagccaggcatggtggtgagcacctgtagtcacagctactcaggaggctgaggtgggaggattgcatgagcttgggaagtcaaggatgcagtgagccatgatcagccattgcactccagcctgggcaatgaaacaagaccctgtctcaagaaatatacatatatattttatcttatatatatatatcttatatattatatatatatataatatatatgtcatatataatatataatatatataagaaatatatatataatttctttcaaaaccggtcaaagttcttttactttcaagtgatggataaaataaaaccattgtggatatcatgggatatatgtgctattggtttgaaataattttcacttttgcatttatttatctgtcaaaggagtaccaatctctaaatattttaaggattatttctatgaattctctaaaaaatataaattgtaactgtctatatcatacaaaaatatttagcaatccttataacagaaaacaagatagtaaacattgtgtgtatgttcatgtgtgtgtatgtgtgtttattggtagtctcattaatccctagtctctactgacgttattagggacattagtggaacagattttgctgaacacattttcagccactctgagtgttcttaggtattttatttatttagagactgaatctgtgttgtcctgcctggtctcaaacttctgggttcaagcgatccttctgccttactttcccaagtatctgggactacagatgcacaccactgcccagctaaaatgtactttaaataaagtagataattctggggttatctcaaactcctggcttcaagtgatcctcctgtctcagcctcccaaagtcctgggattactggcttgagccactatgcttgccacctctggggttatattagcatgacaccaggacaaaaatctgcccatttttatatcaggaaaaaaaatgctactttcatttaggtgcagaaaatggcttatgcctattgaaataaaaaattcagtctaatttagacacctaagattattatttgctataacgacatggaatacatcactgtgtgtcactgaattcatggaaatgcagtacagaatgcaatacagtaatccccccttatctgcaatttcactttctgcagtttcagttacccatggtacaacacgataagatattttgagacagagaaaccaagagagagaccatattcacataacttttattacagtataattgttctgttttattatagttattgttgttaatcacttactgtgcctaatttataaattaaactttattgtaggtatgtataggaaaaataatagtatatttaggggttgttactgtccatggtttcaggcatcctctgggggtcttggaatgtattccccatagataaggattatctactatatacagtcaggtaagccattcccattgattttattacaaattgcagtgcttccatggcttgcttacacataatttgctgaggtaacttttgcagaaagtaaccattttacgtgaacaccaaatactgattaaaaaaatctctttttctccttttccctctctttctctcccttctccctctctccttccctgtcttactccctcgttcctgctcttcttctcttttcatactcacacagacactccttcccctacacacacacacatacacacatacacacacacaccctgcccctgggcataactgaataggaaatgtttattttccaaactacagaaaaaaaccttatctcaaacactgaaagtccttccttttcctggtttggaaacactaagtcatactgagtcacttgtagattttctttagccagttttatttaaagcataaagttgtgaggacaaaatgactcaggaatttgtaatgtaccattagagcttttcacttttaggatgctagttcatattcagatgacttagtattaaagattgatgggttgtttactttctagaagaatctgaggagctcactgtaacttcacttattttgacctaagtatggcctagagtttatgcttattaattcatttatttctcggtaaagccatgtccaaggaattaaataaaaggaagcggacccagtaagggttgatgaataagaagctgttaccttactcatttacatgtattacttcaaatgttattgattgattgattgattgattgagatggagtttttgctctgttgcccagactggagtgcagtggcatgatctcagcaacctctgcctcctgagttcaagcgattcttcagtctcagcctcccaagtagctgggattacagcctccccactaccacacccagctaatttttgtatttttagtagagacagggtttcattatgttggccaggctggtcttgaactcttgacctcaagtgatccacccgcctcagcctcccaaagtgctgggattacaggtgtgagccaccgctcccggccttgatacctctttaaaaatgaagtttgttaaaatgatcagaaactttaatgcagctgattgcattgccattgacatcagtgagaaataaaaactatagctataatggttaagttgagcagttggaatctgtatgtctgtatctatctatgtttatttagatgactggataaaagagtcatgattcctcctagtctatcacgtggtaatgccaaggtcagaaaaatcatttgttatgatctatcttatgtaaaagcctgtggagttactttgttttcctcactcataagatgtcaaaatgtgctttctagaatttttgaataatttttgcttaaattcagtgttaaagttggagactgaaacaaatttaaatctgttgttagccaaagagtaaatcaagcttatgtgggtgcaatatataacatgactacccaagaaattctgcaaaaaaatgtagttgtctagcaattaggtacagagttgtcatcttccttctatgataacttttgattataaaaataattgaaggtaaataaactgtaaatgacacaccacctcaagctatgccacatgggcacctaaataagttctttttagtaaatgccaccaaatggctgtatttcttacagcttatggctaaattctgacagaggggaggtgccttcaccataagagtattttctctttgaagttttcatggttttgtgtgtgtgtgtgtgtgtgtgtgtgtgtgtgtgtgtgtgtgtgtgtgcgcgcgcgcatgcgcacacactagtttatattaggttagagtttaaaaaaagctgaagatagccaaaattagtccagagagttagacttgctgccaaactaaagaaatagcttggtttcagtattcttctggcttctcagtcttaacatttggggacctgagtgcttgatttgagctgactgaaattaacccagatggcccactttgggtcctcaagagctaattaaaggaagtcatttcagttgctgaataatcaaggccgtaccttcctccaatgttggtttcagcccacaccttacagatgatcgctggctttctgaagctctctctaaactcataattattgtttggaccctgcatgtaactaaattaatttgccaaggatgggaatgaaatgtaagttttattggcaacaatggtaatcccccaaaacagaatgacagatacagtgatggtaataatgttactgccctgttaatgcctccgaagataagatacacttgaaaaataatgtgaaaactgaatttgtccttgatttgaaaaatctgagaatcacataaaatgtttgttaatttcttaagctggtaaatatcattaagagaaatggacacatataagataagtttgtgtgcatatttgtacacagttaggtttttggaaaaagacagggatatcagatgctcctgccaccagggttctggccaaacacgacatttcctactcttgtttttgaagagttctaacacttcatcagttttcaagtgtcagtagagagtgggcataaaaccacaatttcaggagctgcattctctgggtccagatttcatctttgctacttattagttgtataacttttggcaacttaacattatatgcctcagatttatcagatataccctattaaatggcaatgtgtctaccttgttaggttattgtgactcttaaataagttaatacatgtaaagaacttgtggaatttcagggcacacaatgttaccttaccattgatattatttgctgttattaaatcttaattttatgtaaacattttaaaatgtctgtctcgttaacaataaatgtgcaatatacaaataaatgaaaatcaaaattagtggtggagttttaatgaaataatttagagctccagctctggaactgtataatcttcattcaaatcactgtgaccttgaagaagttatgtaacctaactaagcctcagtttccttgtttccaaaatgggagcagtactaatatctaatccttagaggagttgtgaaaattaaatgggataacacgtataaagcacagagaacagtgcttggcacttaatgagtctacagtgtgtgttagctattgttttattaattctgtcatgatgaagtgaacactgtgatgcaatacttttatacttagaatctgcctatatagggttttcagttttgctaatgaggagtgttattctctgctgtgtaaagaacacatgctttggtgtttataatttttctctaataggtaaatgattaggaaaagaataacctgttattttacttatcctttgttgagatatttaaattatacaaaaaaactgtagatggctttttatatctataggattttagctctggataaatcagttaggtaaatgcattattaatgttggaacctgcttaactctgttgtccagccacattgtagccactggttaagtcgaacgccactagaaagaaaagcaaataatcaaaaacatcaaaatggaaatgaaatatggagcaaggaagtcattacttctgtaaaataaaggtctgagacctaatattttcccattggttggaagtattgattatgaaaacattagaattttcagtaaaattgtttctgtgccaagatggcagatagaatattatgaaagaaatgaccaaaattgcatatgacatttattttatatggtaacattctttctttcattaacaggaaattttagggcaattatttgcttattgggaatgagaaggatgaatgaaaatttaaaaaggattcatcaagtcttccttataataaagtaaacttttaagagcatgtttttccatagaattagaaacttagaatttcatagtaacagtgtattcatcacctcgtttggggagcagattttcagtatgatcacaggaaaacacctgttttgacactctgaaaaaggtgcagacgtacgggcaaactctctgtaggtgtaaataagaatgctttggctagcatcctgcaaggagatgggtctaaatggtctgctccagcttctgctgctgctgctgctgctaatattgctgggaaggaaaagtggctgacctggcatatccattactcttggtgctgcagcagtcactcaggaaatgttgtttaaggggaaccttctggatccttttcatggcaccatggcaagaagaagctgtatcttatctatggaagataaagcatggagttggctaatggatgctggtgagtgaataaggcaattggggagccagtttgctaagataccatttgggtaggcctgctcgctcaaggcctgagatgacatccatgggaaatggcttttggtattctgtacattagaaactgttttagagaggaaccgtggttttcacattggtgatctgatctgtgattctgtatatgttccataaagttctcatttattctctgcttcactacttgaaatactaatattgaagtttgttcagtacttcagtagatggagcatagttttccatgtaacttcttagtcactaatctctactcttgtttttgacttgccctacagtgatttttaaaaataactctgtggtatatgaaagcagttgttcctcctttcaattctaattgagcaccttttttttttcacaacagtagattataggattttaaattatcttcccttttatgatttacatcagacacaaacatgtcaatagtttacttttgtccaattaaaaattggaagaaataagaattttaagttaatcatagagatgtaggtcaaattttcttagaattattattctgtggttaataggtatcccataaaaacggtaagagctatgtttgggaacttacagtggcatagtaaaggttctgccaagtcatgggggaacagacttgtttaacttcaacttttaacagattcatttgaccaaccccctctcctcaactcttcttttttcatgaagagtgcctttccacatgtggcactaccggacagtaagtgtttattgagcacctactatgttgctaggcaaactaggtgctggaaatataactgtgagcacattcatcaaaaatttttccccttgcgatgcttaacaacagttatgaaaacctttgtttagatgatctgatcttatgtaagatactttaataacaacataatttttattcaaaaatgtaatctgaagagcttcataagtgaataaacctacaatttctgattgacaatgtttatttacttctcttccacttttttgggggtttgtttcatttttgttgtttagattgttaaaaactggttttcaccaatgggattaagagcataggtgcagaatacaaactgcaattgatttttaattttttatttaaagtcaaattattacctttaaaaaaaggtcagcctccatttggattctgccatagaggcttacacaatctttctgcattcaaacctatcacattgacatgattatatttttaaaaaattaagtttagtttaagtcaaaatctaaccttaggcactgtctctaagatgaaaaagtatttttaaaggaaaatttagattcctcattctcttataaaatcccagttccctcaaatttaaaatactaactgcttaggcagtacttaacatgtcataaggtgggagttacttcattttataacaatgtctaactcttagtgacttatcagacagaagtaaaccttgcacaagctatttgatagcttttatttcctgtgtcacttagaatatatattttgcaggtgaggggagaaatcaattttcccaacacaggatagtttgaaccatttgtctcaaagtaaaatagactactgttactattttagttaccttagaactaaataccttggaatagaagaaattagatatccgaagtcaagaattacacacacataactgcttttaggcaatagcttttcttctttactaatttcaagtataaagtccatggttaatttgcttcgagtcttgaaaaattgagagttcctaaatgattttgaccattttcattttcatttcatacatattaggaattattaaagtcctgtcagagtttatactgaacctctgacttgattttatccagctcatcaaagcaaaattgtcttagtagcactcttttgtagctgtttaatatttaatattcagtgggctccttaaggtgagttcttgaaggcttgtgagtagttgaagagctgtgaatggtggttaacaagctattatcatctccttgaaaagcataacatgaagcagagattcaggaaaatcttagacagtgattagtctatctgacagtgcatcaaaactaaattagttggccaagcacggtggctcacgcctgtaatgccagtactttgagaggccaaggcaggtgggtcatttgaggtcaggagttcgagaacagcctggccagcatggtgaaggcctgtctactaaaaatacaaaaattagctgggtgtggttgtgcacgcctgtagtcccagctacttgggaggctgagccaggataattgctcaaacccgggaggtggaggttgcagtgagccaagattgcgccactacaatccagccttccagcctgggcaacagagtgagattccatctcaaaaaaaaaaaaaaaggaaaagaaacaccaactaactaaattagttatattttctgtccttcctcttctttatcctttttctttttccatcttttgttcttctcatctctgcactgcttatctacttgcttcttctttgtattcttctcttatctcattgaatttcttccgtctgcctcatctgatcataacagaaagtgataagtttgataaaatgtatattgtacttactaaaaacaattttaattatttatcaatttaaaaatcagttgtttaaccttctctctgtctttccgttttctcatctaattcccaataatgttgccttttaatttctgctgccttgcggatcagcaccctgggattttttttttgtatttgtaaattaaatattgcgatgacaagatataataattttatgtcacttattagatttttaaccataaatgccgtaggcatgctataatatgtattccttacttttctttctagaactaaatctccatacccacttcatccgtgtttttggcttatgtatgggatgctagaatggcctatctccatgtattttgttgcatttctccattgcttcttgtgttctggcgggaatcttggtgattcttttcaagcactacctgagctctgtgccaattgttcctcttctcccagggtgttgtgctgcgtggtcatgtctccacttccttagccctgtccattgacagaaccttgggttctgtgatggctgcctctaaacccttgtgaaagcggggaatattcctccccctgctgctacagttgagcaccgtgctgggtaccatgttgccctctacacttgctttcagttgttaaggcttcccaagctttggctgtggctcagtgatcctgctgtcaaaaccctgaaactttcctagcctggacactcagtggtagcagcaggtgttgggatttctccaagcccctaagactctgggaggaagagaatggctgtttgacatagacctcaggagttttcaaagcaccaagaaacctctccagaagatatgtaaaggtaagattctgatttctctaggaagccgttctagaagctaaaaacaaaaccctgtagctatggatttaatataagttagtagttaaagaatgtccttgggaaactctgtgtttgatcaaaccaaaatatgagtcttagggaactatttattaaaaactcttataggaattttgtgtgagattcacattagttttatttatattaaatttggcatggaacagatttttaaatattcaattttttttattcggactctgtgaagcactttttcacaatctgcattgtatatctagtaagagaaatcttgttgagaattaaaatggttaaagataaaatagaaattattttttcaaataccgatgttttatttgcctctgtgttaatatttaaaaccaaaaacatttaatgaatatatcttcaaattcttcaagctgaaattcttaaatccataattaattcaaaaggaattagaagagcagttcaaatcttagttggtagtgctagggatgcattactgtcctttgtcaaaagttactgcttagtattctaactatggtgatttcttgctttatttttagattttaaagggaaaaaaattaaaataaaaaaactttttgggaaaaaaattcactacatatggatataaataacctgaatggaggatacttgtggagaggtggtaagggtgtgtgtgtgtatgatgggtaggggagagagatcagcagcatcttaagttaacaatacaaaacacctcttcagtgttatgagtttgtgacagctgttattcagtgcccccttccttttcttttttttcccccgcctctattttcaggcagtaatctgtgaagtgatattaagacacctcttctaatatgagatcattgttggccttactgtcagtttaggtcttctttttttcgcccatttgttttcttttcaatattaacttaattccttaaatggtttccccttgttgaaattaacgctattagcttactaccacattggagccctttaatttcaatggccaaaaatgcaacttaatttttaaaaatgaaggaaaatgtttactcatagctgaacaaaatgaaaaatattgatctttgacagtgtttattaaggatgctttttatttttagtaaactttatttttattgatatttcatttaacataatttcagagtagctctgtgctgtaagatgagcaaaagaacagataccctaaatctcaaagagctttttctttcgtgtttttcttctgagtagggcatgaggtttcagattccccagtgttgacatctattattttctaccttgagattttacctatagacacagaaagaggagataaaaaggccaggcatggttgctcatccctgtaatctcagcaatttgggacgtcaagaccagaggattgcctgaggctgtaagaccagcctgggcaatatagcaagacattgtctcttcaaagataaagaaacgaacaacaacaacagtaaaaaactgggcatggtagcaggcacctgtagtcctagttactcaggagactgaggcagaagtattgcttgagcccaggaggtcgaggctgcaggcatcactgcaccccagcctgggcaatagagtgagaccttgtctcaaaaagaaaaaggggagataatatcaacatgcaaaaactgaacaatagtaatctcttgtggtgtatacttgccacctctgtaagattgtaatgacaatgactgagttttttcctgccaagttcagttccattttttttttaagtaaaatatcagactatgtgaatttatagacttatttctcagagtatattaaaaatagtggaagttgggagatttttaattcttcatgagtccaagctgagacatagctacaactgacaggatctgttcaccatacatacttccaagtttggaaactatcagcaggcacctgcaactaaacccacaagcgtaaatgttccagagtgttagaatcttattcgcataatacctagcaagatcccagatgtaaacgggagaactcaaatgttcctttggattccgtgatggctgagaagcatccaggcctgctaactcactgaagaagaatccagcagaaggggactggacagaacctacttttgcataaccactgatcccacctaaagcagccagtgctgcatagacaaagccaagccagtataaaggcacctgtgggccagggtccatctgcattgttctcttctaattctctccagacaggagactgcagcaggcctgcacctataccactttcctgaaggtctgggtaaattgatgaggggacacaaactgtacgatgcttattttttaaaatgaaaagatgtttaacaaagcattttattcatatatgaaaacattcaagtttattccctctagacttcaaagtataactaaatgaaatgttttgaagtgcattaaaatgggtaattctttcatatataaaaacagaaaagtgaaattttcatgcttttattaacacttatagtgagtttataattttttaaaatgtgtggcacagtctcaagctagtggttagcattatttgcaagtttgtctatagagtgcattttgtcttttctatttctagaactcttaaattcccttgggacaagaaatgaaacaaatataagaatgtaaattatgaattctctttcttggaagtttaattttaaaaaatagtttaagtacttttagagtgggaatttagaacacttaattcacaaacagtatgaagtacttaatcactgaaagtattagaagtgagtgttaattctcaaaataaggtctcaatcgcagtcataatttctataagaatttctgccatcactctgttcataagactagtactgctcaattcccattgtttcctctctcccttctgttctgttctgtttttggagagcatgggagctgtccataccggtaggcaatgaggagaatgtttataattgagattgagtaatgtcaaatataagccttttatgatacgattatttcctttgttgtaataaatttctcagcctcattaggcatatccatgtagaaaataaatttaaaaataaagtgtgtacagagcagctaaaagaggtggcaaatatagggatgagcccagatagtgacatttttggtactttaagggactgtttcacttcaaaaacaaaatattcctgtttattatttttaggtggaaataaaagctcactgaatcagaattattcaaaattaaaatggtgtctttagttaatggtagtaatgtatggattaccttttaccttcagtcccattacaatgattattttatttatttttcacaaaaacaccttgaggtgtagttagcattatttcacctatacaagtgaggaaactgataccaagagaaacttggcctcacagctggacacaggattcaaactcaggaagtgtggctccagagtccatccatccttagaggtccttgttagttgtaaatctggcagtgagtgccagttctcaaatcagtcctaacccttttcatagcctggtaccagcaaggggattctgtctgcacctccttccaactcaattttgggttgccattcacttgctggctatttgacctatcctctctcagcaataatcccaccctgtctaaaatatgaataatattgtctccttctcagggtttttatgaagatttaattttacgagacagagtatgccaagcacttagcacaatggctagcatatagaaaatagccaataaattattgatgttattatgtaatgtttccagggtcacacaactagaaaaagattgagtcagaattcaggcccaactctgtcttactgggaaactaaacaaaacacacacacacacacacacacacacacacacactttccacaaacaacaggacctacaaagcaaaactcgtgctctttctggattataacactacctctcaactctaaccataacttttagatgagtaaataaggatgtcatgtatgtgctgaagggataagtagcatagtttagtggcttagggcaaactttcaaattgaggtttccattgtgtgacagcaggcaagttaacccctctgaggttcgttaactacacatattaaactaaaaacagtatcagttgtattgcattatcatggataataaattttaatacaattaaagagctccaataaatgttggcttttagtaattgatatagatataaatgtttctttaaaaatatattcacaaaattgggatgcatagttagtgaaatcataaacatgtaaagtcttagagatggatataatcttagtagatgatcttccatttttgaacagtctgtatgctttctctgtcaaatccatttaacctctctgaaaggtcagtggagaaaggggaagaaggcatcagagatcaggactgacccaaatatggggtggttgtacctccagagatgtgggcaaattttctcagtcttggcttgatgtcagtgactagcattggaaaaccagatggtggaaataacccctgttaagcagatgatgggattatcaatcttgtgttctttctcttttgaagcagaacccaaaccaacggttgggactccagtcctgaagagagagagagttacctggactgagttgaatgccagagtttaaccttgaatgctagtcacagcagggacttcttgaattcttggagctcaagtgtctggcctgccttactagattctgaacaccttgaggttgaggatgtgtatcataatatttatttgcaactttagaacagtgtctgggaaatagtgggcacccaatgcatgtttgataattaaataagagcataagatccagaaacggtacagaagatcttgtttaaggatcccaagccatcaaaggggttagaaatcgaggctgcagtgcagaaagcataggatgtcctggggatgggggtgggtgccatggagctgagggtgcataacatttgtaatgacgggtttaggaactcagtaaactgaaactgtcagtgtagcctattcaataaatgtaggaataaagtattccaaattgtttaaaaaatgttgtaagcagatgacatatttaaagaattgaaagccattggaatccatttatattagtttttcatacagtgaaaaataatatttctggcactagaaactcaatttggtaccagagacttgaggaaaaatgtatttataaatgtgtcattgatatattcccttataaataagttattaaatagggttttatgtttataatattataaaattgtaatttgtatgtatgaacgttaagaacttacatggatgatgggggaagtaagagtggaagtgtaaaagatgacctttttttggggggtgactggtataactttgaggtttgttttttaactataattttactacttgtttgatatatgtttcccagaaatatggtgaaaacatctttcagtcagaatctaagttaaaaaacataaaacatagtaaaaagaacaaagagaattaactatgtttggtctattgagacaacaaaagaaaacacaaagcacaaactcatactttttttcggactataacactacctctcagccctaactgtgccttctctgataaatcaggatgccgtgtgtactaatgggagatgtagcaaagtttagtggttgccacaaaggtgattttaggtagtcctaacaggtattgcagtgatttggcgtggtatatcaaaagccagagacactggtaccttgtattaaaaccctggatattgtgtgctggcacctgaaggaaggttgtttagaaaacttaaactgagagtaaaactcaaaccaagtgtttccgtgaacatttgtgtcttcttaatttgaaaaaggccatgtattaaaccagtgctcctgtcagtgtggaactttctggtttctcaagaagagtctcttaaattaagcactaagttaatattacacatttaaacattttcgctttcgaaaacatacattgttgtgaaagtaaaatattaaatgtagagagaaattatcacttacacgtgtaccttattttgtagactatagagtccatttgtgctattattattttcagatgtgcctgtaaagtggcttcttttgctgttcttttcttcctgctctctctgtatacacaaatgtccatacagatggaaaggcacacaaagacacacagacacccatgcttttgcttttactgtaaaagagtcatactagagtagaaattacgtgacattaattctctgtaattctctatttctttcctttcatggctatgtatgcctgaattgtatgtaggtctagcataccatttgggcatgaaaacgttgttttacttcacttaccctgggagacttttttttttcctaaattcctaatgcctgtttttaatttattttggcaattcactgtgggagttttaattaggtagtatgtttgggttactattgaagcagtatgtattaactaccaaaagttaaactcatcgtaaaaccctttacacatgaaataacttagataccttgagtaccagcttttcttttccctgcccttatcctggatgtgtccttggcagtttaatctgctttattttactcctttaaaagcgtaagatggaatggctcaaataaaatcagtgggatctctccctgaggagaattttgtcatcagaaataaaagtgacaacaccaagaggggaagtgttataaataaagtgagtagtgtttggtaatcatcaccattcttgatttcctatgtggaaataggactttgatatatgcattttttaaagcatcttgcaatttaaaaaattacacatggaacaagccaaataaatatttttaaaatactgtttttatttagagagagagacagctgtataaactgctctgtgtatgtgtaaaacattgataatacattagacataatttgcagaaactactaattttcacatcatttccaagtagaactgcaaaggtacagtactggtttagctttatggttaaaagcattggctctagagccagataacacaggctcaaaccctagttctgccgtttactggttgtgttaccttgggtaggttacttgacctttttgagcttcagatttctaatctttatttaatgagttttaataatagaataataggattgctttgaggatcaaataagttaataaaccacttagaacagtgttcaataggctggatttttgtttgtttgtttgtttgttgctattctttttgtgttatgttttgtatccagcagaagtggttatttagcttcctattttatgaggtaggactgatgggaattgacagtcttaggaaaaagtacaactgtaagtcagtggaagtttttcctagtcaagatgtcaaatgccagaggtcggattcatgtggcaggatggggtccaaactgtacaaaagcttggagatgaatgaggtgagacagctaagcttaagacaaaaaacaatgtgaagttatgtccttgggcagtgtttgcagtagtatagtgccgctttggaaaacttagaagatgatcctcaactgtgtccactcaaaatagattgtgcatctcaatgtcatagagtcagaaatttctaccactatctgtttaaatcatcgtttatttatattccttaaatattcatacctttcacataagtgagatacattatttttaaaaacgcagttttccttcttgattttttcatattgtcccattattctgagaagagtttattttatgagaattaagttattatcttacagaataaatctgattactgactagatacaagataaccacatatttttcctagaataatttaattccaattttacttatttgtaccttatatgacttattttcaggttagaaaaatgtggtcctacagttttgttttgaagtttgcctgggccatgtgaagccaccattatcatttacgtcaaaaatgaaggttatctgttgcccaagagaaaaatacagcattctcaatttaaaacactaaaatagtgagggtttcataagctgtttcagtgatttctgaccttgggttggaaagctctcatgtctcagttacctcagtgggtatagtgacattgtcccagtctgcattaccaaattgtttcaaatcactttaattaaaaaaaaaaaaaaaaaccagtcatggtgactcacgcttgtaattccagcactttgggaggctgcagtgggaggatcgcttgagtccagaaggtggagacaagcctgggcaacatagtaagaccctgtctctacaaaaatttttttaaaaataagaataaattatctatattgtaatttcaaagtttaggattgagagattgagctcatgctttttagtgtaattataattttggagctatgctgacatatttgtaaacaaacgcttagtgaaaactcatataacaatagaacagccaactatactgtattaagattgctacatgagaagagttccctttaaaaaggaaatttcaactcagaggaaagtttgatttgtgttcattagagaaccaaaaatatttaaaaatattttccatgagttgaaaagtaacatgaaaaaaatggattattttaaaagcattaattgacactttaaaaaaatatatttttatagaacctcaaattgagttaaaattatacttttagtcacttttaggttatagttttcatatcaaatgtattttaaatttaggttttatgtcttttaagtcttcaaataggccattttctgcctattgctcaaatatgtcgacctttatagcatcaggtcagtttacactgaaagctttcaatgtgtttggcatttttaatggaagtcaggagctttacaacaaagaacacagaaaatcatgtaagaagacagtgtgaaaaagcactggacttggagtcagttatttggcttcctatgacaggtccccatttgatcaccatgttactctgtgcgtgtcatgttttctcggaagtatacctgccgccatcttgactccttggttgaacaaatctaataaagataatgcacagcacagtactttttgtaaactgatactcatctctgtgaaataattcatttatctgaaaagcaatataaatgcatgtttaaaaatatactgtgaaagtcaatatttttatgaattctgctcatgaatcccacaactgtatgttgttctcatgaacagtaaaattgaaaatgtaattattgtttttataaggataattggtagtataaattttaatctatttagaataacaggtgggtgaaaagaatacagacttttcctccaggatgagtcatagattttaaaaattaagatgatatttaccatttagtctacagttttgagaatgatagttctattgcttgaaagagttagataccttccaaaagagaaaaggaatgtaatgggaggagagataggcaacagaaaacaagcatctgtcccttatggagaaaaatgtatttttaacagatactagagaatatagaagttgctatatcaacaaaaaatttttatttgctcaaacaggtggataagccaatgtgtatttactgaataaatgagtatgtgctagtggaaatcaatgagtgagtgaataagtgaacaagtaaatggataaactcagtaggtaacacattattcttcctgtttattatttttaggaaacaatacttatttgaaagtattacaaagaattcacttaaagaaccctggtgaaattcctcattttctcttgtggtaataggcagttgttatagtacagtcataatcttttggttgtaatttattatgtaggttgaattactctacatttacagagcttttgggaatcaggagatgagaaaacacaaataataagcaaaagggcagttagtactatcctaaaaataaacattggcccatgtaatcacatcctaaataaaataaactgaagtgggttaagaaaattatagcggtttagaagaatttagtgtgttttctagccccattttcatttgattttgatagtaatgattattaaaggaagacagagtactttgtacttttaacatttagccggcagcagcaattgcagcaatatccaaagtgtattgaatgtctttggtgtagaaaaaggcactggacttgatatgatcatagaaggtttttaagtgcttgagaaaaaggttggggaagcaggtgaaatatgagattagggcttgttggaagtcttaggacattacagagagcataataagtcttactacctcctgggaacagaatgcatggttacaaaaataaactgaggtggaatttgaagagaagggaagaactttggctgacagggaagcaagatcaggttagcaaaaattctggctatcaagacctctcctggggcccattccctaagaatgtatcccttgtgctaaatagagtatgtatgtacaggcacactgtacatgtttgaaatacttgaataacagttcttcagggattactgtgtaattatttgtatctattgcctttatcttagtgctgatttatggggctagattttgacttaagttacctacaatgtcttgtttcatagtttgagaaagtacataaacaatattgaaaaaactaaacatcagtggtgttatttagtgaatagaacagttggaaacatatcttatttttaaaagaatagctgaatgtgacatatccatggcatgttaaaaaatgaaaaaaaatggaaactgactttgaacagattattgaaatgctagtgtataatttttctgagttgcactataaaaaatttttactcttgcaactagaggaaatcactcaactggaagtgctggatataatttctgacttatccattagtcatcctaataataagaaagtatttagttcctttttttcatagcggtccatcttaaacaataaaattacatagcccactcaaagatatttcaggaaaattgaggtgttgctttcaaaaaagtattaaaaagtgggcacagtaaattgtctgtgtgtgtgtgtgtatgtgtgtattttaatgctactgtttttatcattcatttctcatcatgtagataggaaggttagcagaaaattaccttgagatttatagttgggatgactaggcctggagcattgccctttgctaagataagaaatataggtgttaaaattgatgttttctctttctttttagggagaacatgtaattggtttgggagggttgaatttaaggaaaaacatctgaaaccctcttacacagactgatagtgctgtgataggaagaaaatacccagagagaatgtacagtaagaagaaggaatctaaagacaaaccttggcgcatctctctataaccagcagtcagaaaggagggaaatcaaaagaaagtgtcagagaatgagtaggttaatacatagcaggtaaatgaggatggtgctttgccaaggcaaaagagaaaaacattcagaaagtaactagttattctatagagaagacaagaaatgagaaaaaaatcactttggctgttaaaaggacagtagtaatctttgaaagcagatgagtagaattgggagagaggaggtagaattcagattgtaaaccagattccaagaagatgagtcactagtaaattgggaggtaatgcatgaggcctcaacacatgtagacaactctataaagaaattcaataataataagagaagtgggagtcagctgaaggattcagcacagaagaggttgttgtagagcagtgagggttattccactgcagaatagtggaagcatgtctttttcactaagggaaggggcagccgtcagtggagagtgaaagaatgaatgacaaatcgctaaaatagggaaatatcagagaagatgagaagggattaagaaaaagtgagttagagagattggccttgaatggaagattaaccaaaaacttcctgagagacagaaatgaaggtgcttagccagattccattccctaatactacctgcattttggtcatccttgtcatttgggtggttccatgccttgggtccacactcctttctttactctttttaaaaatattttattttaactttgacttatagacccatctcgatagaatttcatgagggcagaggacatgttttatccatgcatgtgttctaatgtgtttcggtaacccccgaagtcagtgctcttaggggaagaagtttcatagccctgcctatcgatcatagtacaaggctgatgactaattagctacctaggtgaacctcaaaagctgtttccaaaacaagtcctcaatttctaatgaatggggcagattattatgtatcagacttttttttttcctgtttttggttaataaagttactgcataacaaaacataacttagagttcagaagtggatatatccaaagccagatagaagttgtaactataattcattgtaataagtagaaacatttaactgaaaaaaatgaaaagacaaaaatttgcaaggcaaatagttgttaaatgccatggtttataccactatgtcaaacaaatgagatttcattatgtcattatattttgtctgatccataccataagcacaaatcccttgattagaatagttggattgcattttctgattcttacatagcaaaaataactctaagcaaaagttaactaaatgttgtctgcctctcatgtagaaaacatgttttatgttagtgtttgttttatggttgctattttttctgtaagttattagttttcgagttttattaaaggtgtaatttcacagttggagtatatttgtcaaatcctgaccctttttacttgtacatatatggtacaacaattttttaaacacctttttatgtgtaaacacttataggaggggttttaaggtagtgggcttgaagtcagactgctagtgtgttgaattctggcctcaggaatcactagctatgcaatcagatacaagttactataagctgtagttgtgtcatctgtaacactgggttacttaaaattctttgctgaagtgacttttaagatatttaaatgaagtgaaacacaaaaagcatgcaaacagggtctagcacatgataaagccttattaaatgttagctactattattatattttcagattatattttggagattcaaaagtacttagtaaatgtccagcattgctctaagcatatacttggtctctactaatccactttatttatttttttcacaaatgatcgataatctatttttcaaagtacagttagacatagaaacattatgaactgtctaccatttttatggctttagactcaacattatatttgaagtgaaaaattgtagctattttaattcctaaattatgtaaagctataaaatgtgttatgttagccagttgattttattcctcctgaaaatactttgttttatttctcttcagaaggaaaaatagaaagataagacagtaaatttaggatgagcaaaatatggccgatgacagctttcatgtattcattttttcatgttttaaaaattattactatcactaatcacttaaaacactggttgattatgactgttgtacagttgcacagacatcttgttttcttctagagagtcccaggaaagcatgagaacatcatttaactacactagaattgtaaattaaaacaattttatcctggctcacgtctctagggctgccttgaaccactctttagtgtagactctcctgtccaacctccctggagtttttaaaacacatcgccctgtctcacatttctgtcttcacacaattttcttttcataaaaattttcccaccctggtttttttttgctgttgttgtttttttttggttgttgttgtttttaaacttacgactcatccttttagactcaataccggagacagctcctctggggagtctcccttgatcccctccatttcctaagctgtgggaaatgtctccgttagtaacccacatcagttcctgttgcagtcatttactgacctgagtcctctgggatgcagcagagacacatcatttgccctgcatgtactgtggctaacactgttgtgtcagtgctcacttagtgttggttgaatgactgcatgcaagaatagctgttttaatttggacattaggctaagttttatcctttttagggaggtgcatggatgtaaacttcttggattatgtagtacgttatgaaatgaacttgtttaagtctattttatgatgaatagtttacaaacatagaaacaacacttgtagtaaactctcttaaaattaaatccagacagatttaaactatgtgtgtcagatataattttttgtcttttatatgagagtacaaaagtcagagtactctgtgatcagcgaacaaaaacacacctcagtctcagaagcttatcctagcaaaggtgtctttctttctcctgtaaagtcaatggtgtactctttcatccaactactcaggaatccaagcttactctgccttcctctgatgtgtggcttccaaagtgtctgaggctgtgtcagagagagatgggaaaagaacattggtttccaataatctcttctgggaaatcaaaccaccatttacgcttagtgtcttttggctagaataatgtgccaccaacttaatgcaacagaggctgaaaaggttgccttttagagtagtcaggcagaggaaatagtgcgtaggaattgaccaagccactaggtgatttgtctccttttttgtgtttctatttttgatttatttaatttttttgtgatacttgagggcctggatgaatgatgtgaggtagataccactgggtaaattcaagtataaaacataaattctatactaattatcaagcccttgtcatatcttaggcatattaattattgaagaagagtctatctcaacaaatccttttttttttttttttttggcttatagtccattttgaaaatgtggtagacattttaaaacatagtgcacatcagcatgtaacctcaaaatctggcatgcaaattcagaggttcacaaaatctctgcagcccacccactgtagccttcccagagttaagagcacctggcctgtgctacatggattggtgaaatattagaaaagatgagagaaaatcagtatgagcataaattttatcttctttttggtgagtactttgaaagaaaattaggacctaatcccctagtttaagtgaaagaggtaatttggttgctacatgatagagattcattgaaggagaaagaagtagacagtagacaaagttgttgttcaaagtataatcaagagtcaggcatccaattgaggtctgaacaatagcttttattcatgttctctcaccagtctgtgttacatgaagctttaatgatatttgatgattgaattcattttttaaaatagctgcattgcagaaaagtggtttgctattaaaatattacgtaccttaggagactgaggtggaaggattacttgagcccaggagtttaagacaagcctgggcaacatagcaagaccctgtctctaaaaataataataataataactgagcatggtggcttccgcctgtggtccctgctacgtgggaggctgaggcagaaggatcacttgatgccatgaggtggaggctgccgtgaggcgtggtggtgccatggccctccagcctgggtaacaaagcaaaacctgcctcttaaaaaagaaaaaattacgtacttgagtttggatcatacagattaatgaaagaactacaaaagatttttactgcttaattctgtatttggggtctcttcatttttaaaaataataaagcaatttgctttatcttacattggggttttatattcccaattatttcaccttaattttacaatttttactatatgaaaaaaaaaaactgccctgaagcctttggtttatatagaataaaatagggcacatattgttgtgtaagaaaagtaaataccaacttagcatgtttaatcatgttgtagaattatgtattttcagagataaatacttgttacttaatgtcagttttatagatgaggaaattgaaattcagtgtttaaatgattcccccttagtatttgcttctatagaaatttttacctgttttcactctggtttctcttcagatcgtgtaaatctttcgccttttactaaagaaatttttacctattttcagcagttttctcagtgtattgtaattatttcatcaaaagttgaatctccttaccaaacttgggtactactgaaaggcagaaatttctgttattcatcattattcctccagagcttggcatttttttttatgctcaatacattgagtgaaggaatgagcaaacaattaaaagaaagtatgacaaaaaaatcgtaagtgagatccagtctctgcccaaatgcctgagaggcaaaatagcaacatgattggtgctgggactccagagccaggcttcttaccagcttgacttcatactgtctcggtcaacttggcaattgatattatctatcttatagtgttgttatgagaattaaatgagttagtatacacaaatgcctagagcagtgcctgcgtccagtttaatttggctttacaaatttaaacctgcaaggattatgtaattagacatacataaattttacacaaataaaaatcagagtgaatgtaatttgacatcagttgaataaaatgaagcaaaatatcataatctttggtttattactgtgtatttggtaatcctggaaattgatacaatttgcattttagtttaagtgcatgttatttaagtaacatttaagttttataagatcatggaattaaccattttttcgtatttttcaattagaaaaattttgtatttttacaattagaaaagtgtaattttttattagtatgcaacagatatgacacagctaggctaaatcaaattattacatatagtccaaaatttagatgattatactgaatattagtattcacttactgtactactgaagagtcaacatttcaaagctaatgatgaaaattatctactaagtgtgtgactttttccccaagaatgatttcatctgcttccaccaatttcagtattctagttgatagagtcaaaatcatagcatgcggaagcagcacaagatatcatgtgcaacatgtgttgtgccaagtcagtaaacagccatcgtaggagtggccagcgtggccttataccttactagaacccagagaaaaaagagcctgctttttaaagagaaaggcaaaattgcttctggcctccatttcccactctttgtttctcatgggaagaagcaagaattccagaatcgtgtgaaattttcatggttttatgaaatcattctctgagtcattaaaatgtatgctaagaaaaaaaatctaacttatgctttatgctcagatgcaattttaatagtctcaaactaagataaacaaatatcccagcacacttttttaattaaaaaaaaaaagcacccgaaaaacttattattctattctttcctgagattgactagaattaatacttttcacagtttttatgtgccaccaatagcactaaactttttaaagggtattgtctctttataaaatgtatcgaccagaatctgcttcttaaacagtggaatactagaatgtgttacagaggtgaggaagcttctagtaatccaagtttgcctgacaaagtccactctttaaaatgtcctgatttatttatttgagacagagtctcacttggtcgctggagtgcagtggcacaatctcagctcactgcagcctccacctcctggaatcaagtgattcttgtgtctcagtctccctagtagctgggattacacgttcgcaccaccactcccagctaatttttgtatttttagtagagaccgggtttcaccatgttggtcaggctggtctcgaactcctgacctcatgatctgcccaaagtgagacctcggcctcccaaagtgctgggattacaggcgtgagccaccacacctggccctgctttttcttttttaaaatgataaaaaatacagttacttttattctgtattccagaggggatctgggcatatgtgtgtagtgtgtgtgtgtgtgtgtgtgtgttcttactgtaacccaggtatatcttaatgcaaaatcatgtgtttcccttgtggtgttaccatacttataatatcaaatgtggtgggtcctgtggtagagaggcagtctgggaatgagtagacctgattttaaacctccaattcaccatgctattgacgtaaatgttggtcttcactttactcattttctcaacagagatcatgtcatcctgaattataaaacatgcctggcccatctctccaggctgctgggagaataagaatagagagcccagtgtagtacaagcccagagagaacttcaagaatggtagctgtggtttgtgaattattagctactattcttaatagtgacacaaggacggaggcaggattcagttttcagaagcccacagttatagtcaagaccattgctactccttagttatatgatctttgaacggactttttacatcttagagccaattttcttatcgctaaaacaaagttgtagcatctgccatgattacttcaaatggctgttgtgagttgtgtataaaataatactgttttgtaaatataaatcatgatagcagttttctcatgctttcttagtactacatttccaaccctgagatggagtgttataggagcagggaaatcagccacgggtgggtgtgggcaggaatggttaaacactactgttatttcagtaatgtgataattggagttttaagggtatgtgtgtgtgttttgggaaagtagagtggagcaggagaaagggtatgtagacaactgtgttagagaaattgaatctcagatggtgagtgttttattttcccaccttactcttgcttctttaagttactactcccacaggagattggctatagactgacatgagtgagtaaagttactcattaggggaatctaagcttcagtgagatgataagaaagtgattgaagcagggagctgtgaagagttagaaataaggttggctcatggcatgcatcatcagcttatcaggacatggatggtggcagagaaaggaagaaaactcattgaaataaatatggggatttcaggggtccatggagcagaacacacttgaaaaggtcaaaatgaagttagaagggtgtgtgtgtgtgtgtgcgcacgcacgtgcgtgtatctgtgtctgtgtgtgtataaattaaggaatgagtatgcttgtaggacgtatttaagaaaaagggggtttgttaattttagtcttctaaattttacacactacatcagtgaggacagtttcaggtatcccatgaagagcgaaatgtgtataaagagagatttttttaagcttaaaagacaaattatgatttctgaagttttgaagtcatataaaagtttattcacttcttataaatatgttattatctttgattagtgatattttattaaaggtacttctcatttttattcatatttaaacataaatgtgttgatgaagatagtgatggtaatgttaaatcattggcttcttgagaattgtgtagtcctggtatgtgagagaaaaaaagacaataaatgataagtgactcattaggataaaggatagaaaagagagcaagaaatatttgaaaaatatgtatttcatttactgttaaatatccagttcaattagttttccctgcaactagatctatttcctttgctgttaaggagaatgaattgagatatccaactgatgacattctgtttttcattttttccttttattcatgttgctaaagcatgctttgcttcttccctgattatggattacataaggaagcactagtttaactatcttttctaaaaaagtaactaagggattcacatcagttaacctctgaattacaaaggaaatgttgtggacattattattattactattattattattattattttaatagagatggggtctcactatgttgcccaggctggtctcaaactcctgggctcaagtgatcttcccaccttggcctcccaaagtgcgggaattacaggtatgagccaccgtgcccagcctcatctggtttttaaagtaataaatacacatgctttaggaagatatcagttgcttaaaagtacattaacaattaatttcccttgaaggggaaacagtttgactcattcaaaagctagatttactgcttatgaacaatgactaattatttccctgaagattaaaaccttatatccctgaaataacacaatttaagtttatatgcctattatattatttgagtttaactacatgtataagcaagaaattgtttttgcattcttctttgctgtcactagcagaagaaactatatgtattttgacctagtaagtttcaagtcatttgatttaaaaggagaatccaaatggatttgcttatcaacagattgccaaactaaaatttaaaaaatagtatctccatttctcacataatttttatttaaatattattcaagtctaaaattccatctattatttatcacacaattcttagttgactcctgactgtctaggtgagatggatccagtggtatcctggtaaatgtttaccaacctgctcttatgggggtggggaaggagacactgatttgtcaggtttgctgatttctgtggtgcaggcactaatatcacagacttaaagctacctaagtgaaatcactaaatgtggaggtaagaagagatgctcccaatcagctattgccagccagtgtaagctggctcctgcacattcctggagaggccaagatttgagaatcccaggattttcattctgggatttgagagaggagtataataaaagataagggatggttctagatatctctgatggtgttaattaatgtgattgctacatgtgagcataggtgctccaggccctttcttctattcagatagaaaattcctcagtgattcatagtggttttaaaagctaggagagagttcagacattaggtaaatcatccctgttttatggtgcctatcttttcttcatctgcagttagaccagtctcactataaaatacaaagcacaataatacacagaagctatttacaagtgagatttaaaaattatacttactgccttttgaaaacattgggctttttcctctctgttcagctttgcccaggatacctgttagacaagtcttcagtatattcttttggctttgtcatgtcaaccacataccttggccaggtctctgatgatttccaaatgtttaatcatcctaatttgtgatatccttgttctgtcacttttttagtatcttcagcctaacgtgtcttgaataggtctttggtctgtgcttataatcaggttagtagtcctgtcgtttttccctcctccaataaatctttcatattttaaaggaaaagcagcttccttgttaaaccaatcataacaaaagccccacacccttatcccaaaccttcgtggttaagattaatgatagctgaaaatcatatacccgtttaataattatcttggtaatgttaataaaaattttaattgttttcattgaaaaaaatcaaatatgaacaatccctccctgcctgtgccatttaggtcacttactcatcctggaatcccctgatcttcttcctgtccccatctctctctgtcctttaagactcatctcaggaatcatcctttctatgatgccttctctagttaactccctctgctcccaggcctgattgggggttcttctcctatgcttcttcttagggctcccatagaactctgttgacccttcattaagtagttctacatttattatatctgctgtcattttctcctcagcttttattttgaaaaaaaattaaacccaacaaaaattataatactagtataataaataccatataccattcaagtagattttccagttgttaacattttgctgacactctccgtcatatacatttttctgaatctttaaaggaaataagttgtgcatatccattccttttgttagtcaactttatctagattttgcgattcttagattaattatacttaataatttttgaagatttatttcttgatttattcattcatcaaatatatattaagcagctattatgtaacagatgctaaagccttgaaggtttcaatgggtacatagcctgattacaggatattttagatatatatgatataattatgaccagatcagatgaggaataaaatattaccattgtaagtgtagaaaaaaacccatatacccagatctatgaaagtgtcatcactgattcatcattgattcgttcagtcaccagttgtctactctgtgctgttctatgttaggtgctgccagagactgtgggtatacatttgaggcttcttacccttaaagaatctcatctcacatgagagacagaagattatccaagaaagcagtggagtatgaacatcagtggagttcccatggttctatggaaacagaagacagagaggcaggcagatctttctgtgtagttccagtgatgcttagatagtaatttgaaggataagtagaaggaataaactaggtagataaagagacagaagacatacgagattgaggcaccattatattttaagtcaaggaagcatgaaaaagatacaagatgttccagaaactggtggcggtttaatacaatgggaggggcaaatgctaaggggcaatgatgagaaaaggaaagacacagggctagagggttaggcccaggttatgagggactttgtgagttaagctgaagagtttaaaagctatggtaaacccatgaatgattcagatggataatgatagataccagatttgtgtttctaataaggttatcctgaaaaagatggtggaacaaaattgatcttgatgtcttgatagttttaatttaggtagattaaatcttgctttaataggagctaactcaaatattaaaagtgattcaaaggtgattactgtacatttaataaattatccagattattgatgcctcagccaatttatcttacctaagaattttattttcttccacattgttttcttctaaggtaaccagcatttaaaattttaaaaatgtgttgctctcagcaaggagttagtagtttctgcagctaatattgctgcctgaaagacagaaagagggaaaggaattgctataattagacacctggctttgtaaaaggactagatgtcatttagagcattttatttcttgctgcaaaactctttctgttgagtaaatgagtaggaattaatcaatgacaacatgacagtgattctggaggttttataatggatgtaatgtttttgtttattagatcaattaagcctgattgacttgcagattgcagcagctctgacaaagcacccattgcttataacatttcaattctctgtgctcactgccgcgcggatccactggcaggatcagcaggctgcagggatcttgtcagagacagcactagtaggggtggtttgcgcagatgtcaaaagtcatatgatgtagattcaaaaaagttacctagttgtattagtttaacactttgttttaacagttttacactcctacagtcagatagcatagttcatactcgaagattaatacaccaaaagagcttattagtttgatttctgaaggatgtcaaattgttaaatttccatgtagtctagggtttcttagcctcagcactattgtcatcttggacccgataaatatttgttgtagaggggtgtcctgtgcattgtagaatgcttactagcatctctggcctccacctgctagtaacagttttcccccaacctccagatgtgacaaccgaacatatctctgggtattgccaaatgtcccatggtaggcaaaagtgcccctgcttgagaaccatagttgcagacatttaacagttaaagtaaaacaaaaaaagtagttcacttaacctttccatgggctaattgtatttatttatttaaaaatctatattgatacatctgtacttgtagagatatagataaatgtttggcactttgctaagtactcaaagttggggagtattttatagaatgaacaaatctgaaagatccatgcaattggctaaattaatgtgtgtgtgaagtttccatgtttttaaaattaagataggcaggaaactaagtcacagaaatgggtatcaaataaaatagatgttctatttaaaaattctatgttttgacataataataggagaaatagaattgcatatgtaagaacatcatcagaagattatctttttcattcatggtttgcaatattggaattatgcatttgttttataattttatttttatatgcatgtttaatatatatttttttcacttttcaaatggtattactagcatgtgaaaatagcactgagggatataaattgaagctgttatgggattttatgtggaccttgcacaccaagagcctgatctttgttttaaaatgttgttaactcagtgttaaatcagagtgtaagacagcagggaaaagagtaaggccttagcagggactatgtgctatgatcattaagttgaatagaggtgtaagatccttctagctattatagaagagcagttcatggaagaccaagtttctgagaagaggaggatgaagatggtagataaatgaatattccaaaatgaaactacttgttgtctttgtccagtgttaaactattactatccatcattttcttctttggtaatcacttaccaaatgctgagcgtatgccaggcattaaggtgctaagctagaaactttcatttacatggtttcattcagtctataaaacagccctctgaagcaggtattgatagttccattttagagagagggaaactaagaattaaatgcctaagtacgggtcacacagtctgttcctattgcaactagagattaagcctcattgctatatcattaccttatttgatatattcaacaagcaccttcaaatataccacgtagtttttttaatgaaaaaatatcaattcctgcccatttgtatataataatccttatcagatcctcttcacattctacgctttttcatactctttctgaaacaaattaagaatgagattgatccttcatacagctgataacctgtgttgatacagtagctatatttcaccaaaacctttttcataataagactattggtcaggtgcatttttttccctacaatacattaaattcaagatgccctttatttttcatggacaactcctggaagctagttagttccttttgtctctaatttgattacttaagctataaaatagaggctatagtaataatctccacctgtttcatagctcaagaaatagcatctttatttagcggtgcctacatcttttatgtttaaaattccttaagacaagacatctgtacacaatgtagctatagtgtgatttacaataactttgtgtttttgttatcagcaagagatcacttacaaagagacaatacaccctttgtacttgctagtaaaacactacatagttttacatgtcaagcatatgtaaggcatggtggaagtcaggaaggataaattcattacatgcctgtcatcacatcagaaatccacctcaatcagaagtggtgtgggagttgaaacatatctgccactcaggtgatatattaatcagatttgccctttgaattgtacagtaagagctgtaatggcattacatatttatggccagaattggctcattagtggatagctttgatttggaggttaaaaaaaaaaaatctaactatgttttattttccaaacccagttttactaacatgttgtagcttctcataaaatattttgaactagtaacattaagttttgacaaaagcttgtaacctgaggggaaaaaaaattggtcagatactgtgagagagatttcaaaagaatagggagtaaatttgttattacaacagtgaaaaggaatacaatttgttattttgtgacttgtcctgctttttttttttcataaccatttttagagtttttagtaaagatccaggggacgttggttcgatgtactagcagctgcatgaaaatggactgcttcatgtgtgtgctcatctatctgtcttctatctcaccgagttgtctttgacaattgacctctcctttggagatcttttcagataattccagacactgtataatgccaaaccttaggatagttgcaggtggcatatgtagaaagcattttaattatgctacagatttgaaatagatgcaagtcatatctttattgaatttaacacctttaacatatatattgagatgaatttcctaaggtgtagtccaaaaacgcttgtcagttcattcattttgaaagtaaaatgggcatggggcctaaacaattttctgattttttttttataacccctcttatcacttgattatgtgaatagttaccacatgactattctcttcaggtttcagcaacgaaacagaatggttgaatgtttgctacttccacattgcttcattcaaggcaaaataactcacctattaaaattgtcattatttcttttctgtctaaagtctcaaagactttcccttttcaaattttgataccttaaattggatgaatctaattgagcctttaagctcagtttatcttacctaactaaattcagaggttgctaaaaggatgtactagaggttaagttagtaatgttaagcagttaattttttttccctaaaattatggcttctaaaaatggaattgggaaacccttgcttaattttacctggtgtcttaagaacagtttgtgtacaactgatataaccatgaggttgatagaaacagaactatattattttaattatgcaattctattaaacatctgttaaaaggctgaaaggctgaaagtgtatgaaatgttttttccagaaattccaagatagcttaagggaccttttttctcgtctaagatattttattagcataaaagaaaagatacacaaactcacacacatatattagtgacaggaagatatttttggacttagatataaagaaacctttcaaaatcataaacaatagagcctttgttaggacaaacatgtaaaaaggtgctatatttgctacaacctaggaggaacacaatactgacatttcaggagccttcatttcttcatctccagaatgaagtagttggcttaacactttctaaattctatttcaactctaagaaattactaactgcaaaattaaaatcagaaaaaaaagagtaattttgttgatcacagtgtagctaaaaagttgttaactaggctggtaatcatagcccgagggtttgttgttgtttgaacattgagtaacaggtttctaaccttgagtttaattaccatcagaagtgtcttattctgatgttaaaggccaaatatctgtgatttcaggacataattctttgagaaagtacacacctttcatcacatgtaatttttaccagctgatttttatagcacttaatgttactccatttcaatccatttgtcttcttattttgctgtgtgagtcatcttgccgagttctgcagaggataatgtgataccctcagcacttaataagctggcagatacatttccagttgaatgttgatgctatggaaaatttaaccgaattaagctataatgcttcacttacttttaagtggtccatgttagaagattaatgaaggaatcttttcagttcattgttatattttggaaatataatactttgataggatactttggtaggataaattataacaggtgtaagactgcaatttaaatatgtaggcataaggaagaaacaatatcacagccaattaggaaagtgagtaagcttttgaatgtcattatgctttgttgtttttgttgtgaaaattaggggcatcaaattaattgattattaatgtcagttattttagatggtgaataaagacaaattttctttagatatcatctcatttattttcccttaattaacagtgaagggatagtttgcagaatattagacattaataattttatgtacaaaagagaaaataatacagtgttcataattctgtgattgaggatgtattatatatttacataaaacaaggctgtaaattctaaaggaacaatacattagacgtagtttacatttggctttttaaaattatattttaagttctgggatacatgtgcagaatgtgcaggtttgttacacgtgccatggtggtttgctgcacccatcaacccgtcatctacattaagtatttctcctaatgctatccctcccctagccccccaccccctgacagaccccagagtgtaatgttcccctccctgtgttcatgtgttctcattgttcaactcccacttatgagttagaacatgtggtgtttgtttttctgttcctgtgttagtttgctgagaatgatggtttccagcttcatccatgtccctgcaaaggatatgaagtcatccttttttatggctgcatagtattccatggtgtgtatttgccacattttctttatccagtctctcaattgatgggcatttggatcggttccaagtctttactatagggaatagtgctgcaataaatatacgtgttcatgtgtctttatagtagaatgatttataatcctttgagtatatacccagtaatgggattgctgagtcaaatggtatttctggttctagatccttgaggaatcgccacactgtctttcacaatggttgaactaatttacagtcccaccaacagtgtaaaagtgttcctgtttctccacatcctctccaacatctgttgtttcctgactttttaatgattgcgattctaactggcatgagatggtatctcattgtggttttgatttgcatttctctaatgaacagtggtgatgagcattttttcatgtgtcttttggctgtgtatatgtcttcttttgagaaatgtgagttcatatcctttgcccactttttgatggtttttttttcttgtaaatttgtttaagtttcttgtgaattctggatatcagccctttgtcaaatggatagattgcaaaaactttctcccattctgtaggttgcctgttcacactgatgatagtttttttttttgctatgcagaagctttttagtttaattagatcacaattgtcaattttggcttttggtgttttagtcatgaagtctttgcccatgcgtatgtcctgaatggtactgccttggttttcttctagggtttttatggttttaggtcttatgtttaagtctttaatccatcttgagttgatttttgcataaggtttaaggaaggggtccagtttcagttttctgcatatggctagccagttttcccaaaatcatttattaaatagggaattcttttcccattgcttgtttttgtcaggtttgtcaaagatgagatagttgtagatgtgtggtgttatttttgaggcctctgttctgttccattggtctatatatctgttttgctagcagtaccatgctgttttggttattgtagccttgtagtacagtttgaagtcgggtagcgtgatgccaccagcattgttctttttgcttagaattgtcttggcttatacaggctcttttttggatccatatgaaatttaaagtactttttttctaattctgtgaagaaaggcagtggtagcttgatgggcatagcattgaatctatgaattactttggacagtatggccattttcatgatattgattcttcctttccatgagcatggaatattttttccatttgtttgtgtcctctcttatttccttgagcagtagtttgtagttctccttgaagaggtccttcacattccttgtaagttatattcctaggtattttattctctttgtagcaagtgtaaatgggagttcactcatgatttggttctctgtctattattggtttataggaatgcttgtgatttctgcacattgattttgtatcctgagactttgctgaagttacttatcagcttaaggaaattttgtgctgagacagtgaggttttctaaatatacattcatgtcttctgcagacagagacaatttgacttcctctcttcctatttgaatacactttatttctttctcttgcccgattgccctggccagaacctccaatgcgatgctgaataggagtggtaagagagggcatccttatcttgtgccagtattcagagggaatgcttccagcttttgcccactcagtatgatattggttgtgggtttgtcataaatagctcttattattttgagatacattcatcaatacctagcttcttgagagattttagcatgaaggggtgttgaattttattgaaggccttttctgcatctattgggataatcatgtagtttttgtcattggttctgtttatgtgatggattacgtttattgatttgcatatgttgaaccagcctagcaccccagggatgaagctgacttgattgtggtggacatgccttttgatgtgctctggattcggtttgccagtatggtattgaggatattcacattgaagttcatcagggatattggcctgaaattttcttttttttgttgtgtctctggaggtttttggtatcaggatgacactggcctcataaaatgagtgatggaggagtccctctttttatattgtttggaatagtttcagaaggaatggtaccagctcctctttgtacctctggtagaatttggctgtgaatccatctggtcctgggctttttttggttgataggctcttaattactgcttcaatttcagaacttgttattggtctattcagggatttgacttctttctggtttagtcttgggagggtgtatgtgtccaggtatttatccatttcttctagattttctagtgtatttgcatagacgtatttatagcattctctgattgtaaactgtatttctttgggatcagtgatgatatcccctttatcattttttattgtgtctatttgattcttctctcttttcttcttcgttagtctggctagtagtctatctattttgtgaatcttttcaaaaaaccagctcctggattcgttgattgtttttggttttccgtgtctttatctcctttggttctactctgatcttagttatttcttgtcttctgctagcttttgaatttgtttgcccttgcttctcttgttcttttcattgtgatggggtattgattttttatctttcctgctttctcctgtgagcgcttagtgctataaatttttctctaaacactactttagctgtgtcctagagattctggtacattgtgtgttctcattggtttcaaagaacttatttatttctgccttaatttcattatttacccagtagtcattcaggagcaggttgttcagttgccatgtagttgggcgattttcagtgagtttcttaatcttaacctctaatttgattgcaccagggtccgggagactgttatgatttctgttcttttgcacttgctgaggagtgttttacttccaattctgtggtcaattttagaataagtgtgatgtggtgctgagaagaatgtatattctgttgatttggggtggagagttctgtagatgtctattaggtctgctttgtccagagctgagttcaagtcctgaatatccttgttaattttctgtctcgttgatctgtctaatattgacagtggggtgttaaagtctcctactattaattgggtgggagtctaagtctctttgtaggtctctaagaacttgcttatgaattgggtgcttctgtatagggtgcctatatatttagggtagttagctcttcttgttgcattgaaccttttaccattatgtaatgcccttctttgtcttttttgatcttggttggtttaaagtctgttttatcagaggctaggattgcaggattgcaacccctgcttttttttttttcttggtagatattcctccatttctttattttgagcctatgtgtgtctttgcatgtgagatgggtctcccgaatacagcacaccaatggatcttgactctttattcaatttgccagtctgtgtcttttaacgggggcatttagcctgtttacatttaaggttaatattgttatgtgtgagtttgatcctgtcattatgatgctagctggttattttgcccgttagttgatgcagattcttcataatgtcaatggcctttacaatttggtatgtttttgcagtggctggtactgctttttcctttttgtatttagtgcttccttcagaagatcttgtaaggcaggactggtggtgacaaaatctttcagcatttgcttttctgtgaaggattttatttctccttcacttatgaagcttagtttggctggctctgaaattctgggttgaaaattcttttctttaagaatgttgtgccaggcaccgtggctcatgtgtgtaatcccagcactttgggaggctgaggctggcagatcacctgaggtcaggagttcaagaccagcctgaccaacatgggaaaactccatctctactaaaaatacaaaattagccagctgtggtggcacatgcctgtaatcccaactacttgggaggctgaggcaggagaatcgcttgaacccaggaggtcaggttgcggtgagccgagatcttgccatcatactccagcctgggcaacaagagtgaaactccatctcacacaaaaaaaagaatgttgaatattggcccgcactctcttctggcttgtagtgtttccgcagagaaatccactgttagtctgatgggcttccctttgtggataacccgacctttctctctggctgcccttaacgtttttttcattcctttcaaccttggtgaatctgatgattacgtgtcttggggctgctcttctcgagaagtatctttgtggtggtctctgtctttcctgaacttgaatgttggtctgtcttgctaggttggggaagttctcctggataatatcctgaagagtgttttccaacttggttccattctccccatcattttcaggtacaccagtcaaacataggtttggtcttctcacatagtcccatatttcttggaggctttgttcattccttttcattcatttttctctaatcttgtcttcatgctttatttcattaagttgatcttcaatctctgatatccttttttccacttgatcgatttggctattgatacttgtgtatgcttcacaaagttcttgtgctgtgtttttcagctccatcaggtcattgatgattttctctagactggttattctagttagcaattcttctaaccttctttcaaggttcttagtttccttgcagtgggttagaatgtgctcctttagctcggaggagttacccaccttccgaagcctacttctgtcaattcgtcaaactcattttccatccagttttgtttccttgctggcgaggagttatgatcccttggaggagaagaggtgttctggtttttggaattttcagccttcttgtgctggtttttcctcatctccctggatttatctgcctttggtctttgatgttggtgacctttggatggggtttttgtgtggacatcgtttttgttgatgttgatgctattcctttctgttttttagtttttctcctaacaggcaggcttctctcctgcaggcctgctggagtttgctggaggtccactccagaccctgtttgcctgagtatcactagcagacactgcagaacagcaaagattgctgcctgctccttcctctggaagtttcgtcccagaggggcacccgccagatgctagtggagctctcctgtatgaggtgtctgttgacccctgctgggaggtgtctcccagtcaggaggcacaggggtcagggacccacttgaggaggcagtctgtcccttagcagagtttgagtgctgtgctgggagattcgctgctctcttcagagctggcaggcaggaacatttacgtctgctgaagctgcacccacagccgcctcttccgccaggtcctctgtcccagagaggtgggagttttatctgttagcccctgactggggctgctgcctttctttcagagatgccctgtccagagaggaggaatctagagaggcagtctggctatggcagctttgcagagctgtggtgggctctgcccaattcgaacttcccagaagctttgtttatactgtgaggggaaaaccacctactcaagcctcagtaatggtggacgcttctccccacaccaagcttgagagtcccaggtcgacttcagactgctgtgctggcagcaagaatttcaagccagtggattttagcttgctgggctctgtggcggtgggatccactgatccacttggctccctggcttcagttccctttccaggagagtgaacagttctgtcgctggccttccaggtgtcactggggtatggaaaaaaaaaaaaaaaaaaaaaaaaccttctgcagctagcttggtgtctgcctaaatggctgccctgttttgcgcttgaaacccagggccctggtagtgtcagcactcgagggaatctcctggtctgtgggttgtaaagaccatgggaaaagcatagtatctgggttggaatgcaccattcctcattgcacagtccctcatggcttccctttggtgggggaggttgttttctcaccccttgagcttaccgtgtgaggtgatgcaccccccctgctttggctcgtgctctgtgggctgcacccactgtctaacctgtaccaaagagatgagccaggtaccttagttggaaatgcagaaatcacccactttctgcattgatctcactgggagctgcagacctgagctgttcctgttaggccatcttgccagccactcatattttacttttaagtgattaggttgtttgggagaaatggtgatttaatggaaaacttatccatgtttacatattttaaaattagatttataaatgaagattttcaaatatgtacaaaagtagagagaatagtgtaatataccataattcagtgttgatgattttccttatttattgatcttgttgcttctatcttctcacttttttgggaggagggaataggctagaacattttaaagcatatcttaaatggcatataatttcttgtgtatatgcatcttttacatataaaggctgttttaaaaatgagttgctgctttatagtttcttctttagaaacatataagattaaagataaaagaaatagaatagggaaatagcctagctatagaaacagcacttttaaatttcatatgtacagtgatttattatttgcaaatcatctactttttaaaagtatgatactttattatttgcaaattatttaatttttaaaagtgatttttgtgggaggtcagagttggatggagaagggtcattttcatttttgattagaggattcttgtaatgacctgatgaaaactgctctgagggcatcttcagctggaaagtatgtattactactttctgtaatcagggtcagccaccagtgtctcccaggagcacagcaagtagtcatttcccagctctattataaatcactaagtaatcacactgcagtgtcttaaacccatagagttgacagatatgcctggtattccccttatatgccgtgaccattcaaactagggggtcaacttggactcaaagtaagctgactgaaaaatgggcagcatacgaataccaggaaagtgaaattgaagtcacacttattaaataatctagatcacatttgccaaacaaagtgttcactgtggatctgaaacatgtaaaaataaatggaaaagtagaggaaggcttcagggatgcttgagctgtttctaacatggcatgtataaattgccacacccactgtcttctgcccactggcggcaaatcctttgtgttctcataggtcaaaagaggactcaggaaatggaagtaattatttttcccatgagcaaagaagagttgatttcattatattatttcttggaacttgtctgttattttcatattttatttatgtggcaaagaagatatcttctaagacatgcatattataagaagttgaggttattttttgtttgcctgtttgcttttttttcgcgacagactcttgttatgttgtctaggctggtttcaaactcctggccccaagcagccttccttcttcagcctcccaagtagctgggattacaggcgtgtgccaccacacttacccagcggagttggggttgttaagctacttttgagaatcgttgtattctgcaatgaataaagatgggtttgcccaaaagaaatttttttcctcaagtaaagcattggcactaaaaggctcctcttgacaatctgtttatagctattctcacaattaagtgtggagaattagattaattccattgaaatcataaatgcactgcaatctgtagattatcagttagtttagataaacaccactgattactgttgaattatgcatacaaatatttatagcatcttgtataaggtacttgtaaaaataaataatgattataataataaagatttagatctgggtgtggtggctcatgcctgtaatcccagcactttgggaggccaagtggggaggatcacttgaggccagagttcaagaccagcctgagcaacatagtgattggtattaggtcttcttcacatgtttggtaaaaattcagcaatgaaaccagtaagccccaggctattcttctcaatatctacaaacaaaacaaaaaagttagccaggtcttcgatgtgtgcctgtagtcctagctacttgggagtctgaggtggggggattgcttaagccctggaggttgaggctgcagtgagtcgtgattgctctgctacactccagccggggtgatggagccaagaccttgtctcaaaaaaaaaaaaagactgagtacttaaatttctatatctttttccatcttgaaaggaatattttccaactggtttaatactgttgtttaataagaataagatatatccttaaattaaacaacagtattaaccagattttgagatgcaatgttagccacatttatttccctttagccttcagaaaaatctaagtttagataccaattctttgtttcctggataaatttctccatttttctttatatatttctgctcagaactcatactgtcaggccggtatcatacccatggtatcttatattccaactataagatgcatgaatatattaataagtttttagttttaagtgtagtatgacatactttacaaaagttttcaagttcagaaatagtttctatttatgatagaaatatttaaaatgtaagatttttttcttgagaaaagactatattttgttaactttttcggattatacaagtatttgactcagatgtctcagaaaagtctcacatattatctcgaggaaacatacattgaattatgctttaattgtttatctccattgttttaatcttttgtctaatacagtgatatagttttctcttcatagttagactctcttaaaaaagaagctcttgagagtgtagttatgtgtggttcatccgtaaaataagaagctgttttagaagtaaaatgtgatgtttatggtggacaagacttgctgactaatggttgttggaaattttccatttgtcagattgttatgtagatgatcatatattaaatatagctaagaggagagcaaaagcccaaggaatctaaagaacatttttttttggctaatagtatgtttttaggaataagagctgctgtaaagaatgcagaagcctcatgtcattagctgcacgtccatctcctagcagatgagctgaggggtgccacgcactctctctatatatatacgcacacacacacgtgcatgcgcacacacacacatacacacacacatacatatatatctcttcttggggaaaatgggtctcgctgcttcacctgaagtctgcatgctttttgttccctattttttgctagtttcatttcctcacttcctcttttcccttttgttcccttttccccgtacttcccctagacttaaaatgttacatgaagttgagtttgtggctagtgatttacatgcgaacttgttgttttaaaacaaagccccaaaactgtggcagtgaggataatacagcaaaaacagtgaggctattccaagtagttgaaagattttcattgtgagtgagaagccattaatgatggttgtggttgttccttttttcaaaggttttctcatttttgataagatgatattttactacatttaatagaattatgcttagataagatgcttttttcattgaattggcctggtccttgtttttatgtgggcctttgaatctgggttgatttgaaactacctactgctgtcctctatactgtctgcagagacctgaacctgtagatcatatagaagtcgtgtaatagctaggacccatcaggtggttatagaaccgaaattaaattcaagccccaacacctccactcgtcagccatagaccgttagtaaattaacctgttaatttatattgtattatctcttatttggggacaataaaaggcctattgaatagaattttagggtctaatacatgtgaagctcttagaactgtgtatagtacacattatatagcaagaaatgtttgttgtcattatgtgttcaaaggcaaattgttgatggaattgaaacctatattgtgacacacattaacatatttggaggccacattcatgtttcagaatctttggtattgtttaaaattatttaacattgagtaaattaactgacttctacagtgacctaaatttgatctatgatcagatctatcatgttaatctattgtttcataataggttgagctatcaaatgatggacacaaggataaggtataggaaatcttcgcttactgtcttccgtggattcttggaaactatgacttgacatgaaatggagtataacaaaaccaattgtttttctcattagtgttataactaaatgaccttgaaggaaacgatattatttgaggacctgctgtatattgttttatgtaaagtaacagtttctaagaacctattggtgatgttaagtgaggactaactatattaagaatgtttcaggccatgtgggatggctcattcctgtaatccctgtgctttgagaagccaaggcaggaagattgcttgaggccaggagatcgagaccagcctgggcaacatagcaagacctcatctctacaaaaacaaaacaaaacaaaaaaacaattcactaggtgtgttttctagctacttgggaggctgaggtgggaggatcacttgagcctaggaattagaggctgaaatgaggcacaatttcaccactgcactccagcctgagtgataaagcaagactctatgtctattttttttaaaaattaatgtatgttctagctactcaagagagatatagtaatgtactttttaaaaatatttctattttgcatgatagctcctaccaagaaacgggtacaatataatgcaacaacatgtttttaatgctacctctctatatttatttaggtaggtaatagtatatttctacctggtatttatgtaatagctagacagctttttgcaaaaatctttttaaatgtacttatatcattactttttcctttgaaagattttctctttgaaatcttccaaggctttttacaattccaataatatcaagaaatcatacccaagatactattttgcatcattattgaaacaggagttttactttttatccttatgttatttatttattttatatttagagacaaggtcttgccctgctgcccagggtgggatacaatggtgcaatcatggctcaccgcagcctcaacccatcaggctcaagcaaacctcctatctcaggctctcaagtacctgcaactacaggcacatgccaccatgcctggctgataattgcatttttttagagatcaggtgtcactatgttgctcaggctggtctcacactcctgggcttaagtgagtccccctccttgacctcccaaagtggtaagattacaggtatgagccaccatgcctggcctgaagtttaaaatgtatgtttgtagtagactgaatactctatcaactatattttgatttgtaaaagggtcatcctgcatgtttaacattaacaaataatctcaaactagattagaagcaatggaaattaattaaaaatttgtcatataaagtcaccactgacatttttgataattacccttgggtttctcttggcaaattgatagactctacactgaagcaggaactcctatatatttagctctctgcttttaatgtggctatttctgaaaaatattatcagagttttctgtcaaccaatgatcattaatatttggtgattacagcattttcccttggaatagaaaccacctatggaggtgtacagcttttcttacaggtttaaatattaaaactattttagcctttctttggaactattttgactatgagttatatttttggaaaaatatattttcctttcttggggacctttccaaattgttcagaattgtcttcattaaattaaagcacttctgtttatgcatttcagatgcgtgtgcatgtcactacacgttcttataagcactgacgtaatactttctccttctgaatattgatatgtttttgtttggcattacacaggcagaatctcaaaaattttctaaatgacatctacatttaataattgctgcaaatattgttgtagaatcatgaggttgcagtagggttttgttttgtttttgagaagttttaaaatttgtcttattttgcattttttttccctttagttaaagattcagatgaacaatgagtcagaagataggttaagcttttccgcctctgctccattggaatgagatagactaatttccttgggatagatggaggctatttatataggatgtttatactataaggcaattaaatacttactaagtagatataatttctaaaagtaaaacagaacctagaaccacaagactgctattcctagcccagataaattaatattaattctaaacctcaaagatcttcttaaagattgctagatatgaagatttttataccattgctcagtagtacataacaggttgtataaccttgtgatgaagaaattttccttccctattcgtcacttactgttaggttctctgtatttggaaagtctccttttgttacagatttgaagtttgaagatgcatcataaagtctaaaagtaggaaatgcccacagaatttaacattaacagttgtagaacatattgaatacctaaaatacagtgtctgagtgattagagaaagaaagtggagtattttgagaatttgacacgctccttatcttccaaattgctcaaatctgtttccttgtatctaaactcaaagtttatggtaaggtctaaacgggcattgagccagatagaatggagagaatgagaagaaaaggggaatcgacagggaaacagcatgaatggaaaaactttccaattgttaattgattactagatgtaagcccctaaagaggtattgaaagaggttttacagcttttgcttcattatccttaccttcaaaaccttggctaaatgtgtccagagtattttgagctcagagtatgagctgaaaagagtaatatttcagataccttaatacattatatttagccctttatgtgggagttactgcattttcacattatgtactttaacacaactttaaacatttcctatattgagttttttttttaaaaaaggcacttctgattacgtatttcaaatgtgtgtggatgccactacacatttttctaagcactgagttaatatttttccttgtgaatattcacatttttgtggcactacacacacagactctgaataatcgaactattcacaagccaattctaagttagaatatcttttaatttttgttatgttttgtttttgttaatagcaagttcttataccttaatatttgagaaacacacagttaataaaacagaaggaggggcagcaataagataaactggctttgcttcatcaaattatcttgtttttagacaaatccaaatggcaacaaccatgcatcttttctcaaactaagattttataatagatgttttcattataacaagttgtatatctacatttcatttatataaaaggcagctctaaactctgactacattcaaagttacttgtaacaaagactggattgtaatatgaacacatctggatttggggaaatgtgtacaaatatggctatatgtaaaggtagcagcagtttatagctttccttattagacttctgtctatatacttcaggcaggagtagaaaaagcccatggcatattgagctagtatgtgtccttacttgctaaaaacaaacaaacaaacaaaaaaaagtaaaaacaaacgctgtccataagtgcacactattctgtaaagaaaaattcctatttacagttaaaatattttaaattttaaaacaacataaaaatgtgaatacattttggttactttttggaatattaaagcagaatagataaatgtgtctgtgtcgtttcctggaaaatcatttgttaaaaaactcattttggtaattatctagtaattctatagttagcaaaattttattttatatttctatattcatatttctatgaaaattgttcttaatttaacatgccaataattcttttcattcacatgttaatttccacacctgtttctatgaaatgtttgtttttaatttttctgattaaaaaatgttatctagtttagctttgtaacttagagtgagaaaaggctatggtttgttctctgaaatgcttaacttactttcaaactgattaaatcagccaaagaatttgaagggtttagctattagatgtcaaataattgcttgattaacctatacttcagtttttcaactgttcttttgacatattaacctgcttcagtgcagggaacaaatttttgaggctggggacatagtaggtgtttggcgtctttctcaattgatttagaaacaaacttagtgtaactaagtaggcgtaacatactctttagttacccctagaaaggtatatttagacttgtttagtaagcagaggtggtaatattcaaccaagtaagcaaatataagtatgaaatagttttcctttaaacccacttggcagtggaaaaagccaaatggaaaactagctgaccactctgatcctgtttgtcttacacagtagttaagctaaatgccactcagacaatgatttatttattaaagcaaagaaaatatttttctttcctaaaatcgtaatgtaaaataataaatataagagtacattttgactctgtgatagaatccgtgttcctcgccataatatgttaggttgcataacattttttttaaagggacaaaagctggagaattcatacgttgtgttagcaagaaaaaatagataatggaagcaggactttcctgccccttccctaaagcttcaagtaatttgaagcgtgaaaaagaaaatgaaacttaaaaaatcagtgagaacaatgtgcttccctagaggctcttttcattatgatagcacttatttccaagaatgcttctgaatatgtatcccaggcaattaatgcaacatacatttgtctttaatacttttccagtttgaagatatttgtcctcagtggcagaatataaaaaggagttgaataggtttctttctgttccattatcttttctttttacactggttgccctagcaggggctatcttttccttgtttttcctcaccttttaaatccagtttttgttatctttagcattttattcaacttcgttttatattttgctttaacattctggttctataatgctactttatcttgtatatcactccgtacttattggggtttttccatgtctgccagtcacatctcttgaggaatgattctcacttgagaggtagtgagatttttcttccagctcaaaaccaggagaaaggaagacctgcctgattccgtctttggactcaaggagcccatgagataaaggctgtctcataaggtagcatcaggcttttgttttgacacaagtttaccatgcgttttctatagtctcctttcattacctactaaaacttatccgaatacttacagagaatggttttgtgcaaactgccttgctcttggctgcttagtggagccttatttcctgtagtctgtagcagctactgcaatgggtagaacttagaattccaccttaaaattgggattcttacaaagtccaccaaacccatgaggagtctatatttgagttttgaggatattcaaaagccctgaaatgttatgtaatttcacgtgtacagttttctggagagtgagtctgtagcatacagaggtgtttgtgtcatgcctcaccacagtttaagagctgtttatatgcattgtacagagcccaagggtattctggaaacaacaaagatatgaaaaccttggttatagagaattagagaattactgttccatgagtgtggaatacattatattagactagatgagctggtgtaaaggagtcattgtaacaaaatcaacaaaggtttcttatgcctgtggaatagcttccatggagctttttcccaagtgatccctccagagttgtttttgtagaatcatctgggcagctgtgcgttgtattcatgctgaggtgatagatgaatacttttcagaatggacatgttatgatacatttcaggatccttttaccttgaaaactatgttgctgccatgttggaaaaataacacctagcaaaaatgattaatgtggaagggtacgtctttaatctgtgatgaagagaaattaatttcatcttccctcacctcaaatccctgttctatgtaatggacattagcagatctatattgtactcatggcacctaaataaattcataccattaaagggagttttagatttattacctattagatatattatttattcaggttaaatgagaatttggctttgcaatgtgtattcgttatttgggtaatgaagtaacaaacattttaatgttacttttcaaaatgtaaaatgtaaatgatttatatttgaattattatagacttcatatgcttagtgtacaacagaagtttgtaatgttttatttttaaggaaagttacactttgggaagggtgatccatggaggcagaatgtaccaaactgcctagaggaaatgtgtttctttttcctagaggaaaagcataacgattggagtagccaccaatagttaggctttttatccatgttatcagggcattaaattttttggcatataaaataaccctttatcctcagaagttgctgcttctgggtttttgcctgactagagagttacagaaagataattgaaaataaaatgtatgcagtttgaaaaatattcaaactaaattcaaattggtttttagaagttacatttgtaaaaaatcacacttgattgccatttaaaaaccatcaaacttcagatgtgggtttaatgacaatactatagaacaacatatcttagaaaaagaaactacatgacaaatagattgcagtgagcatatttaacatccttttaggcagcctgtcacagtgctggttagtgaccaagtcagacaggcacttaagcaggtcatttccagcattcactagcaggtgcaggttttatatgatgtttgttttccaacttttgattttaaaactttgaaatcttaatttgcagagaacattcttgcctgataaaacagacattctttttgtgttgctttgaaatgttcacttttataaacctatgctgtccggagtttctatttccaaactttgtaccattagataggctgtggtcctgagtgggccagttgtttgagtattgcttgcagatttgattcctcaatggaaatgttcccgtaaagcttattcagataattattatttattctttaagcatgaaaagcaggtcaaatagctatggtgtaattttcagaattatttatactttttgtgtaacacaagagagattatacatccctagtagaaatctcaggaaaagaaccctttccatttggtagcgatacttagttttgagatgtgatttgcatctttgctgtaatttgaaagacaaatggcttaaggtgcatgtttttaaatgaagtttgagatttttaaaaaatatgccttttaaaaaaatatttcttcttgtattgaggcctctcttacattaaatctttgagagccattgtttccttaagtaaataaggtacttctttaatcctctctgagagtggggaaaatgcccacagggtatagagaaaggaaggactggtactctcagatactttgtaatattttagttctttgatttcaaaaaatcactctcctctttcttaacaactgctttctttcatctaaattagacattagatgttaaaatcttcatggattttaattatatcaaatcatgctatttctggataattaatgatggacaattaatactaatgtattaattgaagtattctatggagtacctttttacatgttgggtaactctaccctcaactgataaaggaataaataattttaaatttcataagtcataggatcttttcattttatgcataataaatcaagacacatgctaatagactgatactttcaaaaatcaaattttaaatgtgccacttgccttttagagtgatactgaagtggtgcaatctggaaaatacatgatagaatttctaccaaacattaatatttatcttctggatcaccacctgaagactaatagcactatgtctagaattcttgtcatgggccgtgttagtaaaacagtaataaaagtgatagagtagttcactattttatgtcctgtggctggttatggtcatctggctgaagtctatcccatattaatcccttgagtcaacagtcaggaacattcagtgatgtacttgaaatacttttaacatgtggtatttagaatgtttagaatgtcaaaggatcctttgtaatgatcttccccttgggtagttcaaaagatatttttaaagttatttttcaaagagcacagtatttgaagattttaataagatataaatctagagtactttggggaaaaaaagctcaattctagaaaaggaaaaatcataccatacagtgaagtgatatattagtcaaataatctatgaaaaaattcaagaaaatagagcatgtgttcatttttggttgaaaaaaaggaactttttttatgaacaagagaatgcatttgatgctctcttgggaaactgttacacccttctctaattgtgtttttcacattttatgttcaagtgtagatgactgaagagataacataacctgttcatatttttcatagaacatattaaagcctgtttctatggcaacaacttttaattggcaaatcccattctgtcagcactctcaagtggatttttcttgggtacattgaattgttagaaatgcttcacaaagtaaaagttagatttggcattactgtttggcatgaaagatgttcatggtcaaggatttattttattaaataatttatagtatgtgtagtaagttgctgtacagatgatacatctatctcaacatcccgttggtgtgtcaagatacctgctgagaattgatacagacacttagggcttgcacactgaaaatagcaacttgggttatttcacacaagtaaagtaggcaaatgccttacctggcaggaaaaaaaaagtttgaaaaaaacactaaaatccttttaggcaacattttagactttttaaagcagcatatttatagtttttatttccttatggctctgactttaatagtataggttgatttgttagaaacatagtttgcagctttcttactcataaattttatttcttgaatcaatgtggtgcagaatgttgaagcaggtatttggtaagttggatctggctactgcagtgttgtaaaaatagattaagtaaacagacacaacaggccaatgcagcttgagttttgaacccttctgagaccccgtatagctttaatagtctttagttctaagaaggaaaactatgaatctctcaggtaattttaatattatataatgaaggaagatctatcttacagccaataatcaggtgttgtatcttttgtaattatttcagagcgctttatctgaaagcttcaatttttaagctattccagtctgtgtatttttttttttttttttggtctttgctatttttatatcactgcggtagcataaccctgcaccaagtacaagacagtattgcagtttgtgttgaatgtaaaactgttattaaatgaaagctaataaagcaaattcttggaaagaaggaaattgtctacattcaagacttaaaatattaaaatcaaatttgtcttctaaaaattaaaatatgaaaggactaaatgaaactgtatatttccccctcttcaaaagtcatgacttcatgtagtcaaggaccaaaatctgattagtcactcgtattaattatttttcactgttgcataaattctgtaaaagtgttcctttctcatatatcatctttgtctcttaaaactgtccttactgtgtttttggatttttgtccttttcatcagaagtcacagaaagcttttatggctgaatagttcaacctcacctaggtaaagtgccattgtatctttctaatccatatgtttcctgagcagttatgactcttgtaattttataattatatttaaaagaaataaattgtgtgtatatatatttataaatataagtatgtgtacacacatgcatatatgctctgtgggtatatttgtatgaatttattgctagtagtctaagaaaaggatgagatggtattattaataacttagatgaagagtggtaagccagtttaccaaggcttttccataaattagtgagaaaggtaaaagtaaaaataaagattagatggcctacagctccctgtaaaataatccgttctcagaaccacaggccttttgcattgttttatgggccaacaggctttcactagacccttgacattcttgtagtttagatttctggtttttaacattcaggaactgtcccaaagattcattacatgtaatcgattgtttttggtccttgggaggaaattttcatcaggtgctctgagttgacttgaggactcagctggagaaggcatctagttggctaccctcttcaagatatctttgttgactgttcatataagccataactatggtgaggaggatggagtatttgtccatttgggaatttacaaaggtccgtggaacacataacattaaaatatcaggttcttttcataccagtgctttacaaacaggacttgagaaatgagaatagtataataaatgtcagtagttatggattttagcttttcagcttttattaaccctaccagtcccagtcccatagttgagtgaaacaataaatgtctgtcttctctttgctctcaatttctatgccaagtgcagttcccttgattgtgagtgcttcagactcccagctcttacctttacctacctaggtccaatctaaagtttccgactttgaggaggtatgactaggtactgtatgggaaaaggataggatagaaaggggcatagaattcctaggaaatgaccactgattctggttcagaggcctagcagttgaaagctagagctggaaatctggaagctttattaatggtatttagtaggtatctggcagcacatctggtagcctgcatgtgcattatttacacaggtattcaggtagatgaagtgactaaatgaagaaatatctttatcacacacaatgaatcatgttctaacgtaagggcaaagaaggaaggtgaagtggtggaggaatagtttctgagttactggaaaatatgaatgtagacattattaataaagattaataataaaccttttctggtttagagcctaattcacatgcttttaaacagttgacatgaaatatttcatagatttaaatggggatcagtctttatacataccctttttatacagtcatgcatctcttttttttttgagatggagtttcactcttgttgcctaggctggagtgcagtggcgtgatctcggctcaccacaacctccgcctcccaggttcaatcgattctccggcctcagcctccagagtagctgggactacaggcatgcatcaccatgcccggctaatttttgtatttttagtagagatggggtttctccatgttggtcaggctggtcttgaacccctgacctcaggtgatccacccacctcagcctcccaaagtactaggagtagcacaggtagcacaggcatgagccacagtgcctggccccgtatctcttaacgattgggatatgttctgaggaatgcattgttaggtgattttgtcattatgtaaacatcatagagtatacgtgcacacacctggacgatatggcctcctacatatccaggctatgtggttatagcctattgcttctaggctggaaacctgtactgcgtgtaactgtactgaataccaagggcaattgtatctcagtggtatttgtgtatctagacatagaaaaggcacagtaaacatatggtatgagagattacaaatttttacacctgtatagtatatttatgatgactggaacttgcaggactggaagttgttctggatgagtgagtgagtagtgagtgaatgtgaaggcctcagagattactatacatgactgttggctttacaaacactgtgctcttaggctatactaaatgtatatgttttgttcttcaacaaattaaccttaatgtaatttatttatttatttatttattttttgagatggagtctcgctctgttgcccaggctggactgcagtagcacgatctcagctcactgcaacatatgcctcccgggttcaagaaattctcctgcctcagcctcccaagtagctgggactacaggctgccatgcctggctaatttttgtatttttagtagagacggggtttcaccatattggccaggctggtctcgaactcctgaccttgtgatccacctgcttcggcctcccaaagaacttttttaaatttataattaaaaaaaaaaaaacttactgactcttttgtaataacacttagcttaaaatgcaaacagattgtacatctgtacaaaaacttttttatatctttaaggcttttctctatttttttttttattttgtaaacctttaaaaactaagacacaaacgtatatgttattttaggcctacacagggttgggaccattaatatcaatgtcttcttcactccacatcttgtcccactagaaggtcttcaagaatgataccatgcatggagctgtcatctcctatgataacaatgccttcttctggaatacctcctgaagggcctgctggaggctgttttacagttaactttttttttttaattattagaaagagtacatgctaatgataagtagtatagtaaataagtaaaccagtagcacaatcatttattatcatgtattttgtactgtacataattgtattgttatgcacacacacacacacacacacacacacacacactctgatataagtgggttgtagtcctctggtgacttaggccgagatagtttttgaaaatgaaatgccataccttctttattgtagtggcaaatcaaagctaagtagcagtaaaactgttaatggactaggatacttgatgcagggagagggtcacagggcacaggcaagaatgcccttgccctaaagactgcagagtagcagagcaggagcagcactttgtggaaagacccagcttaaccagaacaatgcccaaaaacctttgaagtgcagtgatgtgagagcgagactagaaaactttcatttaacaaatctagataaacttaaaataagaacaacagctatactctacctgtgttctctaggtgctaggtattgacttcacacaaatgttcatttaaatcctcttatataaccttatcagggagatagtatagttattcccattttattggtgaagaaacagaggtttagaggattaagtgctatgtacaaggccgcagggctggtaaatggcaaaattgggatttgaacctgaatacatctttctgctttttgagttcctactattaagcactctctcctttttcagttttaaaggaatgttgcagcataatattacacattaagttgccctttcttagataaattaaaaccttacctaaaatgaataatgattctaagtttgaaccatgaaatcttcatagcaaggacggatgttatgtaactgcttaaacttctgttcacagatttttgacactacctttcaaatttatgaccttctttctatgttttcgttttttcttccagttcttcatacctataaaccttcctccttttgaccttgttatttgcatttgaaaacttggtccataaagctttcctgaaaatcacatgggaagcagtatttcatacagctccagaaaacttttggaaggaaggctgacagtgttgggggcttaattctacatgcttctttattctctgcatttagctcctgcctgacatgtgcagcatattgctaaacacatgtgagacattattgtagtgatatttcctatagaaaacaccttggtataattcaagatgaaaaatagaatatacatgagaggtgaaaaggcaactttgattagtaaagtgctgacatcccagttggaagcactgagaagtacattcaattgcctctggcttgctgaatctgtctatcccatacccacccccatctcacagggctaacagggaagcacattttgaaaattctgatgaatgcattccaattctcttttggtgggaaaggctgagtttgcagggaattggtagtaaagtattggcactttctttgtttctataatatcaataaattgcaaactgtcgtttcttttactgaacatgtgtttcaaatacagagctcatcattaagtcctgtcattttgtgcaaaaaaaaaaagtatgattacattatagagaagcagttgacatttataaatagtaagtagtggcataaagacttttctctttacgtagtgcaacatgaacagaaatctccgcaagaagtacctgaagatgggtcttaatatttttttaaatataatcccctgcttaggtaacattacacataggttaatgtgtatttcacttatttctttgtaatacttttattatcaatttcagagctcatttctgagacaaaaattcagaactaaaattgatattaaaaccattggagtggtgttaatgggagacagagttaaacaaattgagccttttgtacatatttacatttcatgtgctttttaaaaactcaaaaaatgaatggaatgcttttgaaaatcagcatacttattctacttcttcctctttgaataaactgctatcccagaatttctactttttaaaagcagcaacaagaagtaaaacaaaacattcaaagccttgatgttgagattttgaataatacatgtctgttttaacatttatccttaacccctttctatttttatcctctttggcaaaattatgtaatagccttaactgggtgagccatagtctccagatgggtaagatatacacagagaaggaagatatattacaaaagcaccttttagaatattccatgttctggcaatacaaacacgttcttctgaaaggtagctactcccagttttttgcagtaatgtcagggaaactttatatgagatgtaaaaatattcctgagaagtattctgagtagaaaatcccaaaggccttctttttttgttgtttttaacaggaaaacatgcttgtacagatggctagttgaattttctagcttttaaaatggtgtacaatttgttgcgttggatcctaagtttctagagtgctgctatcttattgcttcaaggtacctcctaaaagaagcccagaatctcttgccaagatgcctcccataggaaggtaccagaactcctttacataaacatctctgttctctcacccagccctccctggcctgtctccttgacttctgtcattcctccctgaaatcccttttccatgaatacctgctttctagatagtcctgaactgctggaaaatagatattgtattcccaatagactgggagtagaaagggcccctggccattgatggcttttaaatctggaatgtaggttagagctacaaattagcttgcagctacagtctatcttagagaatttcttgatatccaagactaatcctaggtatcagataacttttaatgggcatgataattttaggccttttactttctgagcattgaatctacccaagaatagcagcaaagagctaaaagtctctggaactgtactgaaacactgggtgagaaagccattgacttaccttcttaaggaaatgaatgttacggtgaaatatgattcaggtctgagggaatatcgtttgactattagtatcccagctttatttgtacctcttcttgagagtgtttctcatgaagttaccttccattaatgtcttctatagctagctttctttaccagttggaattgcattttgtatttctttttctatcctgcatcacccagcataatgataagcaagtagataccttatatatttattaatggataaatatgagtattaacaacacattgtggatatatgttcccctttcctgtgcgtgagctatagttggcacagtgaatttcagcattatgtagttcactagttctttgtagaaattgttttctcaaaggtaatttctttatcgcctttagtaggagatatgaaattattttaaataattttttctgagaactatactgaaaaaatagtgcctaatttattaagctattccagtggttattgagagtaaccaatttagttataaatctatttttatcactgacattcagttcatcctacatggttttccaaaacgaacctaccattttaaaaaccaagattgttgggtagattttcttcacaatttcatccaaagtgagaatctctgagacagcagtaatattttgagggcaaaaccaaatttttccaaagggtaacagataacattgtttataatttgcaaaatagtcatagtcaattagtgtgaaatacatattttaactaaatgtgtactgtgattaaagctataagaagtctgtctgactatttatatacagtgagaagagtctttcacagactgtttgcttaattgctgcatttttaaacaccactagctatttgaatttcagtttgacactgttttagttctgaatatagcctgccaaatttgtttatacggtacatatgcctcatgcagatgtctctgacaccttaattgttctgtgaccttgtacaaattatttaatttcacaggatgtctgaatccttgtcagcaaagtggggagtaacagtactggtgctatagaatccttgacagaattatgtgagatctactctttcctttattcagcactctgtggcacactctaagctaggtgaaacagggtgcctgccctcatggatcttattccctagtgcaggaattagttgataaataaacacataaataagcaacataattacaggcatgacaagtactatacagaaaataaacagggacaggtgtcagatggagcctgactctgggagacctttagatgggtgttatgtccagtactcttggaagagcataaacaataaatagtaattttctcccttcatcatccatagttaatttttctttttttgtcccgagagggagtctcactctattgccagagtggagcgcagtggagcgatctcggctcactgcaatctccacctcccaggttcaagcgattctgctgcctcagcctcccgagtagctgggaccacaaacatgcaccaccacgccaggctaatttttgtttgtattttagtagagacgggtttcaccatgttggccaggatggtcttgatcccctgacctcgtgatccacctgcctcagcctcccaaagtgctgggattacaggtgtgagctaccgtgcccggccttcagcttttatttaattattatattcacagtctataaaacaaaaatatggataagtagtttttatcctgtgagaaatatttttaaagtttaagattttgtagcagacatgttattgcttcaaggttaacggagtgactagtacattttcattattttgtggcataatataaattattttaaactttttgtttaaataaaatgcaggccaactgttgcgctgtttatcaaatgatagtcctaattaatatttgtctgttttttcttctcaagcattttggtgctatatttcacagaagacatttgtgtgctagcttatcttgccaccccacttgaacaatttaggcagctgttttgtcttggatttttaggtcctatataaccagacaatcagtcattactcttgacttctcttaatgagcgcagtctttctgtattcttaggtcatcttcactaaggagtgtcttcctgaaattcaagtaggcctcagcaagagcattggatggatggattatctttgcttgtattttagagttcttaacctggcatttgacgttactttcacttaactcttgcattaactctgaacttaacctcccctgaacaaagcctttaccccaaacagattgctttagccactgtctgttgcctagcgggaatgttcacacctgtgtggttttagttactgccattttacctatcaggccctcctggcttttttaattcctgggaagtcagctgtgttatagaggagaggtccccaaccctgggctgcacagcaggaggtgagtggctgatgagtggatgaagcttcatctctatttacagctgctccgcattgctggcattaccacctgagttctgcctcctgtcagatcagtgacaacgtgttggattctcataggagtgtgaaccctattgtgaactgtgcatgcaggggatctaggttggagacgctttatgagaatctaatgcctgatgatcagtcactgtctcctgtcacccccagataggaccatctagttgcaggaaaacaagctcagggctcccactgattctacattatggtgagtgttataattattttattatatattacaatgtaataataatagaaataaagtgcataataaatgtaatgtacttgaatcatccccaaaccatccgccactccaccaccaccagtccagggaagaattgtcttccacgaggctgatccctggtgccaaaaaggttggggaccactgttatagaagacataatgctcagacttgatatcagacctgatttgctactgtgtgatcttaggcaaatcctttcacctctctgagctttaatttcctcattggcataatgtagttagtacatttactcatatcatcatttcaggttaattgaatctgctttgaaagtgctccactcctagtctgtctttcctctgcattttttccaccctggtttcacagcgcacttcatattaacattcatctattttctgtaatatatcctatattaagctttattgcagccctaccttgaccctattccaccttttcttctgttttttgtttgtttttgttttgatttttggtaggttgtcagataacagagataaattaagattctcaaaaaagtttggggattacctgtttattgtaatgaaccatcttttcaattgctcgaacagtatttagtataaatgaagtacaagaaatggtctgtatgaattaacaatttcttttccatggtggacccatagaaatacattaaagaaaaactcatgggggtatagcatgttcctaagtgtaacattgggaaaacaacaaaaggaaaaaaggacagaaatacactcatggtaagtagtaagctggctggacaatacaaagagaaaatataataatgcaatcctgttggcacatgtaataggatgtgatgtactgccaaaatggattgtctaatctgaaagtttccccagcttaaaaaaatcttggagataagaacattggcattccattctaagacttgttaggtttcaaatgattgagaatatgtttattattattattatactttaagttctgggatacatgtgcagaatgtgcaggtttgttacatagatgtacacatgccatggtggtttgctgcacccatcaacccgtcacctacattaggtatttctcctgatgctgtccctctgctagcacccctacccctgacaggccctggtgtgtgattttcccctcccttcgtccatgtgttctgattgttcaactcctacttacacttgagaatgtgcagtgtttggttttctcttcctgtgttagtttgctgagaatgatgatttccagcttcatccatgtccctgcaaaggacatgaactcatccttttttatggctgcatagtattccatggtgtatatgtgccacattttctttatctatgttttaagcataaataataaagcgctgataatctgtaaactttacttgaatctatttaaagtatttcttggtcctttcatggtaatcttctttaatctttccttaaaataaccctattgactaacatattataaatattttcctactgtgtgtcatgtgagctccagtgtttttaccaattcacacatgtagagaggaaccttccccccaccataaaccagtaaactagcaaaaatcagtagtctgtaatgtggaatactggttttagaagaaattctattttgtttgtgtaatcagttcattttattgtcagccaattttctactctttcagagattattattatttaaaacaaattcacttgctacatagtcttttcaaaccacaatttattcatttatattttttcacaatttatttttaaaaaatcagaacaaaccaaaaacagttgcccaactacagtacaaaagaaatgcattgtaaattcagagccacattttaaaaatgaaatttgaaattattttaaattatagttaagtgcaatgaaacaagatatgcataattttggaaacagggaaaaatagttgcatgtagagactgggccctattttggataacatagaacttagtcactcaattatgatttttgaaacagtttcagaacagttgattaaaaattaggcccatctactcattctttctgtttatgttagtgcatgtaatatattagtatagcacagttttttttttaattaaaaaagacctatcatgtttaatatcaggagaggttaggattcttttagggtgtgtagtaaattattgtttttaaatattatggctgaatatgtcacattcaaaaaacatacattaaaattatctaatagaatcaaatgatgcaaaaatatggagtgtatgtgtgttagtatgcattagaaaaggagtaaagtgggagattatgaaagatgggtctgggattattatctagagaatggtaaaatctgttacctcttgcctggactgttaacataattacttaattggtctcccctttccaggctcttagccacttcaagccctcttacattcttgtctgaggaattcatgaagtacagctttgcttatgtcctttccaccccattcagtggctctttctggcttacaaaaggaagtagacaatctgtaatacagtatttgaaaccttccccaagctagacttttctaggtgctctttcaaacttgtttcctgctgctcttattacagatgtattacttgtcactgatgccccaatgtatgatatttcctctacctagatatcttttccaactcttcatgtataaatttagcttcttttttgaagctattacctgatacttctaaatggaaatagtccccttgtctttaaaattaccagaactctttatctgaatgtcttttgtgacactctttgccctataaccttatattctattaatagctatttatatgcgtgccttgtttcctttcttaggataggtttctagttcattttgtgtttccactgtcccatagcacagagcacatgagaggtctcaccatacagtaggtgaataaatatacaaatgagctattctgaaatttggtataaaatatattcaaggtgagaccacttctgcctgccttgccttgccttcttcttccttcatcattcttcttccttccctccccctgctcctatttcttttgtctcatccattattaccttttttctcctagcttagaaaacaatgaattaattgttctgctttctcttttgcatctatgtctacacatactgtatttctgacctagatatctagctcttctacaacaatttcagaaagtaggtatactctgttattattctaagaaaaacaaaagggacttcttatttaattaattattttttttttttgagacaggcttttgctctgtcacccaggctggagtatagtagtgcaatcatgactcactgcagcctcaacttcttgggcttaagcaattctcccaagtagctgggaccaaagatgtatgccaccacacctgtctattttttttctatatttttgtagacacagggtctcactatgtagcctaggctagtctcaagcttctgagctgaagtgaccctcctatctcagcctcccaaagtactgggattacaggcatgagccactgcacccacccattcttatttaatttttgatgacttctaatgggagaagcacattatctattttcattttccatctctattatagtaaaatcatttgttgtatctgaaaacaagcaggaatgacaaagttttccttcagtccctggattatttaggtcactttcattctggctaccaaatggtagaatgcatgctaaccctgacattactagtacttcctaacttcatagcttaacattgtcgggaccttacatgagatatttaacctctgggaactgcagtttcctgatttgtactatgaggctaataagaatacctcatgggattgccatgaggataaaagctacatattattgtgagagttaatggtagacgttgtaattacctttgaacaggccactgaggagaggattctactgatagtactaattgtcttcctaaacaaacagcagcagtcctgttgagacatcttctctccttacttgaaaatttataatatgccactttagttttataaacatttgctatagctatgaaatttttaacttgagcttaagcaacttaaaattgagttataaaagcaatattgtcaggttaacataggaactgcctaagacctctagcccttgatgggtgataagaaaactaaattgtatagaatctattattacttatctaatttgctataaataacactgataatacactctttcttaagtgtactatgtatgttgagtatatttttaaaagaataagggctctcatgggtacattgatgttgtggatctgttatccccgctttttccttgaaatattttctttttgtgaacaagttgtttagaaataaccctgtgattatgcaggtgttgctggtcttgagaccctgtccaggattatatgcccaagggaacaaaggacagtagctttttatgccatccattgcacttgagtgcccttttccccagtgtatatgaaatgaactatttggaaaatggataatttaaaaatagaagtatcagttaactaacagtcagataacattagcagttatcttgaagtcactggcaaaaacagagtttaaaaaaactctggaaaaggttgtggttgattggtaaatgagaatgtgtattagtatatgtaaaccaacctgtggtcttcagagtagccatcattagaatcatctggggagcctttaaaatacacttatgcctgggacccagccaaaactatctaaataagaatttctgggagtggaggctggatgtaggaattttttatttataatatacagtcatggtcaaggaccagtgactaagctttacagtattgtcaagtgatgtgatagctggacacccagaaatgcccttctgtctcttattcattctacaaacatttatttgaaatgcttaggttgccaaaatatataattcctaatcaagaacagtagacagacttgtagaaattatctataatatagcttgggaggtgctgaattcactactgtgagtttattctacttggcaagaaaagaagggagggaaagtgaaagaaaacttctttagtaagtgacatttgaaaagggtcacttctcataatcaaatttaacctattaaaatgatttacttttaatatcaactccttttaaaaacagatgcccagtttcttaatggtaagtgaaatgaacatgagttgattcttactttggcctgaggaaagctttgtcacagctactctaggagctactgtttcttgaacacaatttcccaagtgaaggtacggcttgggcagggagttttgagtacctgcataaggtcatgtagctagcgggtgagagagctgcaatgaacacaggtctcattggttcctggatatgtgttctttcattgcactaaactatactatagtccagtgaaagaggcttcgtttgggttaattcattaaaggagatttgcggctggacgtggtggctcacgcctgtaatcccagcactttgggaggctgaggtgggcagatcacgaggtcaagagatcgagaccatcctggctaacacatcctggtgaaaccccgtctctactaaaaatacaaaaaaaatcagccgtgtgttgtggcaggcacctgtagtcccacctactcgggaggctgaggcaggagaatggcgtgaacctgggaggcagagcttgcagtgagccgagatcgcgccactgcactccagcctgggtgacagagcaagactctgtctcaaaaaaaaaaaaaaaaagatttactagaggctttgttgggttagttcattaaaggaggttttaacttgatggtgagctggcaaactctgacaaaggaaatgttgaaggaacaggagaaaaggatgctttcaagcatctctggagaaattgacctgagtgatgggaaccaggggttgcaaggtaaagaacgtgctaggagagtgagagcagcctggtcattttccttttctgagtaccagaccataattgaggcccctgtatatattcccccatttaatattcacgttatccctagcctggtattcttatcctcattttcatagaagaggaggttacaattcaatgaggtttaataattaacccaaagtctcactgttcataaatatcaaagttgggatttgaacaagcaactttctgatttcacttcatgtgatttttaaccattgagctgggactgtattgctctttccatgtcaactcctgggactgtttctctgtgcttgtctctaaggcttgtgtatatgagaagcttacaagcttaggatacagatacctctaacaggtgaccatattgtttacttaggtgggagcagagccacaaatttgtacttggataacagtagtaagcagttaactgagaaaaggaggaaatggtagaagactagaggagagaaaaatatatttgaatgaagaaaaaaatggggctatagtatgtcagtttatggaccctgaaagagatgcaaaaggaatgtttgagagctgttttattggacagaatatcctatattctgaaatatagtcaggactcattcacttggtaaacacttatggggttttcttggcctgatatagactgtgggcatgagcctccttctggaggctgtcaccagggaaggaagatgtgtaaacagtgcccagtattaggagaggaacatgtacaaaatacaaaggaagatacaacaactatttctaataaaagccacctgttttcagcacaggtagagagtgtagaaatcacagatatattcctttactcacttaatgcacccgagcagagtgtttagcagatccaggctttcagcctaaatgttgttggtgtgatagcaagaaaaaaaaaaaaatcgtgtgacaaccttctgtgctttcccctctcacgttcacattctggtttgttaaaaaaaaaactgtgttgccatggctgacgctcctgtgaggcccaacatctccatacttttcatcttaactaagcacttaagaatatgcactacagcttctgattgccatttagaacagagcaccttgtgatgactaagctctttcaagtatctatgcttaacgtgatggcttcaatacccttttgctatatagactcatctgtagatacttggtacaagttccatagtttatagttgtcatctatttttatttgtatgtttattgttaatatggatctttttctgaaaaactattcaaggatactagacacatactgtatatgaaatgattctaaaaattctgagacttttctattttattctcagtggtaatttttaggtagtttgttgagtgttactttagctatttggggaactgccctagaaaaccagtggaattctctaggtatgggggtggagtgcagaggaggagacaggctcagataacctgtgttgtgatactgcttttttttgcctcaagagattttctttacccttactgcttatgctgttgcagtccatccaatagaaacatgttctgggctcatgagccaatttgtctttcccctcgctgctgcctcaagtctgggagagctgatggcagtgcacaattttagcaaatggtcataggcaggggggtggggcagggaggggagtgttttctccatggggacagagccagtgtcattgagcacattttgttcaagtacaaagttgatctgtctgaaggagactgtggtcagcagtggtgagaacctttattgcctcaccttttcttcgtgctctgtcattgtttatgtgaagcagtagcatttaatggctggacttgaggcagaatttgtgaggtcagaaattgacagtatttgtttttcagttagggaatctcacagatttagaaaggagtgccaatgaaaaattgggaaaaagaaagggtctttgtatttggcaaagacaatgcagagcagtgtaatatatactaatttctgcatgtaaatggcagccaaaattttacacatctgctacagtttagaaaattatttaagcactaattatatgcataatatatgctgtcccatctagaaggctgagtagacttcaatggaagagttacagtggaaatattgacataggttgttggaaacatattacataatattatactttgaaatttatcatgactgaataagtgttatcactttagagatactttactttatttgtagggatatgtgggatctagcaggtacaaatacaacaaatgcctcatataaatactaagtaatgatgttattattctcaagctgacttaaccaaaatgtttttcctctctgatttcctttagttacttttatatttctcaataaagacttgccccttaaaacataccatcctatattactgtctaactttatatctttaattttatgtgtttgtatgtatgtttacatatatatgtatgtatatatacacacacaaagatatataactttttcattatataatagtttttaaattattttatatctaaatataatatataactatatataattaatttttcattatttgtgttatatccaaattgaagaggcatgtcagtgaaatatatagataatccaagaacctcttgcttcactaggtttcttattgaagtagataatatgaagcaatattttaacttctttggtgttccatttcttaaaaatattgttgatactgtaagacaggttcctctgaggaaaaaaaaatgacaagtaaattgaaatttacaaaagcatctaaatttttcccattacactttggaaatgctatgtggattagtcttctccaaattcagttgcttacattatgaaatatcttctcctttgcagaactcaaaagggttgaagacttccatttggttctgacctagagtcatctgtttctagtattagcagtcaatgattaaacaaaagcaaaacaacttacagatgatcaagtgggatacacttggtacaaatacatatccctacagtaatgattaggagcacctagtttgtagttaaactgcctgggttcagtcacttgttttgtcgtacttaagtattcagaaaaactgaaatgttacaaacaacccttcccagtaatactgagagaggattaagggaattaacattggtaaagttttgaaaacagtacctggaatataggaagcactatgtaagttttattattcctgtgttataataaaaatataccttttggtttttagtcagtacttcctgaagggaaggagagatttaaagttggagcatttttgctttgtaaatgtactaggaactagtcttaaactatgtttaagcagtctgtaaagaactgcttaaataagtctttcaagagattgttagaagaaaaattggatgcatttgacttaagaagtttacctctgttttatccccaggaaagctctagaaatttaatagagacagtcatactgtaaatccacctagtaatggtacaatgataaattggataaatatttataacacattttgtgtttctccactgaaaggcatgctctacacatagagcgctaacatttattatgtaaatgttagggcttttaactattagccaagattgaaaagtgtctgatttggatgtcataaaacttcagaagtatttcagctacaaacagtttagaaatctgattgttgctgtactgaaaaaataatgaagcaatttaaaaataatagaaacatagtgatctgccatttccagtttcatgatgctataaaaaaagcagccaacaaatgttggagtgttcaatgatgctggcacctaccaaatgtcactgggctttcacaaggtcatagagactctggtttggctcagggatggtggtcagatctgtctttggagcctatgaagactatggaatagtggcagacaataggtgcagttaagccctgcatagcattaacctcagcagtggtgatacacttttctaagattctctgggatagaggaggccataggtatgaaaaaaaagtgagactttctttttacagcatcccatcacaagcaactctaaatagaagagccttataggcccactctgaggagattaagatttcttcagatgactatcagctaaaattgtgtgctgaaataactgctactgcaacagttgtatgtgtatctgatttctcacaggcaaaagctgctggagaaaaaagtggtattttttgtcacaagaatgtgtgtgtgatttgttgcctttttccctttctcagccctctcagtggcagctactttgactctcatgcattacataatgttctgtagaagtgtagagtttcagttatgccattttcaagatgattaatgggaattgtgcaattaaagctcttaggttctctggggaaaaaaaagtcatagtatcccagtgtttgagtgggggtgtgttgatattgcgtcaatagtgaggatattttgggatatcgtaaatgtcgctattggtttcagtatctgagaatcttcaccattaaacttaggagtgttctacaaaatagtgcctagaacagctattgaatactcaagagggctgtttaagtagctagaaaagtctaacctaaaatcccatttgtgattagattatgcactgatgaaaaaatgtttaatgccgttaaaaagaatctattacattatattctttcaggccatggtaaagttacaaatttgaactcaataggctgtgtgtgtatttgtatgtgtgtatttttctttcttttattggcagtctcaataattgttaagccactgtgtgtgtgtgtgtgtgtgtgtgtttgtgtgaacttttcacaggaccaggaaaggggaaaaatctacatttgttttatattgtgtttcatttgaaaacatgttttatatctgtggtaaagtaattgaaagaaactgggattatatcagtggaaatatgttcttttttttttttttttttttttttttagtttgtttcactggtacgaaaaaaatctcccagctcttgtggttgaattgagctccatgcatttgctgttacgctgattgggtgaataaatagcaatttacatctagaaagttaagctttaaatattgattaggattgctatatctaccttaatttagaagactagagattgcttgcctagcaaaataagagaattgcctcattttttcaccttctgtggggatgctaggcatttgttgctggtgttacctgaaagaccaatgaagaaatcaaaacagtagaagttgtgtttgatttaaagaatagtttcttgcctttaaagatggtaaaactatgaaataagtacaagggtgctatgatactaaacacagacaattatgtaataaaaaaatcctatttacttatttaggttaaagagtcatgaatatttgagaatttaaacattaatagaaaaattagtgttactacaatagcaaagacatggaattaacccaaatgcccatcaatgatagactggatagagaaaatgtgatatccctacaccatggaatactatgcagccataaaaagaaacatagttacatcctttgcagggacatgaatggagctggaaggcattttcctcagcaaactaatgtagaaacagaaaaacaaacaccacatgttcccacttataagtgggagctgaacaatgagaacacctggacacgaggggaacaacatacactggagtttgttggggagggcgaggcaagagattgagggggattgggatagcagtaggaaaaatagtgcatgctggggttaatacctaggtgatggattgataggtgcggcaaaccattcactgtggcacatgttttcctatgtaacaaaccttcacatcctgcacaggtaccccagaacttaaaacaaaaaacaatagtgttaatatgaaaatatatttcctccatagtttaacatatgatttaaacatagtagatacataatatttacttattaacaggatatatactatgtatatttactctgtggtatagtatactacttgtaaaacaaataacagcatcaaaacagtgaaatctccctagagacttttcaaagaaaaaaatgaatgtaatgtatctgttataactactctaaaaattttaggctttattttatagtgctataaaagctcttaagagtttattcaaataaaacatgaaatataaattatgtcatatatcctaagttttgaatttgtaacacaagcaaaatctgtttgtaatacatatgctgctgttagaaataggtgcataattggggtgagtatataagtgtgtatttatgcataattatacactgttatatttggtattatgataactattgttataactggttatgataaaatctggtatactagatactggtataactggtattttgttatgatatcccaggcagatgaatacagccccccactaaattccatgaggtgtaaagtggcggttggctctcaacaaagggtgatgctgtcctccctcctccccgccaagacatgtctcaatatctggagacattttggtttatcagaactgagggtaggggtaatataggcatttagtggttgtaagttaaggatgctgctaaacatagtacaatgcacaggacaactcccacaacaaaaatatatctagcccaaaatgtcagtagtgctgaggttgagaaattgtgaacatctttttaggatgtatgtgctcttgtaagctaacccaagtcctttacggaaacaagtgagttatcaggaaatatacatttaagagcaacaatatacttcgtgttagatgcagttattttcagtacttgcaaaagccagtaaactgtgattcttagagtgaatcaaactcatatctaccaaatgaaaacataaccctgaagtatatatgtgtgcatgcatatttatatttgtatgtatgtgaagtataattttctcttaaaatcattcaccttataagctgccataaattttctaacactagatacttgtaatttttaaataaatattttatatacgtgtatgtgtttgtgtgtgtgtgtttattcacccaggcattagaattgataactaaaaagcatggcagagccataaaaaacattttttgcaagtgtgaaataatatggcttgactgccaatgttactatttttggcaaaaattttctgaaatatttgtatcatcttagctgaaaaaaaaaaaaatggtaagaattttcaatagctaactaccaaacttgttagccagagtttctgggcaatatctgagcaatgaatacccagaaagtgctccaaaaacatttgcatatatcagctatcccaaaaggaaatcttggttttaacaatttaaataaataattatagcttgaacagtcttaccagaaaaccataatgaaaatttgaaaagacttatgaatataagctagtagccctgtacttttcccattgctcctttatttccagagtctacttaaatagaacttggtaattgtaatcctgccacatagttaccatttggctgcttaataacatgtgtctttagactctgactccacaaatcacagtattccttttaagtagaagaaatataattaaaaatggaaaattagttttcatttgggattttgatattttttgctttattaagtccaaccaacttctaatcgttttgttttcaattagctagtttgtaattgcattgcacatagctagaaaatagctttctcatatttctaacttaccatctctagtttcatttagttttattcttattttgattggctattaattacctagcttccattatataatttatatcttactatatatatcacatatgcagtttatatatatactatatttgtacatatgtaatgtaaaggtatactgtattaaactgtaatgtttataaatgaatcatacatttatttggaggattaaacacttaatctaaatgtatattttcccttattatagccacaaaaaaattatagcagtttgaaagactaatgagataattcttaaattcacaatcgaacaacttacaacttcagaaattactcgatgaatttattgaatgactgttattggtctcatacaggtttttaagactacaagggggaaattttgccttttttggacagattacttttaattgaaaagtacagaaaaaatattacaaaaaatgaacttggtgtagaccaatattttattaattttccttctttcccttaaaatatatactgcatatattgcaatgatgtctttggaatctttgttggattaattctattttaaaagcctccttgaatggagcctaagggatctattaggctggggcaaaagttttgccattaatggcaaaaacctcaattacttttccccaacctaatactatgtaggctctatagagtggcctgctagtcagcaggacagctctccaaaagtaagatttcagtgtaatcaacaaaagcaaggcacagaaacgtaacgttgtaaaaaatgtgttacaatgagactttttcttggtgtatgtggcaaatacacattgattaagagccaagcttttattacattattgatgactgatatgcattgtcactgggttttgctacctgtattatttttagagcgtttaacagatacgctgctaaattgagcaactgctgcttgttattagcttgagaacttagaagaggaaagtaactaatatttattggctgcctattacgacaggtgccatttgtgaggatggcctgtagtcttactaatcttcatacatcaccaatgagatgttattgttactattatatagaaaagatgtgaccactcagagaatttcactaacttccacaaggtcacacagcaaataagtaacatagctacaatttgaacaaagctctatttgataaaattatacagttatctcaatagttggagctacctgtacctatcaaaactgaagatggctggtcatggtggctcacacctataatcccagcactttgggaggccaagatgggtggatcatgaggtcaggagatcgagaccatcctggctaacatggtgaaaccccatctgtactaaaaatacaaaaattagccgggtgtgttggcgggcacctgtagtcccagctactcgggaggctgagaaaggagaatggtgtgaacccaggaggcggagcttgcagtgagcccagatcgcgccactgcactccagcctgagcgacagagcaagactccgtctcaaaaacaaaacaaaacaaaaaaaactgaagacatatttatatttatatttcgcattaacctagcagcccaatttaatgtatcttgaagtgaaatctctaaatgatttagagtagtagctccaatataaaagtctgtatatgtgaactttagataccgatgaatttctgtttttagacttttaaaatgtaatgtcattgtatagattttatgatgccagaaacattgaatgtctatacaaatctcctttcgtacctggtgaaacttacaaacctgcttctgtttcctttttttcttttatgtggctagctttatcatgtatttaaatgactgacctcttaatgaaagcatcattaggtcagtacaactcagaaccaagatttggtatcatatttagttttttctattatctccattgtctctagaatagagttagagtagaattcatcttgaggcatttagtaagaaatgaacattcattcattctgtgaatgtttattgaggtgtgatgctactaagggctcagagatggatgaagctggcaacataccaacatagtatttaccttaactctcaaaggaaggtatgttcctggtggttttaggcaattctaatggaggatgtatattctaacttatttttgacctttttcctttgtcaaactataatcattcagcagcagaatcagtattaaacatgttttaaacttcctaagaagcaaagtgtatctaatatcatttgcagacattattctcttattttttccacacatgtcaaatgaaaatttatctggctttgcacaattgtattttgtagtgttttctgctatatcagaatcacctggaatgcttgttaaaatgttaatttctgggccctcaaacctgtggtcacagctctctgtgggagagtcttggtagtctgtatacgttctcaccaaatatcagttgattcttaggaacacagctttttgaaaatgaagggctcaacacagtcaaatcaagctgagcatagaaaggtaccatagataaaaaatgtaggagaacagcatttttcctgagtagatgtcatatattcagaatgaaaatcaaaagtctgagcgtcttgtaaaagttttgagatgcactgatgcagaatatacgtataccaaacacacgtgatttctctctgttatttcagtccaggctatgttcattggcaggatggtctgggtggtgtgtattcaaggaaggtactggaatgaagtgcttaggaagaccacagttagtgttggaaggtctggttcatggcccagggctatctatctactatttacagaactatagaaaccgatgtgagtgaattgatgggaagtgaattctcgtggtgaccataacccctctcacctgcatttaaagaaatccagttttagtaagaactatgatgcggagatactgagaacaagaatttctgttgcagccaaattattctttgtattgaaaaagcaggctttttctaggagacttcaactaaatatccctgaaattagaccatatgctatccaggaatttatttatttttgccagtcctactctgtggtttatcttgcgagtctaaggttgtttttggttgttttgtatcaagacacttttaagctaataacatgctcatgatcccaacctacatcaagcatggtgattttatatggaataagtttaatatatatgttacttcgtgagcataccaatagccataactaaaagatgtttaaaaaatcatcttcataccaatgttttgtttttcttttgtttgatacacaaattaaattgtggtggcagtgatacacgttttctaataattcagtactagatagagagcctgaggcttacagaagttagctccttatgcagttcatgcatttgatgagtaagagagctaggcctctgtcccagctcatgagacctgtaaggtctctgctatccactgtcccctgctgcctactgatttcaagtattacatgaagcttgtaaaaataacaagcagtatcctatgattctagcctagtgtagagacattcctaaaaacctcatacaaaaggagccaaaaccgatcatttaaattagaattatgacagattttatcataagtataagcatcagagtcaatttatagcataaagttcaattatactaaattggtgtttttagaatgtgaatgatggcttcaattaatctttcttttattctactgcttgtaaacagttttaattagatttattggtgaaagaagttgtcaaggtggttgatgagatctgctactattgatatgatttgaaaatatgttgaaataatatgggtagagtgcctcacaccatattacatattataggctttaatgaatattttattaaaaagaattatccaaaaggaaggtatatttgtacttatgattttatagtaacttcttttttttgagatgagctctcactatgttgcccaggctggtctcaaactcgtgtgctcaggagatctcttgcctcagcctcccaaagtgctaagattactaaacatgtatgatttatctccattatttcagtccaggctatgttcgttggtaggatggtctggatggtatatattcaaggaaggtactagaatgaagtgcttaggacagagtacagaggtagtgcaccgccattcctggcttatagcaacttagtttctccattttttaaattttttggagggtaaatatatccatttcttattgtttcatagattttgtaaaatggagaagactagatttatctttgaaaagttaaaggccacatttttcaccagtatttcattatacttattaatctctatatacagtgggaacacatgggagttttcttcttttcaattgtaaattcctaatacatggactggtaaagcctagtagtaattttaattttatttgttattagatacttataaaggtgttttactgaagatacaatgtgccttgagtcctctaagttcatttcctaagatttcagtacaagtaaaaataaaatataaaacttggattcttaaatcattaaatttaaccaggaagatattatgacagaagcctgatattctttgtttgatattctatgttttagtattaccctagcagtttgtagatttttaaacttgaatctggaaatgttaatgctaatattattaaaataattgaaactctttaagcttttaaacttctttaaatgtctcaacctctcatattgatagtacattctggtgaattcattacttgttctaaatgtatgatcaaatgatatggacaatgcattgtgtgaaaaaccaatgatacattcaagtgggtggtttgcattatatttttttcataatttgctgattttattcttttctaagatgatgtttgctgcttttgtttctctagggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtggtaagcatgttttcagtcttcactcattaagtttttgattcaaagtgctcagttgtagtactaaagtgattattgcaccggatcaaatgaacacaggcaacaatttcagttgccttaccattttctagcaaaattaagtatcagtcaaatgctggaacaatttatactttgtgtaggcactcattttctggctaaatcatgtggacatttacattatagcattttttttcctctaaatttttcttcaaaataaatcccaagactggcagatgttaaaatgctctgtgttacaatgatcatctaactcaccggtatagtcaatatacattttcagccaccttcagaggtaataatgatatttaaaattggtatgtatagtctttaattttgagaatagttctccctttcctccctccttgaaaagaatgtgtatagttctttttcttgaaaaggtacctttcttgttcttctataatttaagttgaaattatttcatagctacaaatgctaggaaaattctgacagtagtaaatcaatatcatagacttggaggtctcattaaagaagaattaatcagggtaggctgaaactctgagggcttaaagagctaaagttgaaaaactgggtggtcatagatatttagtatttgctgagcagtatatgtgggtgactcttgctttgaaacacacatttctatttaactgtttggatttctggagtatgtgtgtaataaatgactttaataatctctattcatatttattcatcaaaatgtgaaagattattataagaattagtgttaggttgaaaaaggtgctttgacgttaattgtgatatagtaattctacatttaaattcaaatgcatgttgaaatttgcaattatcagaatatatctgtcagtaatttatgtcactagcttatatgcagtatcgtggggtcatgggaatgtgaagacccatgtttttctgctatgctaactgtagcatgtgtgctgttttttttccgaatacattctaaaacctgaactcaatgtaattattattctcttttagaactttatgcaacaatcatttcaaaaaagagtgggggattgcatttcaaggtgggaggatctccacattacatgggcagtgataccagttatcagttctatacagttgaagtgagagaatataattaattatgtgtctgttttaacctgatctggttttttcccctatgattgtaggctcagttaaaaatgtgatagcttaaagttatttttgtgacatctactaatttcacatggctgtattaggatagcatgaagatttccatttggttaaaaaaattagctataataattctctaacagaacatgtaggacaaaagtctcatttgcacttggctctcacatacagtttcaaagatcagacaagtctttagggtggctaccaccttagctcctctaaggcctatccttgatgtgaagatactttgttctacttaaacatttaaagcatgcttaccaccaggctgtaccctctctgtgactgggagcacctttgagatcagcaagtgtgttcccagatggaagagaacactggccaccacatttcctgacctagcccttgagtcttactctgaaggccattctaggatgtcgtgtgtgcaatcctgggacaaactgtaaacaatatttatgccctttgaaatactagtaacaaatatattgttcgtgaaatcactaaatcacagatttctgaaaccatgagaacaatcatcacattttctgatgcttttgttagaaaattctctgcttagacaaagaaattatttttattagttgtgagcatattcaggctttatgttaatttttcctcatatgactagatttgaatgtggaattacccttctgctaaaggtatcctgagatcattgtctaaaaatatactttattcagagtgatgactttgtaataagtacagaaatcattttaattattcaattttaaggcatttgggactttaatgactgtagagaaagctttagtacaggaaatttgccttcaaaacctcacctgagacttttttatcctttttgtagtcagccctgttttgatgagggtaatgacatggagattcagaaatgaatggaatggtcataatcagctgcttactgggagtttaatgtgggccttacaaatagggattgtaacaggactagaggaagccaggtgactaatgtggaaaagggttgccactcagagagaatggccactacttacagatgagtgtttgaagacatggcattaacttggatccaacccaggtagtagtcatatcaaagaagataaatactatgagcagttccataccatcagcagtattcagagtatctgagcagtgacaagacttttagtcaagtaggtgacagcatctaacttctctagggccagtttagctcccaaaccttggaggagcaggaaggagagagggagacagcaaggtctaagcaaacttggaagcatctagtattatgcctggcatatagcagagatcaataattacttgatgagtgaaagaacaaatgaaggaaggagtttccgaaacaccagaaaaacaggcagagattcatagtagtttacctgctccatagttcaaaggaatcataaccagcacccagaacacaagcccagttacagaggctgcaacatagaatggggcatagaagtggacacatatcagcagattattagcaaaggcagctagaggcttgatggctacaagaaatatgccactaagcttgggttattatgcaaccaagtttgggttctcattttctcataaattgtgagtgacgaggtctatacatttaatatcttcagagcacaacactgggctaacttggggaatgcagggatctgtaggaaggtttcccatttttatacactttgtgagcttctattgaaatgtaccaagccaagaatcagaaaccggacttaaaatttttgagacaaatacaatacattaggggcatttactgcacttggcactttttgtatattaaatcctcacaaaccatcctttaaagtagtaatgttaccctaaatttagagatagactgagaagttcagaagggttaagaagtttgctcaggttacacagctagtgagtagcaaggctaggattttaaccaccttgttctgcttttggcactcatgatgtggaagcacctaattggagacacaccactggccaactcagggtccttggttgattcattaagatctctaacctagctgggtgtgctggcttacacctgtaatcccagcactttgggaggctgaggcaggagggtcacttgaggccaggagttcaagaccaacctgggcaacatagcaagacaccaacttaggaagctaaggcaggagaatcacttgagcccaggaggttgaggctgcagtgagttttgatcaaaccactgcactccaatgtgggtgtcagaataagaccctgtctctaaaaaaaaaaaaaaaaagagagagagagagagagatctctgaccttcctcaacaaatggtgaaaagtttggaatatattacctacaaggtcttaacaatcttttttttttttttttttttgagacagaatctcactctgttgcccaggctggagtgcagtggtgtgatctcagctcactgcaagctccgcctcccaagttcacaccgttctcttgcctcagcctcctgagtacctgggactacaggcgcccgcccccgtgcccggctaattttttatagtttttgtagaggcggggtttcactgtgttagctaggatggtcttgatctcctgaccttgtgatccgcctgccacagcctctcagagtgctgggattacaggcgtgagccatcatgcccagccgacaatcttataatgtaaacataatctcatttcataagatgagaaaataagtagtagaaaatgaatgatttaatctgtgtccacacagattaataaaactaatattatcaattatagaataattgacattctgctgtcattcctatatcactaataaaatgcaaaatgatcttttttttttaatcatatgttctttgaggacaaatggaaggcctatagtgtttaattatttaaatttaaaaaaataaaacttctggaattgcccgggcaagatggccaaataggagcaactccagtctgcagctcccagcaagatcaatgcagaaggcaggtgatttctgaattcccaactgaggtacccagttcatctcactgggactggttagacagttggtgcagcccacagagggtaagcagaagcatggtagggtgtcacctcaccctggaagtgcaaggggtcagggaactcccttccctagccaagggaagccatgagggaccctgctgtgacggatggtgctgtccagcccagatactacacttttcccatggtcttcgcaaaccgcagactaggagattcccttgggtgcctacaccaccagggccctggctttcaggcacaaaactgggcggctatttgggcagacactgagctggctgcaggagtttttttgtttgtttgtttgtttgtttgtttgtttgtttgttttcatactctagtggctcctggaacaccagcgagacagaaccgttcactcccctggaaagagggctgaagccagggagccaagtggtcttgctcagcggaccccacccccatggagcccaacaagctaagatcctgctggcttgaaattcttgctgccagcaccgcagtcaacctgagactatcgagcttggtagtgggagggacatccaccataattgaggcttgagtaggcggtttcccctcacgatgtaaaccaagctgccaggaagtttgaactgggtgcagaaaccacctcagcacagcaaagctgctgtagccaggctgcctctctagattctttctctctgggcagggcatctctgaaagaaaggcagtagccctagtcaggggcttatacataaaactcccatctctctgggacagagcacctgggggaaggggcggctgtgggcgcagcttcagcagacttaaatgtttatttctgcctgccagctctgaagagagcagcagatctcccacctagcacagcgcttgaactctgctaagggacagactgcctcctcaagtggatccctgacccctgtgcctcctgactgggagacacctcccagcagggatcgaaagacacttcatataggaaagctccagctggcatctggtggatgcccctctgggatgaagcttccagaggaaggaaaaggcagcaatcattgctgttctgcagcctctgctagtgatacccaggcaaacagggtcttgagtggacctccagcaaactccagcagacctgcagcagaggggcctaactgttagaaggaaaactaacaaacagaaagcaataacatcaacatcaacaaaaaggacgcccatgcaaaaaccctatcgaaggtcaccaacatcaaagaccaaaggtaggtaaatccacgaagatgaggaaaaaccagctcaaaaaggctgaaaattccaaaaaccagattgcctcttcttctccaaaggatcacaactcctcgccagcaagggaacaaaactggacagaaagtgagtttgacaaattgacagaagtaggcttcagaaggtgagtaataacaaactcctctgagctaaaggaacatgttttaacccaatgcaaggaagttaagaaccttgataaaagattacaggaactgctaactgaataaccagtttagagaagagcataaatgacctgatggaggtgaaaaacacagcatgagaagttcgtgaagcatacacaggtatcagtagctgaatcgatcaagtggaagaaaggatatcagagactgaagatcagcttaatgaaataaagcgtgaagacaagattagagaaaaaagaatgcaaaggaatgaacaaagcctccaagaaatatgggactgtgtgtaaagaccaaacctacgtttgattggtgtacctcaaagtgatggggagaatggaaccaagttggaaaacacacttcaggatattagccagaacttccccaacctagcaagataggctgtttgggcagacactgagctagctgcaggagatttttttcgtaccccagtggtgcccagaatgccatcaagacagaaccagtcactcccctggaaaggcggctgaagccagggagccgagtgttcttgctcagtggatcccacccccatggagcccaacaagctaagatccactggcttcaaattctcgctgccagcctagcagtctgaagtcaacccgggactaaggagcttggttgggggaaggcatttgctattactgaggcttgaagaggcagttttccccaaacagtgtaaacaaagccgctgataagtttaaactgggtgcagaaaattcacattcaggaaatacagagaacgacacaaatatactcctcgagaagagcaaccccaagacatataatcgtcagattcaccaaggtttaaatgaaggaaaaatgttaagggcagccagagagaaaggtcaggttacccacaaagggactaacagcagatttctctgcagaaaccctacaagccagaagagagtgagggccaatattcaacattcttaaaagaattttcaacccagaatttcatagccagacaaactacgtttcataagtgaaagagaaataaaattctttacagacaagtaaatgctgagggattttgtcaccaccaggcctgccttacaagaactcctgaaggaagcactgaatatggaaaggaaaaactcgtaccgaccactaaaaaaaaaaataccaaaatgtaaacaccattgacatatgaagaaactgcatcaactaataggcaaaataaccagctagcatcataatgacaggatcaaattcacacataacaatattaaccttaaatgtaaacaggctaaatctctcaattaaaagacgcagactggcaaattggataaagagtcaagacccatcagtgtgctgtattcaggatacccatcctacgtgcaaagacacacatagtctcaaaataaagggaaaataaagggatggaggaatatttaccaagcaaatggaaagcaaaaaaaaaaaaaaaaagcaggagttgcaatcctagtctctgataaaacagactttaaaccaaccatgatcaaaaaagacaaagaagggcattacataatggtaaagggatcaatgcaacaagaagagctaactatcctaaatagatatgcacctaatacagaagcacccaattcataaagcaagttcttacagacctacaaagagacttagactcccacacaataataatgggagactttaacaccccactgtcaatattagacagatcaacgaggcagaaaattaacaaggatattcaggaattgaactcagctctggaccaagcagacttaatagacatctacaggactctccaccccaaatcaacagaatatacattcttcttagcaccacatagcacttattctaacatcaactacataattggaagtaaaacactcctcaaaaggtgcaaaagaacagatatcataaacagtctctcagaccacagtgcaatcaagttagaactcaggattaagaaactcactcaaaaccacacaaccacatggaaactgaacaacctgctcctgaatgactactaggtaaataatgaaattgaggcagaaataaatcagttctttgaaaccagtgagaacaaagacacaatgtaccagaatctctgggacacagctaaagcagtgtttacagggaaatttgtagcactaaatgtccacaggagaaagcaggaaagatataaaattgacacctgaacatcacgattaaaataacgagagaagcaagggcaaacaaattcaaaagctagcagaagataaataagtaggatcagagcagggctgaaggatagagatacaaaaaacccttcaaaaaatcaatgaatccagcagctggttttttgaaaagattcacaaaatagatggatcactagccagactaataagagaagaatcaaatagacacaatataaatgacaaaggggatatcaccactgatcccacagaaatacaaactaccagcagagaatactataaacacctctatgcaaataaagtagaaaacctaaaagaaatagataaattcctggacacgtacagcctcccaagactcaaccaggaagaagtcgaatccctgaatagaacaataacaagtgctgaaattgaggcagtaattataatagcctatcaaccagaaaaagcccaggaccagacggattcacaggcgaattctaccagaggtacaaagaggagctggtaccattctttctgaaactattccaaacaatagaaaaagagggactcctccatcactcattttgtgaggccagcatcgtcctgataccaaaatctggtagagacacaagaaaaaaagaaaatttcaggccaatatccctggtgaacatcggtgcgaaaatccttaataaaatactggcaaaccaaatccagagtacattaaaaagcttatccaccatgatcaagtcggtttcatccctgggatgcaaggctggttcagcatatggaaatcaataaacataatccatcacataaacagaaccaatgacaaaaaccacatgattatctcaatagatgcagaaaaggcttttaataaaattcaacatcccttcatgctaaaaataataaactaggtattgatggaatgtatctcaaaataataagagctatttatgacaaacccatagccaatatcatactgaatgggcaagagctggaagtattccctttgaaaactggcacaagacaaggattccctccctcaccactcctattcaacatagtattggaagttctggccagggcaatcaggcaagagaaataaatgatattcaggtaggaagagaggaagtcaaattgtttctgtttgcagatgacatgattgtatatttacaaaaccccatcatctcagccccaaaactccttaagctgataagctacttcagcagtctcaggatacaaaatcaatgtgcaaaaatcacaagcattcctgtacaccaataatagacaaacagagagccaaatcatgagtgaactcccattcacaattgctacaaagagaataaattacctatggatataatttacgagagatatgaaggacctcttcagggagaacaacaaaccactgctcaaggaaataagagaggacacaagcaaatggaaaaacattccatgcacatggatagaaagaatcaatatcgtgaaaatggccatactgtccaaagtaatttatagattcaatggtattcccatcaagctaccattgactttcttcacagaattagaaaaaaaaaaaaactactttaaatttcatatggaaccaaaaaacagcctgtatagccaagacaatcctaagcgaaaagaacaaagctggaggcatcacactacctgacttcatactacaaggctacagtaaccaaaacagcatagtactggtaccaaaacagatatatagaccattggaacagaacagaggcctcagaaatcacaccacacatctaccaccatttgatctttgacaaacctgacaaaagcaatggggaaaggattctgtatataatacatggtgttgggaaaactggctagccatatgcagaaaactgaaactggacccctttcttgcaccttatacgaaaattaagatggattaaagacttaaatgtaagacccaaaaccataaaaagaagaccaaggcactaccattcaggacataggcatgggcaaagacttcatgactaaaacaccaaaagcaatggcaacaaaagccaaaattgacaaatgggatctaattgaactaaagagcttctgcacagcaaaagaaactatcatcagagtgaacaggcaacctacagaacgggagaagatttttgcaatcatccatctgaccaagggctaatatccagaatctacaaataacttaaacaaatttacaagaaaaaaaaaaacatcaacaagtgggcaaaggatatgaacagacacttctcaaaagaagacatttatgtggccaacaaatgtatgaaaaaaagctcatcatcggtggtcattagagaaatgcaaatcagggtccgggtgtggtggctcacgcctgtaatcccagcactttgggaggccagggcagccgagatcaagaccatcctggttaacacagtgaagccctgtctctactaaagatacaaaaaattagccgggcatggtggcacacacgtgtagtcccagctattcaggaggctgaggcaagagaatcgcttgaacctgggaggcggaggttgcagtgacccgagatcacgccactgcactccagcctgggtaacagagagaggatctgtctcagaaaaaaaaaaaaagaaagaaatgcaaatcaaaaccacaatgagatagcatctcacaccagttagaatggcaatcattagaaagtcggggaacaacagatgctgatgaggatgtggagaaataggaatgcttttacactgttgggagtgtaaattagttcaaccatgtggaagacagtgtggcaattcctgaaggatctagaactagaaataacatttgacccagcagtcccattactgggtatatactcagttttgtaaatcattctactataaagacacatgcacacgtatgtttattgcagcacaattcacaatagcaatgacttggaaccaacccaaatgtccatcaatgatagactggataaagaaaatgtggcacatatacaccatggaatactatacagccataggaaagaatgagttcctgtcctttgcagggacatggatgaagctggaaaccatcattctcagcaaactaacaacaggaacagaaaaccaaacatctcatgttctcactcataagtgggagttgagcaatgagaacatgtgggcacggggggggaacatcacacactggggcctcctgggggttgtggggcaaggtgggggatagcattaggagaaatacctaatgtagatgatgggttgatgagtgcagcaaaccaccatgtccatgtcacatgtatgcccatgtaacaaacctgcacgttctgcacatgtatcccagaatttaaagtataataaaaatcaaaaataatcaaaaaaataaaacttctggattctttttccaaattattatttttactttgtcacatactgtctggtgcaaattttgtctgatgaaaaattggtacataatttaaccaaaaataggctgtatatcatggcttgcaacctggagacctctggtagatttctttagtgcatcccagccaagtgtccttcagaaattctgttgttgccaggctctcttcattgccctcaaagagctctacataagcagtggttataaagagctttgcatgatatctggagtttctctagtaatggtctcatgtgcctttacctgtgatcccaaagttaaccttggctatctataatttgtgatggcagctattctttgggtaaacaaattagctatctcagggtccataatttgtgtagaaatcctgtgcattacatgaactttgaaatagcctaggaatagagaaattcagtttctggttttagctaatgtcttgagagcttctttgctgcttctgtaacctagatagactttgctgtcacatcatgttccaagcatttgttgccattcagatgcagaatgctttgaagtcatcatttgtcattcattcttccaggaacacctagaattcttaaatagttttttggttctttactttccactttatccaggtaatggttgagataaggcactttatcccagagtgtttctggtaaaatgtttccatgtcagtttctctgagtagtctttcatccatcctgctgttgttactgcctttttccattaaggagcctgtgaatcctcaaacagcctgagagaatgggccctggattttaggaactaggccatgcctggttgatacctttctactaggaagtccagagtgttctttatttaaatgtttgttatttcagtcaaactggattgaaggataaagtgaaactaagaatgaaggaggtactcattgatttatccagttacaagtcagtctaggagcaaagttataacagtatctcttattttattcgtcatttgctaccctttttttaaagatagagggtcttgctttgtcacccaggctagaaggcagtggtgcagtcgtagcatactgtaagttcacactcctgggctcaagtgattctcctgcctcagcctcacaaagtgctgggatcataggccagacccactgtgcctggccctgctttcttagaaaaaaagaactttataatatgaatttgttgataactcctgttagcttttggcactgtttatattcaaaatagttcagtgagactagttacagggttatgcctacccagaaacatgctttcatataccttgattatgtgtgcttttttaaaaaaaatttttttatattaaaaacatttttaaaataaaaattttaaaaattttaaaaaatatttaaaaattaaaaaaattttttaaaatattttatttctttatatacatacataaaatctagaataatatgacttaaaatttgtgatctgtgaatttcatctgatattgattacatattatttgttacatatactccctctattttttttttaaatctcaaacattgcaaaacaaacagtgttcacatggtgttttaagataaatatcagcccctgtgatatttgcaacattacagcatggtaactacattactgaaacttagaaagcttaatataaaaaattgcaaaacaaaaggaaaaaataaactttggacaggtatattagagatagtaattattgaattttgaggtaaagaaagaaacaatcacttttatttcacattcaagtatatattctaaagaatatttaatgtatttgcttgtttctgtggcagagaaaagcagcaaatccattagtatatatgttaagtaaatgtttgtagaagatctgtatagatgctaaacgcagcgtatacataacatgaacaagacataaagcaaaagtctgccctctaggagcctccagtcttgtcagactagaggagatattcaggtaaacactggcagtggtatatgctgattcgagtaattaggagttcgtgggaacagagggtaagaaaaacccctttatagttagagatgtagatggatcaagagaaacttacctaaagagtcctaattcttgaagcacaattaggaattaaacagattggctaggcacaggtagcattcaatgtggaggataaaccatgtttaaaagaaaagagctataagggaacatgtatccttagagaccttacttacagtcagaaaaatgtacctatatctgtagaaaaccacatagtgtgtggaactagaatcacctaggagctttcaaaaaatactgccacttaccagagattctgacgagtgaggagtggccagggcattcacggtttaaaagtcctccggatgattttaatggacacctggttcattgtgtgaaaaccactttatcacaaccacttggaatcagacatacctgtggtcacatcctaggcctttgattcactcatttgtgtctatagacacataatctttgtgatcctttttccttatctgcaaaaatggggctaatacccacttcagaaggctgcaattcactcattcattcattcactcaagtactaattcaacaggtatttattgagcgcctactgtgtgccaggcattgttccaggctctggagatttagtagggaactaaacagatctcttctgatctgtacccctcaaaaaacacaaaagaaaagaaaattaccaagggaatttatactctactgttgtaaggattaaatacaataaatagcaccgataaagcactcagcatgatgctgacacaaaataaataaggaattactactaataatcatgtttgcatagttaactggggtcataatatgaaattaacactttgatttataatgaagtctgattaccttaatggaatcaatgtctgatttaaaacaaacaagtgattaacccataaacagcaccagaattagtaagtttgtactttgtttttctctgatgaggatgttcattggcaaaaggcaattataaaccaaactttcttatgtctttcaggaacagagatacttacaaatcattatcacaagaatatagtcagtatcaaatataccaattacattgttatatgttatccttcagagaaaacaggatgccacttgataacaacattgcattaatatctgtctttgagattctgctgaaccccctgcaggttagcttttggaatagaaaactggcagtagtgcaggtcaagtgctttcctaatctgatttctctgattagggcactctctgatggggctagcagtgacctatcttcaacatggcgctccttgaaaaaacaatataactaaagtgatgtaacaaatttacaaaaatttaaaataaatgaaggaatggtgtgtgtttgtgtgtgtgtgtgtgtgtgtctgtctgtctgtctgtcttttggaatcaagtttcaaagtataaagctattgttactgattgtctgcctgttcggcaaatagctctacttatcgaaagagggaacaatttgagatagtgcttgctgaatagttgatgtttcacatttttaaacgctcctaccgactttacttggggacagtgccctaaaattgttcagatttgaatttgctctgctgaattaaagtgaaagatcaattgtcttgatgactctatagaaacaactcaggaaatattattgccagttattaaaagcagtatttttacataataaaagtattattctgcctgtaatgtgcaacagctgcatcatatgcatttttagatttccagtgtattttatttgacgagatttagagagctgagttttattagcctctggtctcattttattaaaataaaaattgctttttcttccaaaaacatttttaaatttgacctttgcttttaaataattatagtagattatgtgcaataatataaacatctcaataactttctgaagtatacattaaaaatgcactatctggaaatacatgtttattcatagtaaaagaatgcaaagaggaatgataatgaatagcttctgttgtccatttgctaaactagtctgttagtcccctgacatagactcttttagtcttctatgctaaatttcttataattcttaaatgactaatatagaaattagggtgctggtctggctggattttcatatgcaatctgacaatgtataacaaagtacaagtttaacctgaatatccttgaatagaaatccaagttcaacatatattcagtatacaatcaatccttgtcctgctgtcacctgggcagagagtggacagtggcacagcattaagtcagctgcggctcagggaagtgttggtggacagagaatgccctaggccctagtttctgacagcttgttgataagatttggaatgcacagatagttcttgttgtctgcaggttgctgctttgtgctgggaggggttggggattagaggtgctacttgagggcacttcatcaggcaagagccatcgacctggcagagcagctaaacatggcattcaaaccaacatgttcagaggcataattattttaagttgaaatggtataatctatattgtattgtttcttctcaatgaatcacattaggtattacatattctgttttttcatatttttgttagtaaaaatgtatagctaaatgcaaagagtttgtttcccaagcaatttttgaggtcaacagaagagttccctaagaaaggccttcttaacattgacagtattgacttttggggctggataattctttgttgcgaggggctgtcttgtatgttgtaggacacttagcagcatccctggcgtccatccattgaatataatagttcccctccagctgtgacaaccaaaaatgtctttagacattgccaggtgtctcctgagaggcaaaataactcagttgaaaaccactgccctaagaaaaagggaatacttgaaattcattttatttttctaaatatagaatcagggccagagtgaatagaggatatattttatcttttaacaaatttcttttgtactataagaattacatttgtaatatataccttatattgcaaaaagttttactacagagctctcttgaatactacatatattcagatatcatgtaacttcttattcctgtcagatggcagaattagttattaatacattctaatgtctcttttattctaaagagtcttctataattctgttcattactgctgagtaaagaaaataaattgttaaatattaccttaaagaacagcatccgttttgcctacaagcttttgtgtttcagaaacaaacattattaaacgaagcattaaacttcaagaattagaattgagactctattaggaagttaaaaatgtactatgaataaggtatgaaattgtgttctgttatactttaaatactagaaaaacaaattgttagatttcaggtaaattaatgctattcaagaacaaatatattttatgatatgcaagtttgcatatcaacaaatagaaacaatccttatatatccacgaaagcatttctggaagaaattctgtcttgtagcagtttattcagtgctgccatatgtatttccttgaccaatcatgtagcatttctttagtagcagttctacttcaaacttcacatttcagacttgttttcccctaataaggtgtgataggctagtggaacacttataatttcccccaggaaaatcaccatcaagtaaatataccaaacactttatcttatgtgctcaaaaggcaaggtgtcatcatcacctttcacataccccatgagatttatttacagcttacattgactgtgaaactcttttatcccctgggagttctactttatttattccagataataggacacttgcaacctattaacagttgtaaacaggtctttcaagtacatctgacatagcaattacaaaatgtatttgttagacaaatatctagaattaaatcaggacaaagatgaagattagatgaccacaagaagtttctgcatagtttatctatttttcaaaaaaaaaatacaagtattatagaccctcagctacaaaattccagtgaataatttaatggatattttacttattatattttagaaaaacattgatttgatgaatgtttatttaataaaacagccttaccctaaatgatagtaaatgaacacaggattaaagggaaggagggaaggcctaaggaagaatggatagatggatggaggacaaatgtataattaagaatatcaactttgagctgagacctgcatgttaaattttgcttttattttatttttcagccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtaggaatgactagttggtgtctttatatactacattctaattctcaaagtgtggttttttgtttgtttgtgtgtttccatggccaaaaagttgtaaaaattttaaaacagattttggcttagggtttggaacattttactagagtatagataatgctgtatttgattaatgtaacgtttataaaggctacaacatccatgtttagaatagtggataagaggttggacgctaaagtcacattgcctggttacatcactgtacctcaatttcctcatctttaaaacggcgcttacctcaaagagttaggggaatatctggcacatagcaaatgcctcctgaatgtttgttgttgttgttgttgttgcagctatcaagaataacaaatattatcaatcccctaaaaattgttctcataaagattaacaaatattagtgtctataaaacattttacaatttattattgcaagtttcctcataagctgtacaatattttggttgaagtagaaagaaaaccttatgaagtatgctctcataaaagttttttgcggccgggcgcggtggctcacacctgtaatcccagcactttgggaggccgaggcgggcggatcacgaggacaggagatcgagaccatcctggctaacacggtgaaaccccatctctactaaaaatacaaaaaattagtcgggcgtggtagcgggcgcctgtagtcccagctactcgggaggctgaggcaggagaatggcgtgaacccgggaggcagagcttgcagtgagccgagatcgcgccactgcactccagcctgggcgacagagcgagactccgtctcaaaaaaaaaaaaaaaaaagttttttgcataatcctctaagttctagagtaaaggatgatcagatgtgtgggctctgctgttggtacatgaaaaagatattaaagttttaaatcttatttcaaagtggttgttcagaatttcagcatgactgtgaattaatgaatttggtaaactatagatgtagagaaaaagtgacagcatcaaatgtacactgaaggtacaaacgtgtcattcattgaacccacctaaagaacaaaatgaccttttcctcttttccctggtgaggatgaggcaatatatttttttaacttgcattttaggttcaggagtacatgtgcaggtttttatataggtaaacttcatatcatgagggtttggtgtagagattatttcatcacccagataataagcgcaatacccaataggtactttttctgatcctctcccctctcccaccatccaccctcaaataggccctaacatctgttatttccctctttgtgtccatgaggtctcatcatttagcccccacttacaagtgagaacatgtggttatgtggtttcctgcttctgtattagtttgcttaggataatggcctccagctcaatctgtgttgctgcaaaggacatgatctcattcttttttatgtctgcatagtattccatggtgtatatgtaccacattttctttatccaggctactattgatgggcacttaagttgattctatgttttgctattgtgaatagtgctgcagtgaatacacgtgtgtgtctttatggtagaatgatttatattcctttgggtatatacccagtaatgggattactgggtcgaatggtatttctgtttttaggtctttgaggaattgccacactgtgttccacaatggttgaattaatttgcactcctaccagcagtgtataattgtttctttttctttgcaaccttgtcaacattcattattttttgactttttaataatagacattttaactggtgtgagatggtatctagtggttttgatttgcatttctctaatgattagtgataatgggaatttttcatatgcttgttggccacatgtatatctttctttgaaaagcatctgtttatatccttcacccactttgtaatagggttgtttgttttttgctcgtaaatttaagttccttacagattctagatattagacctttgtgggatgcatagtttgtaaatattttctcccattctgtaggctgtttactctgttgatagtttctttggctgtgtagaagctctttagtttaattagatatcatttttccatttttttttttcgttgcgattgcttttggcatatttgtcatgaaatctttgccaggtcctatgtcaagaatggtatttcctaggttatcttccagggtttttatagttttgggttttacatttaagcctttaatccgtcttgagttgatttttgtatatggtgtaaggagggggtccagtttcaatcttctgtgtatggctagccagttatcctagcaccatttattgaatagggagtcctttcctcattgcttgttattgtcaactttgttggagatcaaatggttgtaagtgtgctgcattatttctgggctctctgttctgttccattggtctgtgtgtctttttttgcaccagtaccatgctgtttgggttactgtagccttgtagtatagtttgagtcaggtaatgtgatgcctacagctttgttatttttgcttaagattgcattggctatccaggctctttttttattccatatgaatttttaaatagttttttttctaattctgtgaagaatgtcattggtagttggacaggaataacattgaatgtatagcttgctttgagcagtatggccattttaatgttactgattcttcctatccatgagcatggaatgtttttcagtttgttatgtgtcatccatgatttctttgaggagtgttttgtcattctcattttagagagctttcacctccctgcttaactgttattcctaagtattttattctttttgtggcaattgtgaatgggaatgcactcctgatttggctctcggcttggatgttgctggtttataggaatgctactgatttttatacattgattttgtgtcctgcaactttgctgaagttgtttatcagatcagggagcttttgggccgagactatggggttttctaaataaagaaacaagttgtctgcaaacagggataatttgacttcctctcttcctatttggataccttttatttcctcctcctgaggatgaggcaatacttagtgctgataaattttactgagaaactggcaaactgaggctgttgtatgaacataattgattctaatactttgtcagtttagcaggaatttagttaataagctgatttattatttattaacttttgttgcatatattacaaaggctgtcagattttagcatattgacaatcatataccagacacatgcatcgcaggtttaatgctcaaaacaatcttatgaggaagatactattattaattctcttttacagggaaatgattttaggagaagagatgtgaagcaactctttcttgttaggtagatacacctgatacacctggatttttgagtgatttgtcattacacaactgtacttgcttattaattaactaatgctgtttgcagatggattaagaggaaacttaaaaatttttaaatatctgaaattattggatcctcagcatgtgaagcagttttattcccccaacctttctaaagcaaaccctgagttcttaatgcataattgttgattgattagtgggatccaaataagaagtctgagattaactttaatgaattaattattaatagatgatattcaaaaagctggttataactcttctaatccaatcctgccacattcacagtttcaggtagtttgttactggttatattttgtagtgcttaattgaaatgaagacttttgtctttgagttttttctttttgtgaggagctacttagcgtattttgtctgttttcttttgctgtagtcagcacaaacggttacaactgcatcaactgtcatttcccttttatctgaatcctgctgatctaaatgcttgattgtagtgcagcttcctgtcttattcttgttaacaggatctgatccagtgtcacagttacaacctgttaggatactgccgtgtgaagctcagaggcttatctttctgctctgtgcttgtgattttagacaatcctatctgcaggttatttcctcgcatgctaattgcattacgtattgaagtctaaaagacatggcaataaatgcacacacttattaattgaccaaatgtttggtcatttggcatttaaatgtatactctacttcttccttgtgaaattctgaagcatatttttgaatgttgagttccttctgaggtgaaaaattttcggaatcagttaaactattggccagttcttcttgccacttcttcctctctttttactgcaacttgttagacagtaaagaaatttaaaataccatagattgtcagccttctggttcttacataattgcttaaaactgacatctttacagcacccagtgtgatactacagaaaaaaaatgttaaattggaaaacaggaattcaagaattactgcatgtgatgttgctaattaggtgagtcagcttggatcgagatgctcttattctctgggcttcatattccttacatgtaaaattagggggttgcaccagataatctctaaggtcacttccagttagaacattctagggacatttaggtcattttcttgtttttaacaccagccacaagctactgaaacatttatttttaaaaattatatacatatatctataagcatatattacatatatcacatatacacacaacatgagatttatatcaatattcatattatcctttctttactgactatcttttaaaagactttgttgccaagtactttctgtactccaaaattcatacttttttttttttttgacactaagtctcacactgttgcccaggctggagtgcggtggcgcgatctcagctcactgcaacctccacctcccaggttcaaggaattcttctgcctcagcctcctgagtagctgagattacagatgtgtgccaccatgcccggctaatttttgtattttcagtggagatggggtttcaccatgtttgccaggctggtctcagcaatttctttccaggattatgttaagaaattattcaaatctgtagagtctaggaaagactgagtgttttagccatacccctgctttactacaaagagttagtaattggagaaatcattgtttgacttattttcaagatgcacagtaattttttatggtgcaaaaagaattcatgaatgcattcattctctcatttactgaacgatattcagtagaaaactgttgaaaatatttcaagtagaagatgtgagaaatgtctttgaaatgctttaattcctgtcttatcaatgacaataaaagatccacatgagaatagtgcccaaactcatgactgatgcccagtaacttgttaaatgaatggataaatgagtcagtcaaccagttactcaggtaattaaacacagaaagatacatccccttattcaggactcagggtaatcccacagaggtactaaaatataaaaaatgtttatcatgtgttaacattctccttggaaacatgtttgcattttgagcacttcagctataaaatacagcatcttggttatgcacctagacctaaaggagtggttttcatactttaatgagattagaatcacatggggtgattgttaaaaatgtaggacctcatccccaaagattgattcagtagatctgcagtggggtttgataatatttttctgccatgtgattctaaatgcaaatagttaaaaacacatgcactaaaagatactagcatctcttatttaggcttcaactttttcatcgtttacttaatgtatttgtaaatgatatggttttttgtgaaacttaattaaaaatctgtctcctcagataagttggtaagaacactgtgcatggcatagtgaaatactttaggtaaacaatgatgactgttaaggtaattcatattacataggcgtaatccaataaaaaccaggggacacgtattccagacactgatgaaaacattagattgacatttggttagctgcaccatttttacatcagcagtctatatgagaaaagcatgagtattccaggaaaggtgggcaaacgacttggtttctgatagtttcagttcgcgtttgcttgtattaaaatataaaataaattattcttggctgaaagttttattctgtgaggtaatcattacacaagtttctaatttgggccactaattgttgtatgtttccattacttacacagaagaatctaataacccttttcatgtaggcagaaaaaaatataatacccattgactacaaaaaatagaacgtttaaagctaaatgaggattagaatgacagtgaaaagcatgcctatgttgggattttttaggtgtttagtggatttaacatgatgggataaaagactttctattcagaaaagattaggaaagaagatgcttttaataatgtaggaaagtcttatcggtaggattattttaattttgcatttttgtagaggatgtttggctactgcttgtgtgactttttttactatctccagaaaattgccaagaaaccttaagagttttcacatagaggtttatgtaggttgtttttttatatctgtaataaactttagaatggctcttaaaaatgtagtcacatcttcatttaaacaatttaatacactatggctctgtcaattattaatctatgtgattagagttttgatatggtatagagtatagtaattgctatattaagaacagtggttcacacctgcagtcccagctacttgagagacttaggtgggaggatcacttgagcagggaggttgaggctgcagtgaactgagattgcaccactgcactccagactgagtgacagagggagaccctatctcaagtagtaataataataataataataacataaatgaaataaggtaatggctaatttggtgtattgacaagcttgtttcaaagttgtgtctattttcctgtcctcttgggtttgcacagtcattcatgggaatgaataaatgacaacgtggaagtggatttaatggttctgtctttggtcattcctattcagattttattttatgtttttataagagatcaagtggtagattcttagttctgttacctatagaagcatgcttgtgttttctggcctgaatagtaatgatggagtctgccttttaggcttcaaagaatgctcccatttgatcctaacagaaatactatgaggtagctaaagtaggtgtccttttcttgaatttttttggaaggagaaaaattgatcaaatatgtacaattattgaataaccaaatgtattagtccattttcacgctgctgataaagacatacccaagactgggcaatttacgaaaagaaagaggtttattggacttacagttccacatggctagggagacctcacaatcatggcagaaggcggaaagcacgttttgcatggtggcagacaagaaaaaaggttgcacagggacataacccttttaaaaccatcagatgtcatgagacttattccctatcttaagaacagctcaggaaagatatgcccccatgattcaattacctcccaccgggtctgtcccacaacatgtgggaattcaagatgaggtttgggtggggacacagccaaaccatatcaccaactgaaactagaaatcacatcatccgatatttatctagggattttaattgtacaataaattgactacagttacatttacctaatcaccagaattatgaggattacaaagtagatattttaatcctttttaaatgaaaatagagataatttctttacattaaattataaactcatgatcagcgatgctgtggacactttgatcaaagtgattgatcaaagtgattatctaggattactttttaaagtaatacttagaaaaatttagcttgttagttccagcttaatagaaagtgaagtccatgctgcttattggtgaacatgtagctatatgtctttgaatacgtttcttaatattggccattaactattaaattgacttctcaaaatgttaaaatggacaaagtccctgtttcttgttataattagctttctgttcctgcttttgattgttattctccaagatgactgagttaattatacaaatatggtgaacacaaaacatattacctcaaagggatatctccttaaagaatatgcaaatgaccctccacttttgaataaattcaaatattgacattaatctccttagaatcccagtgctttaacttgagagcattgctgagtttaatactacttataaaacttacgttattttgaccattttgaaatatagtttttcatgtattaaaaaattagagatcaaatgacaggattattcatattatccagatttgtatggtgtgttgtaagctatgcattattttattcagtattcatgaccttttaaatagatgttaatagtgttttcattgtgaagattccttagctagtaaagtgataggaactggaactcacaatttttgactccaaaccctattgtctgtccgctatattattgctatttagttaacaaaagaaggtttatttagaattaatttacattttcttgggaaattttcctgattatgttttcttttgattatttaaagtttataattattccatagatgtttttctggaaatagaacttaaatgttttcagtgaatatcttcattgtcaaatcttgccttagtatttgtaaagtaaaaggctcatgttgaatcacattatatgtgtagctaaatagatcttattgttttaatgcaggtttgaaaaccatttatcaaacaatattttttttcttttgtgacagagtcttgctctgttgcccaggctggagtgcagtggcacgatcttggctcactgcgacctccacttcccaggttcaagcaattctcgtgcctcagcctcctgagtagctaggattacaggcgcctgccaccatgcccagctaatttttgtatttttagtggagatgaggtttcaccatgttggccaggctggtctcgaactcctgtcctcaagtgatccacccacctcagcctcccaaagtactgggattaccagcttgagccaccgcgcccagtcagaaaatatttttatgtgttgacccagtacatacacatataccaataaatctgtacatttatctgccaaaaataatgaaaaatgcctatagtcatggatatattcttggaatattacttgtaatatggaaatactggaaattatctagatatcctccaaaagagttacctgtattatgtacactatttgatgaaatttgatgcagccatcaaaagtattcactctggaaattatttagcaaaatgagaaatgcttatgctgcattgttgagcataaaagatcaccaaataatagctatactataattacaattatttttaaaaatgtgtgcatacatacagaagactggatgagaagagaaaaatgaaccacagtgttgttagaattttcagatttaattttatattctgtttcaaattctctgtatgataaatgttataatttcttatcctgtttttaattatgagattaaatttgtgaaatgttgtcagttataatttactaatgtaatagtatgtctaagagatttattttgggtatcagcatagtctaaagtgtccttgagtttatcagagaaaccagatcaaactcatattgagcaaccaagggatagatcccattttattgatgatgtctattagggaaaatgtgttttagaaggtttgggaagttcatgttcccataggtaccccactattcagatgcatatctaatgcttggtaaatttccagtcccactggcctgtaactctcaccagtacaagttttcacaagagattttctcttccttattttttcacaagcaagaataatgtgagagtagctattacagtatgtttctgtcctatttcttaggagaaaccgtaagctgtaaaaaaaaataaaaatatgaaagagtcaaacatgcatattatgcaaaagcagttgactaagttttttttaacctcagaaaaggttggttttatgacacattctgagctaattcttagttattaagtctgcttaaatatttttagaattctttctaaatgttccacaggagagtaaagaacatgaaattataataaaccaatccttaacctgtagaaacccccccccccacacacacacacatgcaaatacatacacacagaacctaaataaattcaagtcttctttcttgttaatgcggcaaagagtaacctaaattggaaaagtagagtattagttccctgctgccaattcattttgagcatattcaagaaagcaggaattactgagggagcaaatagcagctgagagagatcacttatagaccttctgcaagtttcctgtttggtgatgcctacattgacatagacttgcttaaacagaaaagtagccctttcgtttatgcagtagtatatatttagcatacacacacacacacacacacacaactttttatcattatttaatgtaggcacatcactcttcctgagtatagtgatgagcctcacatacaataaattttgattaggtactgggtactgttttagcaagctccatagctgatgctaatgttcagccagagaggaggataattattctcggtaacagcttgatcattttttgcttttaagttataaatcttggtaatactttttttcttatgttcaataagataaatatgctaataaaaaaccagaatcttgaataactttttaagtcatttttgtgatcttaataactgagtgtagtggtgaatgacactggctcattgtatgtatttggaacacaaaactttagctaggttgaggtttccaagtagtgcaagatatcatttataatgctcttttttaagatgtagcatgatacagattatagtatctccttctttaagaaacactttcctcaataataggatatgaatataatgtgggaaaacacccagatttaaatgcaatcattgtatttatacaaatccaagaaaacctttgcttcctaagtcgtagtagggttacagtttttctttcttgcttaacttcaaaataaagtgcttagtatctgcgtttgctatttgtgaaaagatacttgaacaattaaaaactgtttccttgaagcttgaagtaagagcacgaaaatattaaaaggacattctgtgttttagatggccctcttgtggtaaaagggtcaaagtatcctgaatgaagactgcttttaaatagtaagagtcaaaattgcgcagatgaatgagaaataatgttctcgccttttccctaagatctccgtggcaaaattaacagaattagcaaatataaaacaaacagacataacaaaaccaatctttttttactgctttatatagctaccaagtgaatctctaaagatcaaaaaaataactcctggaaacattttcataaaaagctatcaaatttgattttgtatatttttcacttggaaataattttatatttacacgaaagttgcaaaaatggacccaagagtttctgtctacgctttactgatctaaatattaatatcttacataactgtagaatccctcttaagaccagaaaaattaacatagatatgctgctgtttaaccaatctacagactttaatcaaattttaccaattgtcctcccaatattctttctgtgactccaggatcctccagcttgtgataatatctcagtctgtcttgcatgaccttgacactttgggagagtactagtcggttattagtaaaatatctttccattcacttcatctgatgtttcatcttgattaaattcaggcagtactacctctactgtgattgtgtgcccttctcattgtatcatatcaatagatacacaacatcattatgtctcattattggtgatattaattttgatcacttggttaaagtgatgttttccatgtttctttactgtgaagttattatttttccctttgcaattaataagtttatcaacaccatttcagattgtatttttaccataattaacattatacatgcattttcttatggacatttatactgaaatggagttataatttgtaactaaactaggaaatgctgaagttacttgttgccttgtttgaaaatcattttcccttttcatctatagccttctgtcaccagtcttgcactttaagttaaaatcttcagaaagcttcttcttcttcatgttgactaaacctcatgtacttaatgacctcataggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatggtgagtagagatatcagctctctccttgttagcagtcagaaaagcaaagtgagcaactatatctgactacaagctattcatttagtaacctttttaaaaaaattgctgaagatatgtttgttcaggtatcccagacaatatataaagaagttactttcacagaagtgagggtaactcctcaaatggttcagattgctcctactcttggcctaactcttaatctgtcttattgtggatgtagggtttctgaaatctctgctttgtaaagaaccacctgtctccttttcaacttaacgatattgccattttcagtcttcttatttctgtgtgccatctaatcagccattgttttcctttggtgtgttcttttgcacatcaaggctcttctttacatatatcttgcttttaacaataacatgatctggaactatttaggagaattgttcaacaaaattgttcttagaattagctacaggattttgagtagtatactatctagattgtctgaaataatattgtggcataaacataatagtaacactagagaagcttgactatgccattatatagacaggagagagacagcagtactcaaggagttagaaattggatcattaagaatagctactaaactatattctcaaggtaaattttaatgtgatctagtagctgattttaatgagcccattctttgttctttgcttacctgttttaatgttgtcatttttttacataaatatatgacttaaatcaatgaaatactcattttaaaagtcactgtgtagtatttcataacacagtgaaataatcacgagagagatcttttctgtgtttatggatacttgagcaaaaatacagaaggcagactctctcctcctctcttcctttcactcttttttttttctgttagagtatcttgtttgtaattaactacaaagaggagttatcctcccaataacaactcagtagtgcctttattgtgcatgcttagtcttgttattcgttgtatatggcattccgatgatttgtttttttatttgttttttctcacctacccaaaaatgcactgctgcccccatgatgcacctctgcttgctgtttatgttaatgcgcttgaaccccactggcccattgccatcatgtgctcgctgcctgctaattaagactcagtcggctgtcaaatcactgaagcgacccctcgaggcaacctttgacctggtactatgacctttcaccttttagcttggcatgtagctttattgtagatacaagttttttttttaaatcaactttaaaatatatatccttttttctgttatagagttgtaaagtacaatgaaaaaactgagtgtggtttcctgacaaaattagtagaaagactataatctaagtacatagatggatatcatacaataaaagattctgaaagcccagcagcccacattcagtttaactacattgtagaatgttctgaagaaatagtcggaggacataaagagtgtatttttgactgtatatttatgtacctgtttggttagcatggctttagtggtagaattatttacattttaatatttatagttcagtatttaaggaaaaaaacttgcatgctctgggacatttgcatgtctaggtagatctggggggaggagcagagtgggttagtttttattttatctgtttcagtcactctgtacaattaactattaacattgcttatacttgtcaatcctcatggagctcgcagtgcggcttttcttcttttcccaaatcaatggcttctcacagaaagcctgaagcattatgggacataaagcactttaacacattataacatgtgctcttgtactagtgagattttgttttggacaaaaataatgcttcctttaaagcttttatcttgctttttttttttttttcctccttaattttttgttcattggattttttccctcgggtagttaagtgctctgctgcttgcttgctcatgcttcctaacaattttagccttcgactgatttttcttttttctttttctctttttactggtatttgttttttatactcattcactaaacagggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggtaaggggtggggtttcttaataaatgaatctgatgatctacagagagtcctactgttagagcagataaaccacaccccaagtttgtttgtaattatagatgaggtgtcaggtaaggtggtcaatgatggaaacttatctgaggtatctcatgtggttttccttaaaaactaaggattgtagcttaatgaaatgtggattaaagatcagtggtattttatatatttatttgtgtttgtgtaatttggaaatgaaatatagttctctttttttctctttcctcaacacttatatatgtctgtcaagctattttatgatactttcttgctgtaagacccctttgccttcattattccatagagttaatttaaattatataaaacagcactttcagttttgatttttatttttcagcctttttgttttcaaggtcaagaatgaaaacaactatgcgttctagagctcttaaaaagggctcttattggcatcaatcagtacactgtttaaaattatgactgttcctaagctaatattgaaataaccctaagtgctcagcaatgtttaatttattatggagttctacatttgtggtttcagcttattttcaatttggtaatgtatacataatctagaattattcacacagattgcaaagtttaaaacacagactagctactcatttaattacctggaaatttactctttttattcactctgaacttacttcagaaaatacatataagctcattattatctggaattttactaaccagaaactcaaatctcactttcctctttattgcttcacccttattttcagaataccatggttttagagacttacttaataaaattattttattaattaaattaatgagtagatatatatgtcaaaaatccagctcccaattttatattagactatactggcagtatttacagtgtattaggttcataatgctataagagaatgtgaatttatttttgattcacaaaataaattatatgagcttttaatactaaccataagttttatacagtacatatttgaaaatcagtcatccatatgtaaaataaatacgaagtaacaattaactacaatattccactagctgaaatagccagtgccccagacacgtggataaaatgatatttgtacttgtgaaatagtatctttcaaattgcagtttgcccatattggaacaaaaactaaatcattttgacctgcagcctcacatttctcttatgttttgtaatattataactttcttctcaacatgcatagtttttcagaaattaatctttttgctcttgtgcaagttgctgtgtccctagattttcgctgcccccaacaaacaatccatcagtttttctatagtcagatgagcaaagtttcaagggattatatgtaactatcataatctctttgaagaaattaaaacttatttttgtcagtttattttattggctaaaacattaccatgataaatgaccgtttcagctagaccagaggtagtgagttatctcaatagattgttcacagtcagttacagattgaactcctcgttctactcattgctgtcttctcactgctgcacttgactagtcttaaaaaatatgatagtttctctactaaagtctaaaaaacaaatctgtgctatttaaagaaagctgaaaaaatctgttttatcaaataggtttcacattagttttttcaacaactctcaaatgactatagttttttttctaaataagtataaccaattacatggtatgatgacccttacttgtgacactagtgtctccctagaatagctttttgtctgtggatagagccaaagatgctagataaagttcaaattagggaaaataataaactcattcataaatcagaatcaaacttgtctctctgtgctaggttaagcattgctaatttaaataaaatctgcattaattgaaatatgctgaaaattttaagatatatttgcatttattatgatgcattttgcatcagagatattctattcttgatcaatatttctcaaatattggccaggcgcagtgactcatgcctgtaatcctagcactttgggaggccgaggcaggtggctcacttgaggtcaggagtttgaggccagcgtggccaacatggcgaaaccccatctctactaaaaatccaaaaattagccggatgtggtgatgcatgcctgtaatcccagctacttgggaggttgaggcaggagaatcccttgaacctgggaggcggagcagtgagccaagatcacatcactgcactccagcttgggcaaaggagtgagactccatctcaaaaaaaaaaaaaaaaaaccacacaaaacaacaacaacaaatatatatacacacacacacacatatttctcaaatataatcaatatagtgtgaaattattgcattagtaacataaaataacatttatttgcaactcagttataagggcctgaaacagcaagttgacctttattaatcacataatcagaagtaggtagtgactccatgattattttaaaatattttcattatataatatatacctgcattcacaaaaattgacgctgtggcatgaaaaggttaaaatggatagctcttcattatttctgccccatcactttgtcagacagtcagaaaggaaagaagtctaatgcagggaatgtatatgcaaaagcctcaggggccaggcaggaaacacaagtgaagcaagaataaattgggagctgtggggtctgggaggcacaggggagcacaggctcagtctaaagagtatagtcaatgttcagactttgccttttgttgcctcagaggattgtctgcctggcaggttgtacttgctgtccactgcaaaccctttgtggctccatttatatcatagtctgtgtaaaccacaattgattgtgtatatgcctcatagggttggttgtaagaaacccgcacaacctaacacagtagccctgacatacagtgttgctaggtcttatggtcttatgattttttcccagatactctagacatttgtatgtttatatgtgaaatttctcaatatttaaattttggcaattcagttttttaaaaacaccctttgagaactaaaggaaattcatcttaccacacattcacatgtaatctcatgtctaatacctgggagaaaaggaatttcattttccaaagtttggttgttctgcagacaaataatacagaagaattagatgatcaaggaatccgatctgaacacaatttaataatttggaaggtacacttttgaaggctttattggaactgggaagaaaatggaattcttttattttttgcagctcagaattttagtggtctgtagtctgttgtttcaatgataacttcagatgtgtagatatattttattcaaattacagtgaagcatggttagctaaattcttagagcaggtggctgcgtatagagtagtttgctggcaaaagatcagggttcagtgacaagccagccagctagctaagaaaaattactacatactttaacttttaagaacagaattggatttaatatggacattacccatctaagcatcattcaaccatacatccatccatcctcctatcattctgttctcccctttcctttcctctctttatccttttttccttcctcccttcctctgtccttcagttttccatccatctattcatccccccatttatctatccacccatctttccatttattcagtcaataaacattgattgtatgccacatggtataccagtatttatgtgaaggattgcaaactgatagctcaagggtaaaatctagtatctagaaatatttttgtttaagagtgtttaaatgaaaactaaatgtaaatcctttagataggacacatactgtacccttcagttccaaacgctacaattccctattgccttaggccaggttgtttcagatattttgttcaaaagagctacgttttattgaatggttgctcttgttccctgctgcactgagtgctttgcctacattatctcattttttttcacaacgcccagaaggttggcattaatattttcattttacgaatgagtaatttggagcctagtaaggtacagtgatttgtcccaagttaaatggcttttgtaaggtttagatttaagtacaacttgaactcaagtcaggctgacttggttagtctctcaatatctattacacgaagaccttaaaaatgatttgggagagtggaagtagcccttactgaacacctaactccatggtgtttcacaccttccacctcatttaaagataaatataagtattaggttaaattcatattgaagttttgtcttttcaaatttcgatatatacttgttttaaccttcccctttcaggaccagattgattatttgtagatattatgcataatttaggatctatttatgttatatatatgagttttcactcatgaaattacggcgtgtaagaaataccactttcctttacaccatttcttttttcgttgaaattaagtctagctctgaactgtgatctctatctccctgggttgagagaaataacaggcattactgggaatccaggactacatgccccagctccctctctttcctgaccttacctcaatgtgaggtcctgtacagtctagtattctcagacaggctatgcattcttcatgcttcagtcaccgctgctcactgctgatgtgatcattgtctatgcttgcaagagctcttaagacaggtactccaggggttctgtgcttgccttggatataggcttccttgtctatgccctccaggctcccatgcccttgaggacctgatgtctgcagggctattgtgaaagaacaggctacctacccagctacctgtggagctgcacactgcctgccacttcaatcttgaggaatttttttctctgccctccatcaccatttttgcttacctaccatcttcagaatcacacctcttgtctccctctctagcatatctccctcaatcagtgttggcttatgagttttaacagttctgaaaatacatttactttaaacaacttctattttggcttgtattacaactctaccaagaataaggcaacgaaaggccaggaaactcttaggtggtggtgtaggtctaagggcaggggtaggcagggttgtgtttatgcaaagaagagaaaaagatttgtcacatttagtatcattaatacatataatcatttataattatgtatattaataaattacttataattaataaaaataaagaaggtactgcttgtttggataccaattttgagaataatccaactgattgttaacttttagtcttaaaatgatatacactatttttagaaaatcttaatcagcctaatacttcttataatcaacctaaataggactgaattattacatcgaaattctaacttccaactaaatcttcattacaattctttttctctcttctacttacttcccttctactccaagtaattttaagtatgcatacatcttatttgtaaattatcatcctagtttttcctacattttcatacatatcaattaaaatttttgatttaaaaggtcatgcaattaaaataacacatttctcagaagcacaccattctgctctgcaaatatctttgtaggagaaattggaaattgacaaatacattcacttaaattttgctttgtgctgaaaattgaggaaaaatttaaattggccatttgcacattattagtagtaaatcaacccatgtaaagatggaaactatggtcatttcaaaagtgattttcatttttggtaagtgggtcctacagcattatgtcctcatatttgtgagttattgcaccctggctagtattttcattgctgccttatgtttatttgctgcaaatccctctcaaaactgtgtgcattggttataatgctaatgaggaagataattcaaactaaaattcaaatcataatagctttaggattttagagagatagtataaggttaactcattttcagcatgtgcagacttaattatgcatgggatgaaatacagtaggcaagtctcagcctaataataaataattgaaaaatataacctgtacaatatttaaactggctttaatattacttaattatcacattattctttttcattcatcatttcttttccaattctctcaccctaccattaagacagtaatgattttataagatgtagatccggtattaagttttgcttgctctactgtctcaaattattataacttctttgttattactggcttgtttctgtttgtctttcacaagtctttgactcagtagtagtagcaaatgacagagatcttcaagtgtcttaatgcttgtcaatataatattattccacttgataggatgtgtccccagatacattacagagtttaatcgttgatcactctgcccacagtctaattgtgataacaaactaatcgcagctgttacagagatgccagttaagtaatccgtgtttcagctgagtttctcaatggcagctttattttatagggccatctctgacgagattcatttggcagatatttttctaacaaatgttcgtcccagatgctgctagtatttaaacaggatatgctaagatttagatagaaatataaaatccttggatattttaaaacctagaattctaaaataatcccatagaaagaacagtagttctgcatatgggaaagtgccttgtacttggtaaaataagttaaattttcaatatttacatgtcaaagagaacaaggactatctatatatgcaacatttatttttgcttatcatggttgaacaattgtcagcatcagtgctaacaccccatatgtgatgtatgtattttcactctctcccactcaaggtttttattgaactctaattagcagtttcttgcgtgtgaaattttgtagaacatttgctactcccagaagtcttgaaggtctaaaccagcaatgaaaaccactctgatttcctagatactgtgaagtaaaccaatttgatacttataagaaattatattcccccttaatgcttttcctacattttaatttcaaactaaggaaaggcacaaatttcacttttttatgtataatttattgcttggcatccctccaaatacaaatcctgtatgaataattacaacccctttcatgtttatatggttgctgctacaatgaacaggaaaataaagcaaaaggaatgaaaatgaatgtttgggtttcattatattgttaagtcagttttgtacattgaattatttagtatttaataataaatatctttagtaagttaatatgtgcctgatataaagaaaatgttaaggcattcataagttaaagtcagaaatagcaaaacgaccagatggttagtaatcagattaaaacaaaacaaattacaatattatttttaaaagaattaagtggatttaaattacttccaaaatacttttgtttataggcaacaattaagagaaacaaagtgtaccagcacacagttaaactggcttttattcttcacttgagactagttctaattgatcactgtgctattgtatgatttgattgtgctgacagttacatgccactgttcccataataacaatttttcttctttgttcaaatgaattttctaattacacgtgtgatgggatgttttaattcttttcccttttcaaatccaccttcctgttgcaatgcatgatgggcaggctcaatattgtgcatgacacccgctacaagtgttggtaggtgccagctttgtttcttgattatcttaaacctatggtgtacctcacagcccctcaaaatccactgctaagtttaacttatatctattgggcaagtccatttcccttttactaacacttgtcaattaaatgccattttctgtttaattgacatggactcacataagtgttttctttacacacaacagtttcctttagtcacctttggtggattttgattggactatgagttctggtgtgtaaaaaaaatctatttcataaaagtaatatactgtatatttttataatagtaaatgagaaaaaaatactttcattcaaacagataactgtatatatgaagtaaatacttgtattttgacttagattttgaatgtctgactatgaacactatataaaattcttgtttttgacttagcatattaagcctgtttgtgtcaattttcttgatttgatggtaacaagcttttttcccccttttttttctctttcatccctcctccccttctctccttggaatgttgtcctgctttgcgctgtgattgcatgtcactcgctggtgatgatgtcctgtcacatggcttattgctgtgataaataccatgcccaattatctcttccatgttgccatggtttccatattgctacactcttctgtatgttcgcttatatgattttccctccgaaagttcccatggtgcacggtgctacgccagccactgtgtccgcagcaacaacatctgccacaagtgttcccttcgctgcaacagccacagccaaccaggtttgctaatttacagctttgtttcttaaaaaacaactctaatagggctcaatccaacagcccttacgcacgtggatttcccattgaggtcagtgggaatcgtgtgtacgtgagggctgtagagggtgctttaataagcatggggtttcaaagatacctcttgttggcctacacattctctctatgatgagcagcagaatgcttttatgccatttataagtgctccaaagtcgtcgcagctccatttctgaagctactaaaatgatatttacacaagcaattctcaattggtttcaaccaatcgtgcaggtattttgaccaatcaaaaatagaggccattttaaggtttttatttaaaatatttggtatatacagtttcttagttcttgcctaaatgattaatagaaagtaaaatacttaaatgtattacgtatgccacaaatgaccactcttgtaaataagtttgttataaattcattataatctgaatcatttaatgagcagattcaaaataaattgtttgcatgtagcatttctaagcttttattctcaatgctttcagtgaaagaaaaatcctaagcgctcttatttttataattaccctgcataaatgttggagatttatgaaggaaaagaaaagaaattaagtatggcaaattgacagtcattctgtattccatgcaaatttattgcaggatacttttaagtgaaagggatttgtttcataaatttaaattttatgatatacaataataactatttaaaaataaatgatgatttaaaatatttaaaatttaaaaattgacatttattcacccagcattttctgattctacttaaaaatattttctagaaaatactggttgatttcaagtttcatttatgtagatttgggcttcaatagagttgatagtgtatgaaaaacatagagccaagccacatttcagataatccacagaggaagattaaaggtagccaaatgaatctcaaaagaatgagtgtcagatgaaaatgaacatgttcccccttgggaagggaagaccaattaagacatagatttgttgttattactgtgaggagtagccacccttgttctataatacatcacgtactgttgatgaagaacattcagctattagtacagccattaaaaactttcaaaatcagaacacaaaaatgaatttaacgtttcagtcaagctttaaacatttcttggcaaagaatcattaatttttcagaagcttgtcaaaatagccctgggtttacatgaacacgtcagactcatttacaagaatgctagattgtgcatatgtggcatgttaataagtaacctttggtagaactattatgatggattcaatacaatccatctatggtgcaaatcaatgataaagaactctcatgcgtctaccatgtatgactgtagaattgctggtgtaagcagaactatagcagagcaaatttcaacatgcccttggccacctgggttgtaggggacactttactttttgcattgtgctgtgaccatttcatgcataatcttggatcttcatactatttgacaaccaaaagaaagaaaagggaatggatatatatatacacacatatattatatctacatatacatacatatgtatatgcctacagtacattagcaatgctggaaatagctgatgccacaaaatgcagcctgcatgcatgcagaagtttatagctggcccttcatctgcatcgattggtgttgaaggtccttggtatgtttcgacagccccatccttgatgcttctacactgttgggtgcaacatcctgtcctgcagcagcaggaaaaatggtatgagaagcttcattatgcttggagcacattttcgtgccatttgccaatgctgtaaaattgtgtaaaaatgtcagctgagaactggaaataaaacagggacatattaatatacacgccagactgtggattgtagtatgttgaattagcctaagatgtctaaattgaaagaacagcaacaaaatgcctttgtgtatctgatttcattattctcccaacaacattgctgaaatgggattagtatcattttatagaagagacttaagcatagagtaatgagttgctttgctcagggtcacacagccagtaaatggatctctggggctagcacccgtgtcatcagtcctctgacagtctcaatccattgtgctgcctctctcaggttagcaggcattaatttcaggttgaagaatcaagctacaaatccgaagttcttaactttgggaactattgaaataagtcaactctatattggtttcttattgtattttctctcaagttctctaattctcttgcccatttaaaatacaataaaaggtgtcatcaggattcagaaatatgttctgaagtaaacttaggctcttacctagttcttttgaattactgctttataattcttacctggtatttttaatttggaaaaaaaaagttagacaccctaatttgaacgaaaatgttagaaatttggttgcacaaaaataggcaagacatttccttatctgatttctggatgattactaagtaactgaaaccacgggggtgcgtgtgtgtgtgtgtgtgtaggccaacaaaaagggcttctttcaattactgctctgcatgaatttttgatagttttacttatttcctaaaagctggtaacatttatagaatagtatttaacatgaagattttaaagttagttgctactttggcatttaagtttacattaacttactgttatgttgaccagataaggactatcacctcacagctgaatttcacttttctttaaaaatttaatattaaaatgttttcatctcttaattgttggcttgcttgcatggatcattcattaaataattttttatttgctagatacccataatatctgccgaacatctgactagccacaagtatgttacccagatgtagaattttcatcactaaacagtaagttcattatgtaatatatagttgcatatttgtggtggttttttttaagatagcaattgtatagtgcacttaaaattttgcgaaatctctgagaaaatatatacagatcacatttttatcttaaatgggtgtgaggaattttatcagacatctttataacaaatatgttaatatcacttaaatatacaaagtactaagagaaaataaattttttaaatttctgattagagataaacacagcataaagaaaatgtatgaccaaaaagtaattagaaggtgtagatcaagggttggcaaactttcttatagggtcagacagtaagtatttttgctgtgtgggccgtatcgtttctgttgcagctactctcctctgccattgtatcatgaaagcagccagagaccacatgtaaacaaatgggtgtagctgtgttccagtaaaactttatttacaaaaacaggcagtacatcacatctggcccacaggcagtagtttggctgacctctggtgtagattatcacttttttttttttttttcattctttggctaaaccttaaatgggaccatgtacttacttcatcccatgcaccaccatacacaggggcattagaatgtaatgagtttggctaagcgtggtggctcacacttgtaatccaagcactttgggaggccaaggtgggtggattgcttgagcccaggaatttaagactagcctaggcaacatggtcaaaccctgtcctacaaaaaatacaaaaaaatcagctgggtatggtagcacactctgtagttccagctactagggaggctaaagtgggaggatcacttgagcccaggaggttgaggctgcaatgagctgtgattgcgccactgcactccagcctgggcaacagagcaagacctgtctcaaaaaaaaaaaaatgtagtgagtctgactttaaataaatatatacacataatcaaatatatgtgtacacacaaatctacatattcaaatgaatcttagttactttaaagtagttacctcagaggatcatataattctgaaaatgttgccattgccacattttaaaaatggtttgaaagtcttgtattttgtctttaaaaacactgtggtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttaaagtataaaaaaaaaaacaaaaaaaaaaaccactgtcttaaatacttaaaaaggtgtccatttttcatccataggaatatgttttgtccagtatgcatgcattcaagttataacatgtgctcagatgcttgttatttatttttatatttagaaagagacattacatttaaaactgaaattggttaagatgggtgaccattctttgttgcttcctttatttatttattaacatatttacaaatgagtttttggtgctactttgtgttagttaccatggcaaggagataaaggtaaatagataataagataaagatgtaaggaatttcaggataatatagtaaaataagagaggtttgaagaaatttctcttagagcaaagatgaaggagcagctgttcccaacaggatccgtaaacaaatgaatgtggacaatgaaggtgttgttctaaagagaatggaggtgtaaaggccttgtaaaagaaggacagtgtgccaagtcaggaaacgatgatggctgagaaccaactcagaaacccttgtgatgttaatctgtagcaaagctggacaaagtcaaagcccatgcaggagaacaggcagaattcaatagccatttaagaaagaaatgagaggctcaactggagaagtactgccaaagatatgctgcaatcgtgaattattaaaattgatttttgtctatttcataagttttctcaaagcagttctgataaaaaggttcagattctgaacaatagccacatttgtagaagaagaggcattactttgcagtgttgtaggtttagaagaagaggtttttttgacatgccagaaaaatctgtttcaagctcttatagtcaattaggtgtgtttggtatgtatatatttaactaaattctgtttcttagcaataatccaggttgaaaaaaatttctaaaaataattagcaaaccagtagttttgtctgtattgaagctaagcttttaatgttctgttcatttaacaaatgattgctcatcttcatgaggagttgcaacatttaaactggtttttgagtcactagattatgatttctttcattttcaaggttgtattgtgaagcatacttttaatatatgtaaatattcgctgctgagaacaaatttcatgtaaaaactggaactgttaatccacaagtacattgtaatgtctattacagcttaattcatgagtaataattctgtaattcaaaaagaatgatttttattttcttagttttaggtgaaaaaagttcaacaaactgaattacccaaagccatcacttaaagtatcattctttttttttcaaacatgcattatgctaatcaagcacccaaaaagaataaatcttgtttaatagaacatattacatgaattttaattttgtagaccagacctttactcttgaaaccttattaaacttcagaaaagaagtttaaattttgccctacaacaattgtgctaaaaaagagctctgtatattaggccccctgattctgcaaatgtattttatacttttagtttaggattggtaaattttggagcacattctacagttttattaaattgtacgtgttatttcattcgtgtagagatgatagacaaattttgatctgtctactcttgtaaaatggtttttgtttttatatgaagatataatgtaaatatactggttaatcaaaaagaaaattttcatattaaatgtatattagaaactgcttttagatattacctgttctaacaaagcttatctctttttcccttgtagatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagt

SEQ ID NO: 35796 - DNA, 197740 bp, Homo sapiens; identical to SEQ ID NO: 35795

SEQ ID NO: 35797 - DNA, 197740 bp, Homo sapiens; identical to SEQ ID NO: 35795

SEQ ID NO: 35798 - DNA, 33199 bp, Homo sapiens
gtaggcggggcgagccggctgggctcagggtccaccagctcacccgggtcgaggggcaatctgaggcgactggtgacgcgcttatccacttccctcctcccgcctccccctggggtggcgctcgctggtgacgtagtgagtgtgatggccgccgcgaggccgggaaggtgaaggtgagagggcgagcaagccggggtggcggggactggcccggcccggcccggcgagtcctgagcagctcggcgtgggccgacgggattctggggccacgggggtctgggatgcagtcaagcggggtccccactctccggcctcgccgccgggccctccccggccctgagaggagggggcgggccacgggacctgggactggtcggtggggtcccctgtagcttctcatcgcccccgcctttccacccttcacggccatgttctacccctgccccttctctatttttcatcctgtcttcattttgccagcatttactcagcacctgataggtgtccacgttcaccgcgggagcgccctgccatccccactttgggcagttactgccttctcgttcagccctgtttacttatatgacttctcaccggactgtaaggccctggagggcaggactgtttcttatccatttctaacgtggcgcctgacacacacagagaaggcacacagaaaatgttgaataaatagctgttaagacgcacgaaggcagaactgcccgttaccccctctcgtaatccttcattgccctctttaaattctcaatcatctctctctcttctacccagaaaagggctctggttatctcttttctacccagaaaagggctctggttatccgcctctggtgtcccaaggtttggggcttgggggaggaaggcagctcaatgtagttaaaaaaggaaggaggccggtcgcagtggatcacacctgtaatcccagcactttgggaggctgaggcgggcggatcacctgaggtcaggagttggagaccagcctggccaacatggtgaaaccccgtctgtgctaaaaccaaaaactagccgggcttgctggcacacgcctgtaatcccatctactcaggaggctgaggcaggagaatcgcttgaacccgggaggcggaggttgagccgagatcgcgctgctgcactccaggagctttggagtcaaagggagctaatatttcagatcccagcttagacaaatcttcaagtattccagccctctgtcccacagaatagagaattaagtgagatactttacagtagctgaacacattggctttcagtcagttcttctgttcctcaatagtcagctgttccacagtcctcaagcccagttttgttcctagttttgctctgtcctcttctcccctctctggatgtacctttcccagggctcctgcagggacctccgtggtgcctcaaacccgcacatggcggaatacgtgtgcacagtcaggattggtcccacacctctgcgtttttttccccagggcacttcctcacatgccagcgcaactccccaatacctcaatgagtaagcttccctcagggatgagtttgtttggcttgaaacctgattagacatgttttgtacaccagtgttttttttttttggacaccggatccatctcccttttcttttctaataagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaagtaagtagtagctgtgacttctggcaccctggatttgagctgagtggacaggggtgtgctctcctggacctctggtggcaagtctcttgaatggcatcctctttgtatagagccacagctttctaacttgtgttgaaaaactaccgtatcttttacttccgtgaaggatttcgctggttgcttagagagcctgtttaaaagttgacagttcagaagtggctgggatctcttgggctccctgaagagttagtctctgtctccctcatttggtctctgctgtgctggctcttccccatctcggcccagcacaggttggctccttgtcactgctcttttaagactctgctctgtcccctttaccctgtatactctttttgtttcgatttctcagcttctcctcttttccagttgtgccagcagacgatccgtggatccattttattttccctgctaggagttgctgtacataacactgggtaaggaggtggtgtggattcagggactgtgcttgggatccaaacacaccttgcagtgaattttgctactgctgtctctacacccaagatacctaatactcctcaacgaatagcctaggttgaggcaaagctgttgaccaccttggagggctaatagcagtttccatttagaactgggttcatttctggtcttaggttaatatttattaatactgtgccctggcactttttaggggtaggggcaggagagtaccagaaagagtgggcttttccctaaagtgtgatcctcgggattttaaaagctattacacagaagggttttttcattgattatatttgtgaaatgctgaattcaacacagttaaactagtgtctttacaacaaggcttccttcccaaactcttttgctgtgctcacgtgctccactgaggaaaatggtagcatatggtgttttttgtttgtttgtttgttttttgttttttttgagacagagtcttgctctgtcacccaggctggagtgcagtggcgcgatcttgcagtggcgtgatcttggctcactgcaagctctgcctcccaggttcacactatcctcctgcctcagcctcccgagtagctgtactacaggtgcatgctgccatgcctggctaattttttgtagttttagtagagatggggtttcaccgtgttagccaggatggtctcgaactcctgaccttgtgatctacccacctcggcctcccagagtgctgggattacaggcgtgagccaccgcgcctggcctagcatatggtgttttacaaactgattctactattgaaccttctttacatgggatattgggtgcaagtcgagttctgtggaccacgctttgggaagtgctgccagaaactatccaaaacagtaatctccagagcacttatgaggcagtcacagcttgaagtgtgacgcttagtgtgtcactgatgttggagctgggctctcaggctatgcttgcaggatggtccccacgtgcctgtggcaaggtctgtggtgaagcagagattatcaaggctttccagaggcagaggaggaacccagctgccctgcatcaccctggaggagtagggagtcagcagtcaaagccttgagataattggggaacacaggatgtgataaaaaccagaagtctgtgatgttgtttgttctctatgaggcatcagaggaggcttcatggagcgggtgacacttgagttgggtctagaaggacagtaggagtatgccaaatgggtggaaaaggaaggaggattccaggcagaaagcagctcatgcaacacagatgtggaatctcagcttgcaagttagcagagccagataaatcaggcagagtttggaggggttgacagtaggttttacgccaggggtttggatgcagctgcaggctgggtattagtgagagcagggaggctcctggaccggctgaactcccagcagaccttgtaacctggagctcccaagcttctactggtgtacacgctgtcgagtcttgcagttagtgagcactaatgcttttggttttatatctcctgggcttgcaaacattgaccagaacttaaaagcacctgcttctgatggcagggaacttgcttcctgcagcaagtcacttctggagtggggtatcgctgatccttccccagctgacctgtttatttgatctccgtgatagcgggtaagggagtggtgtgtgtggtgtgagttggcggagttgcctctgccctccctgaaggctgggtgttcatggagagagtcttgtgatcttgctggtagagtttgttgttattgttttataacatgtaaagctgcctttagctcttactgtagtgaagcatgttgcttgcgtcatcaactttagtcttctcacagtttagatggtattgtggtattaggatattggttttcatccacggatccaggctcataactcctatccacagcccttgttatggttttttgatataatgttagatgtgttaggcctcaggggcaggcctctgaccttctgctctccttccaccctaatctttccccacctgattgtgggccttaaaaccctcccctgagaggggtggaccctgtatcctgggggaaggaatgctgatgtcatgaagcttccataaaaatccaagaggacagagttcagggagcttgtggatagctgaacacacggaggttcctagagagaggcctgctcagggagggcacagaaactacacgcctcttcccccatacctcgccctaagcgtctccttatctgtatcctttgcgatatccctcataataacctggtaaacgtaagtaagtgtttccctgggctaggtaggctgctccatcaaattaattgaactcaaagagggggtcatgggaaccccagcctgaagccagtcggtgagaaattctggaggcccagacttgcaactggtatgtttgaggggtggtggtggagaggcggggcagtcctggggactgagccctcaacctgtgggatctgacactctctccaggtagacagcatgggaactgaatgagaggatacccagctgctgtccgctggttggtgtgtggggaagaaaccccctcacatttggtcacagaagtctcttgtgttgatgattatggtgtgagagtagagaaaaaagataatttgagacagtttctctctccagtaggtgtcttgtttgttgtacacatgaagaaaccaaggttctgtgatgaaataacttgcttaagtttaagcagcccagaaataatgtagtcacaatttgaacccagctctgcctgattacaaaacctgtcataggtagtgctatatcatgccccatccttgatccctttttttttttttttttttttttttttaaagagagagacttcgctctgtcacccaggctggagtacagtggcgagatcttggctcactgcaaattctacctcccaggttcaagtgattctcctgccttggcctctggagtagctgggactacaggcatgcgccaccacacccagctaattttttgtatttttcatagagacggggtttcaccatgttggctagactggtcttgaactcctgacctcaggtgagctgcctgcctcggcctcccaaagtgctgggattacaggcatgagccaccgtgcctgacccctgatcccttttctattccttttggatggctttcctcttgtgcctgccacatcccctctttctcgaacagtctgatctgccaggccatggcaagcctcatttcagcgcactctcctttgctgctttggaagagtgagagtagcattttctttgcagtttcctttctcagagctgtactgtctttaagccctggacatatggcttccatgctgagaaaacatctctcatagctgtggcgtcatgctgaggaggaatgtagaaacggaagtggggtcacttccttcccttgtctccagaggaatcattaacattgcacaagaacttgttggtttgggcacacatgtgggtccctatcccgctttgggtcggtctgtcttctgcccactctttgggatggttagttactaaaagtccgttttggcatttggtcttcatgtacctcttccgggtgttctttctgcttttcaggaccttgtgcaacatactttggccccatttggaagtttttcacgtgtgcttgctggggagcaacacctcatttccaatctagagagagtgagcttactgctgggtggagaactgagcagtaagattagggtggctggggaggcagtgacagacccaggcacagtcagctgtgcacacaccccctcatccaggagggcctttgccctttgacttcctgggattggtgggctctgctcaagaagtagctttcgccgtggtgggaactctgagggacctggcaggggtccacttttggggtcggaattcccagtcttaccctgggcactccttctggtgtgtacgcctctttttgatctttttttttttttttttgagatggagtcttgctctattgctcaggctggagtgcaatggcgcgatcttagctcactgcaacttccagctcccaggttcaagcaattctcgtgcctcagcctcccgagtagctgggattacaggtgcctgccaccatgcctggctaatttttgtatttttagcagagaaggggtttcaccatgttggccaggctggtctcaagtgatccacccgcctgggcctcccaaagtgcagggattataggtgtgagccaccatgcccagcctcttttgacctttgaccaaagacctctaggactttggagtcaagtctcatgacctctaaaatgttgttatatgaaaagataagctacaaagatatgtaggattgagtgagagcaagagagacagtcacacaaaaatagactgtgataatatggctgggtacggtggctcacgcctgtattcccagcacttcgggaggccgaagcagatggatcacttgaggtcaggagtttgagaccagcctggccaacatggtgaagccctgtctacgaaaaataaaaaaattagctgggtgtggtggtacatgcccgtactccaagctactcaggaggctgagtgaggcaggaggatcgcttgaacctgggaggtggaggttgtagtgagctgagattgcaccactgcacccagcctgggtgacaaaagtgagactctgtctcaaaaaaaaaaaaaaaattataataaacaaaatgttgggccgggcgtggtggctcatgcctgtaatcccagcactttcggaggacaaggtgggtggatcatttgaggtcaggagttcaagacctacctggccaacatggtgaaaccccacctctactgaaaatacaaaaattagccgggcatggtggcgagtgcctgtagtcccagttgcttgggaggctgaggcaggagaatagcttgaactcgggaggtggtggttgcagtgagccgagatcatgccacagcactccagcctgagcgatagagcaagactctgtctcagaaaaaaaaaaaaaaaatgttggctgggcatggtggctcacgcctttaatcccagcactttaatcccaacactttgggaatccaaagtgagaggatcattggagcccaagagtttgggagcagcctgggcaacataagaagaccctgtctctacaaaaaattttaaaaaaattagtggggcgtggtggtgcatgcctgtggtctcatgtactcaggaggctgaggtgggaggattgcttggacccaagaggttgaggctgcagtgagctgtgattgcgccactgcactccagcccaggtaacagcgagatcttgtctcaaaataaaaaataaataagtaaataaaatgttaacattgcttatcacaaaatgatggggttatgggtttttttccccttcagtttccaaattttctgtagcacacctgtgctatactaaaatagaccaatagtttttgtgtgtgtgtgtgtgtgtgtgtgtttttctttgttgagacttggtctggctctgtcacccaggctggagtacagtggtgcgatctcggctcactgcaacctccgcctcccaggttcaagcaattctctgcctcagcctcccaagtagctgggattataggcggccaccaccacacccggctatatttttttgtatttttagtagagacggggtttcatcatgttggccaggctggtcttgaactcctgaccttgtgatccacttgcctcagcctcccagagtgctgggattacaggcataacccaccatgcctggctgtttttttttttttttttaaatagagacggggtcctacattgcctaggcttgtctcgaactccaaagttcaagtgatctgcctgccttggcctctcaaagtgctgggattataggtatgagccactgaacctggcccctaaccaatagtgtttttatgtggtcttgctctgtctcccaggctagagtgcagtggactgatcataggtcactgcagccgaaactcctgggctcaagtgaccctcccacctcagactcccaagtagctaggactgcagatgcatgccactgtgtcatgctaattttgttttattttttgagacaaaatctcgccctgtcacccaggctggagtacaatggcatgatcttggttcattgcagcctccatctcccaggttcaagtgattctcctgtctcagcctcccaagtagctgggattacaggtgtgtgccattgggtctggctaattactgtatttttagtagagacgggggtttcaccatgttggccaggctggtcttgaactcctgacctcaggtgatccacctgcctcaacctcccaaagttctgagattacaggggtgagccaccgcgcccagcctgagacactgttcttatctcaccgtcctttgttctagtcctggaggttgcagtgacctgagatccccatattcttgattctccccaaagcattccgccatctccctagcaggatgtcccgaggtaggtgttgctgggttcgctcacgttagcttctcttgcagcgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaaggtaagggggcaccggctcagccaggcccgctcttacctgtttagatatttagctagtgggatttgcgggtggggaggtatatctctgctcccagggaagtcataaccagatagccttagaaatgctctgctcttgaaatcatgtggaattggagtctggggagatgaggccaggaagacaagggaactgccatttagtaattactttaagaagtccacatgttttgtttcatttaatcatgaaagataggtgaatcttatccccatctacaaggcaagcaaattgaggtttgagagttgtccgataccttgtaagtaatagatcagggttttacccaggtgtctccaactccggagcccacgtgttttcctttgcctagttctggctgccattaataccaggcactgtttgggtgtcagtgatccctgaccagggcgccctttctttgatatttttagattggtgacagaactataggaaactcacgtcacctatgccttttctactagttactaatttgagcccaacctctagttccttgtctatcagcagagaaggactggttcccagggccccgctcgtctgagtgtcaactccagcactggcttcctcaggctccctctttagaaggacactttggcgccaggtcctgagattgtctgtggagacccagtaactgagtcttatctgcccttggtttcctcacttgtgaaagtggggctcaggtgtgaacagtggtttcagattctagtctgcagaaccctagaagttcagtggtggtgcttcgggggttggcccctggctcaggggggccaccttctttccattctgctttcaaatagagcagcttggcttctcgttgttttacatgccaggctgctacacgaggctccctttgaagaaagagactgtccaacttcatgccctcatctgtgccctgccctttgcgtggcgcttgatgccacagaaggtgtttcctaaatacttgttgaactaaaacaaatctgaattttaaagtagtatgattggtagttgaaataatcccaactcattgcctgtttatcagtggctatggtgtgccagccgtgtgccaggtgctgggcatgcagagatggggtagatcaggccgctcccctctgggagcccagactaaccctcttggaagctctgagtcacctactcagatgatgtggtggacaaacacatgcgtaatgcaggtgtttatgtgatgcatgctttgatttctctgtgtgtgaaaatatgaggcctcccctgttgtttaaatggaagggaaagagctggagtgatcctgagctgtgctgggtcagggaaagaatggttcctgcctgggcactgtttctaacgggcaggtaacaagagcttgttggcctgctggctctcgcttttaagtgtagtcacatgcttgagagccagcttcctccgagggacattccaaaggccatgcccaggtgcccatataagggaggaatattgatgcatctggggcagaggtgaccggtggacatagcgggaggggagatgggggtgttgttgacttggtcatttcctttcatggcgctggctgtgggggaaattcactgggcaggcccttgtcatgcttcagatgctttcggagtgttctcagggctggggcctgtcagcctcatagttcccaggagtgtgcagaggggctaaacacccgtctgtgttccagccagctgaagcacctgtctggtgcgagttctagacaggacagtggtgggatctcactcagttgctcctgtatggagtaatttgttggccatctgcctgttaagggcactgggaaaaagcagtgcagtgatccaaaggtctgctcacgtagcaaacatttgtgcacctgctgggtgctggggtcagatagtgtggccctcatgaggcagatgacacagacaggtgagctgtacagttaccttatggtgaggtgagagctgagatgggagaagtgcagggtgctggggcacacagagaaggggtccggggtcctgactcaggttagaggggtggtcagagaaggcttcctgggggcagtgctgtctaagctagaccggaggccaagtgagaatgagccacgctgccccaaggcagtgtagtgtgtcagttcttcagagagtggggagggggtttgggcagcagggaatggagccagagggccgaggaagctggtgagtttggggatatggtgagggagaccgtgaggcagcgggtggcaagaggccaacagggccagggcagggagggcctcaagaagtgacatagaggccgggcgcggtggctcacgcctgtgatcccagcactttgggaggccgaggcgggcggatcacgaggtcaggagatcgagaccatcccggctaaaacggtgaaaccctgtctctactaaaaatacaaaaaattagccgggcgtagtggcgggcgcctgtagtcccagctacttgggaggctgaggcaggagaatggcgtgaacccgggaggcggagcttgcagtgagcccagatcccgccactgcactccagcctgggcgacagagcgagactccgtctcaaaaaaaaaaaaaaaaaaaaaaaaaaaaagaagtgacatagagtggttaagagcctggactccagagccaggctgcctaattcaaatcatagctctgccttttactaactccggagccatgttaataaagaggaccaaaggagagaatgaatttgaaaagtgaaaggaacagtgcctggcatgtggtaagaacttcgtaaatatttgttaagaaaaaataaacaaggaaggcagttaacatttaagtattcatcttctaccagccgccattcacagcatttgtgtttcaattcgtttgatcctcacgatgttctcatgaagtagataatgtagttatctccgttttgtgcttaaggaaactaagacccagaaaggttcttttgcttgaggccacagagctagaaagtggtaagaaccagcttcagaaccaggcagtgttgctcctgagccatcttcttaaccaccacaccgtggggccaccatagaggatctggagctcagcctgtcggctgcagggtgccagaggtggactcgtttagggtaagcagggccggcgctctggcccttccagacttgggactgtggaactcctctgaccacgtggtgacccattttcaatccccacctccagacacgtacaggaatgcagaactggaccccgttaccacagaagaacaggttctggacgtcaaaggttacctatccaaagtgagaggcatcagtgaggtgctggctcggaggcacatgaaagtggctttttttggccggtaagtccttgaggcacccaccctttctttcttcctggctaggagggagggaggcactttgtgcaaggtcacagaacgttccaggcagggacatgcttcagaattcattgctttcctcttaatttatattttatttatttatttgatttttgagacagggttctctgtcacccaggctggaagctcattacagcctcgacctccctgggctcaggtgatcctcccacctgagcctcctgagcagctgggactgcaggtgcatgccatcaagcctgacttttttttttttattttctaattaaggttaaaggcatataatataaaatttaccaccttaaccattttaagcatacaattcactagtaggtatatttgcaaccagtctcaagagctttttcatcttgcagaactgaagcttgtattatagccattaaacaataactccctgtcccacatgtcccttgccctggccaccaccattctactttctgtccctatgaatttgactattctagatgtctcacgtaagtggaatcatacagtatttgtttttttttctccattcataaaacttttattccacttacatgaatttaatacacgtgttcttaacaattgtgcttgtattgttcatgaaaatttcgtaagacattaaacaaagctagccatcatctcaagttatttccctgttaactatttttacagtgcatgcatgttaggcaagcatcaaaaaaaaatcacaaaagcaaagaatctaaaaatatgccgggcatggtggctcacacctgtaatcccagcactttgggaggccgaggcaggtggatcacgaggtcaggagatcgagaccatcctgtctaacacagtgaaaccccatctctactaaaaatacaaaaaattagccgggtgaggtggcgggcgcctgtagtcccagctacttgggaggctagggcaggagaatggtgtgaaccccagggggcggagcctgcagtgagccgagatcgggccactgcactccagcctgggcgacagtgagactccatctcaaaaaaaaaaaaaaaaatctaaaaataagttaaatacgtgttttttttgttttgttttactgctagcttgatatacatgaagtattcatttttcctgcatctttacttttacatttgttcttaggttgcctgaaacattttaaatacaaataaaatgagtgtagcaaaaataatgaaagctaacagcagataactttacaaataatggagtgtgaaccatttctgcccttatccagattgaaatgggtcacaactttgtttaaaggaacacttccacagctgtagtcaaaggtgtgcacattgagattgagtattccacagacacacatggtttaacatgtgataaccatggggtatctgtttctaccacagccttgtaagtgctccaaaccttaaagtacccacatttactatacctgtgactggaaccaatgatcctttttattccccaccaggacaaaccaatatgtaggcagttttctttgctttgacatggaagcagttttaacactggcccttgtgaagccacaatgtacctaaagtactaggccaaacatttataacttgtataatgaccaggcacggtggctcacgcctgtaatcccagcactttgggaggccaaggcaggcagatcacaaggtcaggagattgagaccatcctggctaacacggtgaaaccccatctctactaaaaatacaaaaaaaattagctgggtgtggtggcgggcgcctgtagtcccagctacttgggaggctgaggcaggagaatggcatgaacccaggaggtggaggttgcagtgagtcaagatcgcgccactgcactccagcctaggtgacggagtgagactccgtctcaaaaaaaaaaaatctaatacaagaaaaaaggcatctagacagattgtatgctaggcacacagtggtagcctggggaataggcactgtgcctagagtcttgaccctgatgaactgtaacctcaggtgtggtcctctactcctctgaactatcatttcttcatcctcacctgggaggtatgaccccctacttaggtgagctagtgggcttcctgtctcactgggtgcaggtaaggtcattgtagttctgctctagtgatatggctgagaaacttcaactcagaatgagaaacactgtgtttagcacaggttgaaagctctgagactcagagcagatgagtctgctgagcagagctattctcaagaagcagaaatggtggggtgcagtggttcacacctgtaatctcagcactgggaggctgaggcaggagaattgcttgagcccaggagtttgagaccagcctgagcaacatggcaagaccccatctctaccaaaaatttaaaaattagctgggcgtggtcgcagctatagtctatatataggtggtacctatagtctaagctacttgggaggctgaggtgggaggatcattgagccctgatggtcgaggctgcagtgagctatattcatgccacacgctactgcactccagcttgggcgagaaagcaaaatcccatatcaaaaaaaacaaacaacaacaacaacaacaaaaaaccccaccagaatacatgaaaggggtgtgataggtaagaatgagaaagtaggctgggcatggtggctcatgcctgtaatcccagcactttgggaggttgaagcaggcaaatcacctgaggtcaggagttcgcgaccagtctggccaacatggtgaaaccctgtctctactcaaaatacaaaaattagccgggcatggtggcacatgcctgtagtcccagctacttgggaggctgaggcaggagaattgcttgaactcaggaggcagaggttgcgatgagctgagatcgtgccactgcactccagcctgggcgacagagtgagactctgtctcaaataacaataaaaaaaaaaagaatgagaaagtaaccttccctttagcctggcagttgtcagctgggactcacaaggtggagcttcatgtgtaaggaggagcgtgatgggagaaaagcagcgaaacatgccctgtgtaggaaacactggggtcatttagactgaggaagacactctgggggttagtcggtgtttcaggtaggcctgaattaaactttggagacagacagacagtctctataagtgttgctgagggtggctgtgtgattcaaggggcagacagcacgcagtgagcctcttgtagattgatctgaaatgatgaaccaggggcatgtcagaggtttgggcctgggggtgtttattcattttaataaacagtgcctactctttgtctctcagcactgtctgggcactggcaacattgcactgaatagggctttggccttccaggctggtatctgcgttgtgaaagtaattcaggtcagatactggtggctttgctgacagctgttacttccttctaggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaaggtgagggtgccaggctggctgtcagccctgtgcctgctgggggagcaagtcctccgttgtgacacggctgacctcacctctagggagggggcagcaccaccctgtggaggtgaatgggagaccctattttagatgaactttttgaaggatgtaagagcttttgggggctggcggaggtggttttcagaaacgtggatcaccaagaatgaggaccctgctgttcctcatacagctctgagtggccactgacctctcttcactaattaaggaagacagtatgtgctgtgttcttccttgggatattgccagagaggaattcctgcatttgctgtgtgtctctgacctatcagtcagggaccgacactctgagttttctgagaggcagctgcattcttgtttggggccagatgctcaatttgcttcataaagaatcaattggtcgggcacggtggctcacgcctgtaatcccagcactttgggaggccgaggtggatggatcatttgaggtcaggagttcaagaccagcctggccaacatggtgaaaccccatctctactaaaaatacaaaaattagctgggcgtggtggtaggcacctgtaatcccagctagtcgcgaggctgaggcaggaggactgcttgaacccaggaggtggaggttgtggtgagctgagatcacgccactgtactccaaacctgggtgacagagcgagactccgtctcaaaaaaaaaaaaaaaaaaagaatcaatcagtgcagaacagatgactttagggtgatatccgggaaagaagctcaaaagagcagtgaagaaagtgggttcttattgacaactcccagctgttaactttttatatgtggaagaagaaagggtagcagatgggcagcattcccagccactgtgctgtgatgcagcggcacaggaaatctcctggcctggtggttcctcctcagcctctttctttccttcctctgccatcagactgtgaaccagctggcccatgccctccaccaggacaagcagctccatgccggcagcctagtgagtgtgatgtggcccaactctaagtgcccacttctgaaggatgacctcgttttgatggacaggtaagagggaggtgccctcctaggaggtccaaactggaaggcaccaggtttccatttctggataatctaggccagggtccctgggccccatccttgctctgcttaagtattactacctttcagatgggctcaaccaaatcctctggcctcttggctttcctctggagtctggttactatacctatttatcagtaccctgcagatgtcccagggatggtctgtaaaagataggagggatgctcaaaagttggtgggggaggttctcaatctcagcccagtgccagcatgtgtactgggggtggggagttgtggcggagtcagaggtgtattttatttcccttgaagaaacactttgccttggcttggtggactggttataactataccaacatgtacagtattgtagtgtttatctggactcacatcaagtcacaacttcaccttaattgtatatcatcttttttttttttttttttttttgagacagagtcttgctctgtcacccaggctggagtgcagtggtgcagtctcggctcactgcaacctccgcctcccgggttcaagtgattctcctgcctcagcctctggagtagctgggattacaggtgcccgccaccatgcctggctaaattttgtatttttagtagagacggggtttcaccatgttggccaggctggtcttgaactgctgacctcatgatccgcccaccttagcctcccaaagtgctgggattacgggcatgagccactgtgccccgcctggtatatcatctttaaagtagaattacaagtaattctgtttttataaaagcaatagatatatgtgtttaaaaacactcatttctgccaggcacggtggctcatgcctgtaatcctagcactttgggaagctgaggcgggcagatcaggaggtcaagagatcgagaccagcctgaccaacatggtgaaaccctgtctctactaaaaatacaaaaaaattagctgggcatggtggtgcgtgcctgtagtgccagctacttgggaggctgaggcaggaggatcgcttgaacctgggaggcggaggttgcagtgagccgagatcgtgccattgcactccagcccgggcgacagagcaagactctatatccaaaaacaaaacaaaacaaaacaaaacactcatttccaggcaatctggaaggataggaaatgggaagtaaaatccgttaatgagggccaggcctgatttctctcccgtccctggctttctcctccatgacctgcctgcctcacaagtcccaggtctgttctcagcaggaagaatagggctcctgctctgcctgatgatttggtttacccctgtcacctttagccctggtattgatgtcaccacagagctggacagctggattgacaagttttgtctggatgctgatgtgtttgtgctggtggccaactcagagtccaccctgatgcagacggtaactcctcctctgccttctcccaagctcccagcaccccctgggcaggcagctgatggggccttggctgtcaagctcctgctccaccgaggtcttaccctttatctaggaaaagcacttcttccacaaggtgagtgagcgtctctcccggccaaacatcttcatcctgaacaaccgctgggatgcatctgcctcagagcccgagtacatggaggaggttcgtgcttctgtttggcagtttggggaatgcaaccccgagggagcactgcctgccactggggccacttcctgcacccctggatctagtgacttccctgaattaattttattgccaaagaattctccaaatactcttctgtggtatcttctggtggtctttcccctctcccatccactttgctggatgcaccccctcttcaagccactctcccctaggcctaaaaaggatccctgctgcattagtgcatcttcagtgccggtgctcagtttggtttctgaggaattaatacagaacaggctcagctctagggaggcctctgggaaagaggctggaaagaggaatggagaataactggttcttactggtgacttacaactcttagctatttacttatttatttagagactgggttatgaggctggctaatttttgtatttttggtagagacggggttttgtcatgttgcccacgctggttttgaactcctgggctcaggtgatccacctgcctcagcctcccaaagtgctgggattacaggcatgagccaccacgcctggcctcacaactctttaaatatgtgaaatgaaagacaaaagggtaacaaacggcatggtggtgcacacctataggctgagagaggatcccttgagagtaggaatttgaaaccaccttgggcgacgtagcaaaacgccatctccaaaaaaataaagggtaggccgggcgcggtggctcacgcctgtaatcccagcactttgggaggccgatgtgggcggatcacgaggtcaggagatcgagaccatcctggctaacgtggtgaaaccccgtgtctactaaaaatacaaaaaattagccgggtgtgatggtggcaggcgcctgtagtcccagctacgcgggaggctaaggcaggagaacggcgtgaacccgggaggtggagcttgcagtgagctgagattgtgccactgtactccagcctgggcaagagagtgagattccgtctcacaaaaaataattaaacaaataaagggtaataagattgataatatggcaatatgggatgataaaacatgcagttgcagtcagtaggccagagtccaaattatttatttttttcgagatggagttttgctcttgtcacccaggctggagtgcagtggcacaatctcggctcactgcaacctccacctccagggttcaagcaattctgcctcagcctcccgagtagctgggattacaggcacccgccaccacacctggctaatttttgtatttttaatagagatggggtttcaccatgttggccaggctggtcttgaactcctgaccttaagtgatccgcccgcctcggcctcccaaagtgctgggattacgggcgtgagccactgtgcccgcttgtgactgacactaggcagtgtgactttgttagcttccttgacccttctggtaatccaatttcctggccagtgtgatggtgtgataaatagacttgttgagaggatgaaatctgtcaaaaacacctgacacgtggtaggtgtctacaagaagctattgtcacattttatcggtagaaccccaggatgtcagagccaggagggatgttctagtgatgcccactccttttataaacaatgccccaggaggacacagcttgtcagagtataggtcccagatttaggtttcttgacctcagggttcctttcctgccagggcaccaaaatgaggcactatataggcttaacaagaggcagtctagggcacgtttaagcatttctgcttgtatatgcataaaatatctttggcacgctcactgccaagtaacccccacacgttggtctgggaaacttggtggtgagagagcagaatagtgggggacattacactgtgtatgtgtttgtgcctttggctgttgagccatgtgaatatattgcctattcttttttttccctcactctgtcgcccaggctggagtgcagtggtgctatcttggctcactgcaacctccgcctccaggttcaagtgattctcctgcctcagcctcctgagtagctgggattacaggcgcctgccaccatgcctggctaatttttttgtatttttagtagagacagggtttcaccatggtggccaggctggtcttgaactcccgacctcaagtgatccacctgccttggcttcccaaagtgctgggattacaggcgtcagccaccatgcccagcctcttatgacctattcttttaataaaagaggcaggtgggggctgtggggccacctacactcactctggacacatttgtttgggctccaggtgcggcggcagcacatggagcgttgtaccagcttcctggtggatgagctgggcgtggtggatcgatcccaggccggggaccgcatcttctttgtgtctgctaaggaggtgctcaacgccaggattcagaaagcccagggcatgcctgaaggaggtaatgatgagaacagatgtcctccttttctctgatgtttgagacattttgtctcgtgctgaggagtctgtcagtagaaaatccttctgagaaggggatgctgagaagagcagagaggctcttgctctttagccagtggcttggtttctggggatttcatcgttttcctctgctgccaagttgtttctggactaatgcagtacaatcctcctagggggcgctctcgcagaaggctttcaagtgaggatgtttgagtttcagaattttgagaggagatttgaggtgagtcctctgattctggtatctggcgattctgtgcctccccagctcccattggctgtgtccctggcagtgaaaaccagagtctggcccttggttgtaggcccctggtggcccccacctccctccgtgcctctgtgtgttccaggagtgcatctcccagtctgcagtgaagaccaagtttgagcagcacacggtccgggccaagcagattgcagaggcggttcgactcatcatggactccctgcacatggcggctcgggagcagcagtaagagtccaagactgcagataggtggagagagctgccgagacaagggtgctccacccctgccttgggcagttaggacacgccttgatggcagggctgagtctctgggctcccatccagagccctttccctggccaccagaccatgttagaaccacatagacagcctggtgaggagggcggctgggtgcttcatcaccccacctggtctgtgcagcacgattccctgtgttggaggtcttggcccatgccctgctgagctctgcagccattctcagagcctgaacacatttttcaaaacaacattccagccaggagcagtgactcacacctgtgatctcaacactttgggagaccaaggcaggaggactgcttgaggccaggagtccagcccagataacatagtgagatcccatctctacaagaattttaaaaatcagctgggtgtggtggcacacacctgtagttccagctacttgggaggctgaggcaggaggatcactggagcccaggagttcagggttccagtgagctgtgatcgcaccactgcactccagcctgggcaacagagtgagaccctgtcactaaagaataatatgaaaacaccttgcttctatcacacagaattgactttctcagttgtttatgttaagttaaaattttaaaaagttcagttcccttttgattcttttgcacttgtcccagtgtcactctgccctgaggcaccataatcatgaatttacattgttctatcacccaaacagtactttttacataaatgctgaggaatatgtcaggtttttacatgcttcagatgtacagatgtggcatcacactgtctgtcactgtacctggctttgctttctcaacatcgtttttccctctatccttgttagtatgtgtagtttgtttatgaatcggaactgctgtagtatattccattgtgaatatgcctcattttcctatggatggaattttagattttttttttgctattggaaaccctactgcagtggacatttgttcatgtgtccccttgtgcacctttttaagagtcttcctggggtgagttcctaggggtgtggcaattctgttttagggtacacgcgtttccagttttagtcagttttcttgatgctcttcagaacagccgtacccattcattgcatgaccagtactgtccataggccttccatttcatcagccctcaccagaacttcagacctggtcatttttgccaggccttggtagaaaatagtgcctttaaaaatttcatttacaactgggcatggtggctcacgcctgtaatcccaacactttgggaggccaaggcggatggatcacctgaggtcaggagttcaagaccagcctgaccaacacggagaaaccctgtctctgctaaaaatacaaaattagctgggtgtggtggcgcatgcctgtaatcccagctactcgggaggctgaagcaggagaatcgcttgaacccaggaagtggaggttgcagtgagtggagatcgtgccattgcactccagcctgggcaacaagagtgaaactccatctcaaaaaaaaaaaaaaaatcatttctgtgattactagtgaggttgagcttttttccctatattaattggcagaatttgtttaaacccccttaaagcgccctccctgttttgtgcccaccacctgacccacatcgaagactgaagagtgcatggttggctgcagggtcctcttcttacctgggaaggggaaggccatgcccctgggtgcgtgtgtgcagccctgccaggcaagatagcgggcagggcggcgtgggatttctggcatcccctcttgctcctctgcttagtcagacaggaacatggatttctcaccagtactctgctttcagggtttactgcgaggaaatgcgtgaagagcggcaagaccgactgaaatttattgacaaacagctggagctcttggctcaagactataagctgcgaattaagcagattacggaggaagtggagaggcaggtgagaaatgaggaggaggcattctgggaagatttggactccgagtagagtccagaagaaagcagacctcctcctcttagggacttctcagcctttcagaagaaagttgtggccctgtttcaagaatacagagctgccgtttgggttccattgtcgggttgtgtgatgctgggcatgttccctttcctctggacctccacagatcatgtgggcgtttgatcagccagtttcccagaccctctcacttcagaggctttaattccatagaggagctgaggaggctgctggtttgagaggaaggatgtgccatctgctaggatctctcctggtgctgcaggagtgaactttggtcttccttgatacttaacagtgtgcttccttttgctgtaggtgtcgactgcaatggccgaggagatcaggcgcctctctgtactggtggacgattaccagatggacttccacccttctccagtagtcctcaaggtttataagaatgtgagtcatggagcaacaggtcctcttggcaggaggcccccaaaagtgattcaacccctgttggtctgggtcagggccccccagcagtgacagtagaagccacagagacaaggcccaggcttccgtcagccttctggggtcacctggtggatgtggcctgaagggaattttgatggacatgcttctcttaacttccctcttctggtggcaggagctgcaccgccacatagaggaaggactgggtcgaaacatgtctgaccgctgctccacggccatcaccaactccctgcagaccatgcagcaggacatgataggttagtgcccatggggaactgggcagctgtggccctgggctgcccaaagatcagatgcggaggccaagctaaagaaatcaggactttccttatctgtcacttttcatgatgattcaactcgataccttcaggttctgggtacatgttctgaactcattcttgtttgctttttgagacagagtcgcactccgtaacccaggctggagtgcagtggcatgatcttggctcactgcaacctctgccaccgaggttcaagcgattcttctgctccagcgtcccgagtagctgcgactacaggcgtgaccaccacacctggctaatttttttgtatttttagtagagatggggttttgccacgttggccaggctggtctctaactcctgacctcaagtgatctatctgccttggccttccaaagtgctaggattacaggcatgagccaccggccctggccttgtgaactcattctgtacacagggttggggagcccatcttgttctactacatgggtctaccctaggctgagaattgggcctgctcctttaagtccacgtgaggcataagtgttagcagtatggcatctgagtccacacttgcctgggagagctggcctcaagtgaggcatgctcagtctcacgggccaacttgactggggtgtggttcccaggcaaagctgttcagcatccctggcagtagctggtagagccctgtctccaaggcttggtgccgctgtggtgcagggctgagctgataagcttttcctccatttctcttcctgacagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggcaagcaaagttcctcacctcaagggcattgtggggggtcagtctgtaccctgcctccagacacgggaaccattctaaaacgggggttccctaaggtcagcagctgtggtggtgtgccccaccacacagtacaccacagacagaatttttgctactgattgacctggatttgttctaagcagtgatatttgtgaaatgacagatgctagtatttttctctaatacacattaaagtaagtatgtaactattaaaaatagacgactttaaaaataaccacctacatacgactattttaaagttcagattttaaaaacattcatctctaaaccacttgagttgtcacatgtactgccctctgtacacatcccacactcggggaagctgccaggcgggtcaggatggctcctgctcacattttgcacgtcccgtggtgctcacctgagggtctcctctgctacatctgaagctagttgtcccctttttgccttttggaaattgaagagccactctgtgtccctgttccccagactagggcaacactgagggttcacgtgaatgagagactcaatacgtccccctcacccctctcatgtttctctcctcaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtcagtgaccagttctgctcgggaaggtgggggcggagggcaggtgggcggggcctgagggctaggttcctgctgtggcccctgcattgggccacactccacagtccactgcatactttctcctctgtgattgcatggggagcgcttactccctcaccaagtttccctcacttcctgctggacatggtcccagaccttctggcctcggtgggatcaaaggagacattgaaagaggaactcagagtagaaacatgaaggctccttggctggggcccttcagatggccctggtagtgatgggccccagaggagggtgggccacagagaggctgcactccaggctgaccatgtgctctgcaggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcagtgagtggccctgtcggaccccagcaggggacttcctttaggcagggtcagccccatctcccttccccatctctcttcccacgtggcctggaagccactgggtcctaagcatcgtagaccctgggccttcaggtgtgcagggccagctttgaggccagtcatggggagaggggtctcccagggacactttgcgtcttgggctgggacggggtaggcctctgggccccttggtgaggaagaaatgggaaggcaagagatattcctagtaggagttttagaggttgccttgaagagcttgggctgtggatgtagttttgaagtttttgaacccagcctgatcttcgtgcacatcttaggtcaggtgggaatctattgcctaatctggggtggtggggatgaatatcctcgcttccttttttttattgtgtgtggcagaccctttgctctagacattttgcacctaattatttctctgactcttggaggtagatgttgtcttatagccatctcctttttctttctttcttttttttttaattgatcattcttgggtgttttggcagggtcataggacaatagtggagggaaggtcagcagataaacaagtgaacaaaggtctctggttttcctaggcagaggaccctggggccttccgcagtgtttgtgtccctgggtacttgagattagggagtggtgatgactcttgacaagcatgctgccttcaagcatctgtttaacaaagcacaccttgcaccgcccttaatccatttaaccctgagtggacacagcacatgtttcagagagcaccaggttgggggtaaggtcatagatcaacagcatcccaaggcagaagaatttttcttagtacagaacaaaatggagtctcctatgtctacttctttctacacagacacagcaacaatctgatttctctatcttttccccacatttcccccttttctattcgacaaaaccgccatcgtcaccatggcccgttctcaatgagctgttgggtacacctcccagacggggtggtggccgggcagaggggctcctcacttcccagaaggggtggttgggcagaggcgccccccacctcccggatggggcggcggccgggcggaggcgcccccacctccctcccggacggggtggctggccgggcgggggctgaccccccccacctccctcccggacggggcggctggccgggcggggactgaccccccacctcccggacggggcggctgctaggcggagacgcttacttcccagacgggggcggctgcctggcggaggggctcctcacttctcagacggggcggctgccgggcagagacgctcctcacctcctagacggggttgtggctgggcagaggcgctcctcacatcccagacggggtggtggggcagaggcgctccccacttcctagatgggatggcggccgggaagaggtgctcctcacttcccagagtgggcagccgggcagaggggctcctcacatcccagacgatgggcggccaggcagagacgctcctcacttctcagacggggtggcggccgggcagaggctgcaatctcggcactttgggaggccaaggcaggcggctgggaggtggaggttgtagcgagctgagatcatgccactgcctgggcaacattgagcactgagtgaacgagactccatctgcaatcccggcacctcgggaggccgaggctggcagatcactgccggttaggagctggagaccagcgcggccaacacagcgaaaccccatctccaccaaaaaaatacgaaaaccagtcaggcgtggcggcgcgcgcctgcagtcgcaggcactgggcaggttgaggcaggagaatcaggcagggaggttgcagtgagcagagatggcggcagtacagtccagcttcggctcggcatcagagggagaccgtggaaagagagggagagggagaccgtggggagagggagagggagcgggagagggagagggccatctcctttttcaaaatcaagaaactgagatttgaaaaatagtgacgtgtcctctgctactcggctgatgagcagcagagtcaggatctcttgtgcccaaaccagggtgcacagctctgtgctgttgcttctcaggccgtggtgatgctgagtgtgtttggttgttatgattattcagtctcagcagggtgtaggagattctgccaaaccaggcctggctcagggcagagctgctggcagggatatagacaggcccagctgctccctactgtgggtgggctaagccaccagtggcatcttgctccacacaccccaactgggtcccttctctctcctccccagggaactgtctgggacctttgctcatctgtgtcagcaagttgacgtcacccgggagaacctggagcaggaaattgccgccatgaacaagaaaattgaggttcttgactcacttcagagcaaagcaaagctgctcaggtgaggctggcccgtgtggccaaaggttagggctccagggtgcagcccaggcacactggggctcagctgctgggcttgcgtcttgggtgtggacacaaatttttctggtggggatttagctcattcgtgttagatgtgtaccatgggctgggcacggtggctgacgcctataatcccagcactttgggaggctgaggcaggtagatcacctgaggtcaggagtttgagactagcctgaccaacatggtgaaaccccgtctctactaaaaatacaaagattagctggtcgtggtggtgtgtgcttgtaatcccagccactcgacaggctgaggcaggagaatggcttgaacccagaaggcggaggttgcagtgagccgagattatgccattgcactccagcctgggcgacaagagcaaaactctgtctcaaaaagaaaaaaaaaatggatgtgtaccacgtacctcatggatgccagatggtgctggaggctcaacaagacacagcgtcgctgccttcaaggcacttgcagttgaaggcatgatggcatcacagtactgcgagactgcagttcacagcgccctgtgctgaaccgcagggcctacagcgcttaacatgtgctatttcactcagtcttccctatttctccattttctacatagaaatgttggggaacttgtctggcatctcaaaaaatggccaggctaggaggggagcccaggtgtacttggctccagcagcccccgcactctgattctccttacctgccactctttggacccatgaagagggcatagccccccatttacccacagagaagctggttacttggctggggactggcagagctgggattggaactcagatctccatggggtctctgtggagctttcattaataatttgctggaaagaacatcagtctgaggagtctggagtcctgggttctctccagccactcatgtttggcccaagctcttaactctcctgtgtctcattattttcatctgtaaaatgggagtaagatttcatgacacagctgcatgactgaatgtaaaagtgccctgcaaaagtcctcggcctgcccagctcatgataacatcagcacacggggaccctgcagaagtcctcggcctgcctagcccatgatagcatcagcacacggggaccctgcacttcctgccctcgcccctgacgtcagagtctgcagggtggcagagccagaggggagatggatcagagggtgtcagctccaaccctcaccggatcactgggctttccctgccctcgactgcggatgtgccccccccgcacccccacctggggacagctgcttcctagggacacactgcttgccctctggggactctcagaaagggggaatggggggaactgctgcttgtcagccacagtgacacagctgaacctggaaagggtctcctgtcagcacctcaaccccttgcttggcaagcagggaaactgagttcccgacagctcagggacttgcacatggtcctgggtgaaggaaacacagggcttgagaatcagaaaagcctaacttgtagctccctggcttattagccgtgtggccttgggaagttatttaacccctctgggcctccttttccccatctgtgagacagggataaacacgattgttggaggatgatgtaagggtgtgtgtcaagcgtccttaggatggtgcctggcgggtagtcctaatactgcctatcatcagctatcatggttacaaaagaaccatttctttgcaggaataaagccggttggttggacagtgagctcaacatgttcacacaccagtacctgcagcccagcagatagtgggcacctgaggcggagtctgcgtggagaggggcggtgctgccagccctaagtgccatgtgggctcccccaggggcacgtgtggctcctgccccctggccactgccaagagaatgaagcacccagtctcgtaccattttgagccctccagcactacttattttcccccacctttgcctgctgttgctggaagagctggctcatacccccaaaggacactttcagcgacagctatggacagcatggtaccaaggagttaagttgaggctttttccagctttctctggttcatttgattgcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggctcagtgcttcatcccatttgcagagcctcagacacgtcttggtggtgaggctcagttacccctgggcttaggctgaggcgggccctgtgctgggggtggtagaaaggatgctgctgaggcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaatcctt

SEQ ID NO: 35799 - DNA, 24218 bp, Homo sapiens
gagcccaagagagagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcggtgagtcaggccagggagggcaggggctgccgtagtggggcgggcccagccggccgcggagcacgtgtgggcagctcgcgctacatctcccacccgggctggagacgctgacagcacagggtccccagggatctccgggtccccaggggtctccgggtccccagcgctggccgcctcccttgccggcgctcccaggtgagcgcgctgcgccctgcgctcctggcggccgtgtgcatctcccttctggttccgggccagaaagtttaggtcttaacttctgtctcccagacgggcactgttgcggattcgcgtggtggaaaatgcctgcgtttggagaagaaaggagaggcagtctgggagaggggaccttgggtagggatggatgtaggggaaggaccgacacgtgggcctggcgctttggggtccttgcttgggatctgggaaaggagagcatttcctttggggaagaggagggcgctagaaggagacggggagggaaagatagaaaagcttcttgccaggaagggtcaggtgtctgtccctgacgcccttcccacatgggcatgggaaagacgccatgctcctgttggccacatgccagcaaagagatgttgcaatcgtctccgggaaacttgggtcttagtcccacgtcttcctccccctctctgtgcccacggctgcaaacagccattcagtgtccaccaatggctacacgcttccctcttcccggactgtgggaacgcacgtggtgtagcagctgaaaaaactttgtcggaagtgggggtatgacgttagttcaaaacattgttaccttggcacttgtaacgtaggaagggaaacaggaagatgaaatgttgagatttgggggggcagtggatggaaagggtttctgtgatggttgttggtttagtcacataacaagcgttcttttcgtaagtaacgcccctgtgtgagttcttaaacgcttgcaaagcaggtgggtggtgaataacctccctaaagggtgtgtgtccatatcgttcgctcttataaacaggaacgttaacagatggtgtaggatgcttcggagacctcttcactatttggggtggggcatgtttgtctcatctctctgagccctacttcccctttgggaagaaagttgagggagcaatgtgagagaagtgtattcaatattccccaccttgagaggactattttcttgttttttttttctagggcttttactaagtccctaccaaacaacatgctaattgtaacctgtgtaggttaagaaacaaaataggcctgattttgctggactaaaagttgcttaaatctagtcagtagtacattgtgatgttgtttctagcaaatatttcttggaacactttctgccagatgtctgagagagaaaaccttgtgttctccaaagcagtgttaggataacattgttaatgataccttattttgtagaaagcttttgcggtttttcacttaatcctgtactgttctgagattgggaaagcagatactatctttaaagatgaaggaaacagataaatgaaggttaatttcctcaagcaactgcctctgcagatccctggtgatgagtctgatgccttttatctttccactcttactgcgtctctctaaaaatgaaggacagccctttctacgtgacacctcaacactgtttgtctctgtctagtgtgtcctgccatcccctttcctttgccaagcaaacacatagatgcctaagatgtactaggcacaatgctgactaaaatggatatgttctagtatttgcaaatgggccttcacttgagtttataagcacataggccaggaaaaatagttttcatgagtgcaaaaaaattttccttctgataaatgttatggaaatctatggtcttcctccccaacccttccccttagtgtatatgaagtgggtttatggtttaaagcaagacgtgggaatgaatttgatcataagaagtccttggagaagtatttgcggaattacgaaacttttttaaactacattggagagtaaaaataaccttcagcttggattgaggttagacctgagaattatttatcatctttttcctttattattagtattgtcattttaatcaagattattccttcaacaatgctagatattaaaaacagttccagtctttatattttcccaggtaattaattttttgggcaaatgaaaagaggcactaaacgcatattatttggaatattgcctgacttaaatgcatataatgtatcaaaaacaggcctctactgtgtacatttgcatcgaaaacatcaactgtttttttctcctttgccttgctgctccaatcagagtggcctcaaacgtaagatggcctgggtttgatctctcctttggagagatgagagatctttggaattaaagctggagaatgcctcatcagtgtagactgcataactttggagatataaagacatgttttttttgttttggattttctttcccccaacaaagagagctaaagtattttcccaagtgtatcagtctagcaaacttcagaactacccctgcctacaacagagcaagtcttaattactattttagttttgaatttaaaagtgaagccttattgtttatccttggaaattataaactttgtatcttatgaaaagacagtatggattgatgttaataattactttcattctctactgaggcttttttctttattttttctttaaggtaatctattatcaggtttcctgtttcattgagtctttataattgctttttgcacttcctgaattgagacaggggcatttcctagaagtactgaatttgtcattcataattgattccaaagatcatatttgaaatagttgagataaatataaacctacaaaatacaagttacatgaagttttattttgtttagattccttctctcaattctgctaaaatcaggcattgtagagaagtggtcctgctcatgaggtagagacaaccattatggtaaagagggggattttatggaaaaatgcttaagtttgattcgcaaaactgtagagagcaaggtaaacaaagaaacaagcccaaattcatcatgtgatttgaaaagacctgttatatcacgtctcagagtggtaagtacagaactggattgagacagcagcagttctataattattcttgactcctctgatgagctcccacttggcgactggacaagttgctttacgtctttgtagattgcctgttaacaaggagccaccttgtttctcattaaagtttgcctaatatttccaagtatgaaagtgatgtgttaaggtctttcactcttttattgtagctcctattttgaacttataaaatttgtctaggttaaaacttggaacattcatcttgaacattctttttttccttcagtgtttctcaattttaatgattacagaattgtatagacttataaccactccttatcttgcgagtttcctgaaaagttgaataaggaagaaaggtttagtcttctgaaaagtatttccttatgagatcttggcttgctccattttctttttctaaagtattttggaattaagcttttaatggtttctttaggtatgtttaggctttgtctaatgttatcaagatcttagtgatatgagctatatctctctgtaggtcagatactaatttatctgcttaatcctattttagccaccaaagtccttggcactgtcaaatggttcaacgtcagaaatggatatggatttataaatcggtatgtgtgtgtgtatatttgcatgttttaagtttatacttacattgtggcaccaggagttataaatcccttagccttcattaatggcttatataaattttttaggtttctaagcactgtaaatattctcatttctaagctactggttgttaaatattacttaaaatacatttccaggacactaataaataacttatttcataaaatctagtcattaaggaagaaaaggagggggagataaaatcagaaatgggaagggccttaggataaatgagaccatatccataatttcacagatggagaaacggagtcttacactggttaagcagctttcctaaggtcacccaactagtgagtcattgagctggatctttaactcacttctggtccagtcctatgtagaaactgtaaactgtggtaacttttaaccgtacaggaatgagaacataactacaagatgctgggagtattatgaggttttcacatgatatcggcattttctttgctttcccaccccttcttaaagtcctccaatttcttgtctcctttggtggggtgggggtggggggctgttttaagtttcagtgtaaggagagcctagttcacagctgtgccctgtccttttaactgtcttgctttgcttttgctgggaggaaaatctgaggctctgattacacaccatgtgattcagaaagagacagaggaacgggatgtttctgtatgttgagtctgtgagcttggatctaagcactgtggcaatgtggaggaggaaggtgggtggcctgtggagttagaaatgtttaacaaggattttaggtgtctgaattgagtgtagaaaataagtgaaaatatatgttgtgttttgaggacttgggagttaaattcataacacataggttcttttaagtttttccacatacgtactacctttaattgtgagctttttgtctttcaacagaaatgacaccaaagaagatgtatttgtacatcaggtaagagggattataaatactacatttgctatgtgaggagagggtgtgtaatcttctgtcagccctttcccaaaagtaagtcctatggattattattttaatctaaactctttctgtgatttattttgcaacaggagttcagttccacattttaagattggcaaataagttcttctaccccatcatattaactgttttcaaatagttttatttttgcagttgtataaagtgatatttggttagaccactttctaatttttaaagcctttgagtccttagcaaaaaaaagaaaagtctgtttcccttttagcatcctgttctcctgatgtggttcctccttagtgtttgcctggagccaatctggcttctgcctgggtaggtattggttaaagctcctctgtcagagcagctctcaattgaagtaaatagcgcagagaagcagatagtaagatgagaaaacttccagttcccagggtagccctcactcttgttaaatgaggcatgttaggacgtgtccaggtcaaaagctgcaaattcccttagatttgcaggaaatagaggaaatgggtaagatatggagcttctctgctataggtgcctcagtttttctttgctttattagcctaggatgttatttattctgttattaatatgtcctagacttcctttataaaataggttaagagaaggaatactatccttagtgttctttttgtttatttagttttcagtgaattgtctgaaatatgcgttctcagagtataacaataaggaagatagagcagcaggtactaatgccagcccattctcttgcagtgcagaaatccagaatacatctgattttctgtgtttttgtttccttctgtttaggtttgtgtgtgtattggagtgaccgtaggagttggagatagtggtatctagctgtggtttctattgtttatatttctacttgactggatatatctcagttgcatttagataatttgagtagatttattttgttcagatacagtgacttttagggtcataatagtgttgtttataatacttggaggtttgaggttaatagaccttttagggtaagaattctgaagactgctagagtcaaggtcctcagaagttgctgtattggtggctggctttattagcctgtgagtatatgacccgattccagcccccgtgaggttgtgtggtgagtcacctcaatgtgttgaggcttgcccagtttaacaggaaaaagggagcgagccggcagggaggggctgtttttggaatggctgaatgttcatgctgcgtgcctgtcctgaactgccttttttcctctatgggtgaggtctctgctctgttggctcactatttcttttccctcctactcagagttaggggacgggctggattacacatgcttaatcgctttataaaataaggttgacctagttccatagaaacgcaagcccctttaactgtttagagataccagccaaagaaatggaaatgcatggcaggaattattttctgccttcattgatggaacaagagagagcagcacctattcataagcagatatttaggtgtagatgtttaatgaagaatagcatcttcactaaccttttaatgtattatcagggaatgtaggatttgttgacatgaattgtgtgatgggagaaaagttgaataaatatcatataggtagagtacagggatatgaattccccctcctccacttcccccatcatccctggggctgttacggttgtgacttcagataaatcactttaactgttagcctcgtgttaactcatctgcaaaatgggaggagaggggggaggccagattattactaatacgttctgattcttgagataattttgtttactcgtcagaaatatttatccccttggcattttaatttgtttttctttatcactgcctcctttcctcctccggagattcagagaatctctgaagcttaatggtttgaggtaattaatacatctgatatgatcaggtgatcagcctgtaacagtagtgtgtagtcactgcacacactgcagttatagaaaaaacatgttctgtttaatccacctgtcaagatgaatagcacaaatcaaggaagtaatgtggaatatagttttatagtgctttcttgttgttgtgttggagatccaacttagtgggagaatggtggaaaaataagaatcggtcaacagtttcttcaagttcactctggtgtacttgaaagcagtgaaatctgtggccaatattgaaatatacatcgaataaaattttctgttctctttccagactgccatcaagaagaataacccacggaaatatctgcgcagtgtaggagatggagaaactgtagagtttgatgtggttgaaggagagaaggtgagaggaaattgtggttgggtatcaaagtgctggcacatagtactgttgcacaataaattatctatcagccccttatgaattgacatgactttggaatttttgtacaatagcaggaagtgacttttaaacagaattttttttttttttaagatggggtctccctcttgcccaggctggagtgcagtggcgcgatcttggttcactgcaacttccaccatccaggttcaagtgattcctctgcctcagtctccctaatagctgggattacaggcatccaccaccacgcccggctaatttttgtatttttagtagagacggggtttcaccatgttggccaggctggtcttgaaactcctgaccttaggtgatccacctgtgtcagcctcccaaagtactgggattacaggtgtgagccaccacacccagctagcagaaatatttttgacattgtcattataaacattctgcaataaagatactttaatttcttatttaataaatgatcaactctgattatggaaagaaaagctgatttctcaatttaaaaataatttatatttttataccaaaggtatgtatttcgaaatgcagattaaaatttaactatcttatgtattaacaatatattaaaagtgctttgcagctgggcgtggtggcccacacctgtaatcccagtactttgggaggctgaggcaggcggatctcctgaggtcaggagttcaagaccagcctggccaacatggtgaaacccgtctctactaaaattacaaaaatatctgagtgtggtcgcactcctgtaattccggctactcaggaggctgaggcaggagaatcgtttgaacctgggaggtggagtttgcagtgaactgagacattgcactccagcctgggggacagagcaagattccgttttttaaaaaaaaaaaaagaaaagaaaaactgctttggggcaaaagatttcttttatcaaagtaaagttttcaggctgacttgtaagcacttctacctacaaataatacatggtaaagaatattttaatcccaataaaaggagatcgaaattgaatattaatcattttgttttctgtttggcttggattttgggaagctgaaggtaccctgatagaccctaagatagcttcgtccgggtgaactgaatccaagaagttaagggattttcctgaagactagctacagaagtttttaatactgttatatatttaattccgtgtctgtaatgccctttatgctttgtgtttagtctgttatagatactagtaaaacaatattgagtaagattaaaaacacgctaaaactacatatagcacaactgccatggcagctaatcatggcagctgaattataaattaactggatgagaggttaactccctgtatgtgctcctcccatatacacatataccattccataggtcatgttcctaatggctctcaaaccattgtgttttaaaagaaaaacaatttatttcattggatgcagaaatttaagtgattatctttaccggtgtgatccccagggtatcttgtaagtcttttagattttcaaatcactcaccagcacctgccactctgtgaggatctctgatatcccatccaatttttaaaaaattgttttgggttgatttttcttctgtatgttttcagaactcagggttttacaaagtgatgtagggtgtgaaatacactctctgaaatcttcttggtctacatttttttaacatttttgaaacattttccatttgtccatatgagaataagaattctaaatctgtttcaaggataataggaaaggctaaagaaggactacatgtgtggagaatattattcatcaaagaccctttcttcttgttgctgccaaaataggagaagtttcactcagtacctttgtgctggacagagaatcatatgagcccatgaatagggattgtcctcttggtacctcctagactaacataggtttcaacacattctaggaaaataacagtatctcaagtctttcccattgaggaatattcttcctggtctagcattgcttctactttgacagttgtatatttgctaatttatgttctttaaagaggttacacattgcttttgcgattgacattactagacaagaaagcaaaactcaggttgtatgagcaaacaagccatatatgtttaaatcaggatgtgaagtaccttgctcactttgtttaaaacctagatctgtttttaaaatcacagtgggaattcttagtatgttctgccagtcttatactctagcagtccaaggctgttttttgagttagtgtatattctttttaattttgaggccatctttttattttcttctcagggtgcagaagctgccaatgtgactggcccggatggagttcctgtggaagggagtcgttacgctgcagatcggcgccgttacagacgtggctactatggaaggcgccgtggccctccccggaatgtacgttgtctctgttacttaaccagtgattgagaaattgttcatgcatggaattaagtgtatgtacttggagcagataaatgccttgtcttctcctggagacaaatgatttaagtgatttttattttttctttagaggaaatttttatcttattttttaaaatgtgtattattgatttccataggtttttgggaaaccggtggtgattagttacatgaataagttctttagtggtgatttctgagattttggtgcacccatcactggagcagtatacacggtactcttaaggggaaattttagcgctcagaacttttccagagccgctggtctcattagacacttgccattcagaagttgtatcagttaggatatatttggctacaagtaatagacatttaattatcttttaacaggaagacttaagggagacagtgctgaggttttttttaacaaggtttctcttcatttggctcttttttctggccagaacctagtcacagacattcactggcaaaggggaatggatttccatcattgacttaaccttgttgttcattctttggtgccgacactgttgacctctaagaaaatcaaaatttggttggtgaaagagtgagaaataacttgtgaacaggcaataaaagtacaggccacagaactattaacgaatttgccttggttaagaggctgttttatttagcatagcatttttccattatttcaaagtaaagaagcaataagtgattctgtggatttttagttctttaggttggtttcaatgcaggggaaagagtttgtcacaaatctggctggagctttcttgggaggctcagtttataggagtattctcaaggcacccaaaacggacccagtatatttgtggtcatgagaaacttactagatttgaatcattcttggtgtttctagaattagaaccaggtattggcacattgaagaaaactccgaatgtttgtcagcacaggattgtgactgcctgtctcatccaaagaaaaactcatcagaattaaatatctgcagattgagaatgacctatctttatgttttgatagctttatatctttctgtttacctaaatgcttttcctccttattctgccatcatcacatcctgcccaaattaattctgtcagattccttaggacttcccacttgtttctttgtttttgcttatcttatttggtttttaataagctatgagggggatagctaggaatgagctgctgtagcatttcctacatcatgttctctttgaagttcatcagagtcacagagcgctaactgtgattattttgactcccaggttaattcaaaagcaaaagtggtagaaaaacattcagtgaaaaatttttcttaaagacttttcctgtccaaaacctgaaaattccaaagtcatgcatataaaagatatttagaaacaaaattgttaaaacgcttaagaaacaaaattgttaaaactcttaaagtatacataaatgagcttttttgttgtaatatctaagtcccaacaacttgttcagtatctctcaaaagagtgtgttcagcattgctggtgccattattatgctttgtaaaactcttaaagatttgattgtgtgaaatgcaaaagaggaagataagcccaagaagaaaaacagtttatgttgtctcacacttaatattttggtaagcattttctgtgcaaataaacgtttacataattgtgaatctcatctttggtagaggttttatgaagagtagaatgacttgattttttttgaagttagactagttgaggcttttttggagggggagtttggttgcacatgtggacttgttctggaagggtccaaagcttaaatacactcctgtaaaaaaaagtaatgggtcattattttgctttttttatttattcatttttaaaaactagttacttcccattaaagacatttgcatatcccctttaaagtaagacttgaaatcacagtctttgtaggatgtttggttttttaaaatgtaaaatggtagtatatgatataatttaaatagaagaaaaatataaaatgaatcggtaaattcctttgtgaatattaataagatctattatttagaaacctccaggattagggcttactaccatcaaagtatgattaaagctttactcctaaacatataaagggagtcatgccttaggtcagtggttctcaaacttcctgattttgggatctgtttatatgcttacatgttattgaggattctagagtttttgtcaatgtttatttatattaatattatattagaaagtaaaataaacttaaaatgttaattgattaaaaataactatatgttcatgaaaataacagtttttatggaaaaaaaatatttaaattgaaaagagtggtattgctttatacttttgcagatctctgatgtatggtttaatagaagatagctggattctcacatctgtttctgcattcagtctgctgagagaccacatgtcattgtagcctttgggagaccccaccatatacttctgagagaatgcctgggaaaggcaaatagcatcttagtaatattatggcaatagtttgacctcgctgaccccctggaagttttcagaaatcccatccacactttacagacttgtaggaagaataccacttgggtcaaatatgttggtaacatcataaaatgtattcttttttggcttttccctgacattgcctcagtggatggtaaatgctgggagacacgcatttgatggagcaaaaattataaaccttgcagatactcttcgggtggttggttagctgatacgagttctaatgagatgactattaaattgattgtagattgattgctcttgcttttctgcttcttggtattttatctgcacagatctactctaatcttaatgtagtttatcccaggcaatcacatgataatctgggttaaatgcattttgtctgtataatggaaaggattatattgctttggggagattttattttggtgatattcatcctaaatggtgttctttggttctttccttgctaaaacttcttctgaatctctgtttctttgcttcgctagtacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggtaaaattgcaactgagacttctcttcagcaatcctcacccttccgtccttctctgcctcctcttcctcctcctcctccaacatcagctgccagaaaccttgcttatggcttcctgatgctacaaaagctgaggcaaggccttcagtctgttttttcaaagcagtcattccggtaacacttctaaaagcaaaaccacgtgatccatgcctataatagggaacccttatggccaaagtttctagttgatagaagaacaaaagaattaaggtaacaagacaggtggaatgtgtaagagcttggactctgaagtcaggctggatttgaatcctgtttctgctacttatttgtgaggttttgagaaaaccaagttttagattaagttcatccattaagtgggggcattaaatgcctgcaccatagggttatgatgattaaatataaaggatttagcaaaagagatgcctgcagcataaataacatttttaaagtattggttttaaatgagacagtgctgatttttaaaggcaacctaccagaatggaggttgttgattattgattctcctttttcactgcagaatattagtacagctgttttgagtttgttttgtgcttaataaaccttacatcaattttgcagttcctagggaacttggaaaactagggatagatcatcatttttgttatcagtagccacaacttttttctcctcagtgtcgttggggtttcttttttttcccctcaccgctagatgttttgaccgaacattatgttcagtctgttctttgctacccttctcctgtcccatcatgcatgactgtgttctttcttgtttttttccttctactcttcaacagctgcccctgacaaatgtgctaaaaataacaagtagacttacatatatggagagattgggtacatgagacatagtagctttagggcagcactctgggcttctaggaaacaaggacaggaaaagtcagtgagattgtaatatgcacttatttttagcgtcttaatagtgctttcctgaaatactcctccttagtgtttggcttatacaacatatatcacgtttgctgaaagcatgatgattctttttcatatcttttgaaataaaatgtatttcaccttaggaattgaagtttcagagcaaagtcgttccttagtgccacgtaaaacatcatatgcagaagctgatcgaaagctgcttttgaacatgtacgcttattcctgtaacttaactgcatttagttaattgactgaatggctgactttcctacctattccatgtcagaagtaaaagttgtcttgatcctttaaaccatattttttaataatctttataatatctactagctctctgactaagtagtctggttaagccagtcaagagcatcaaaagaaaattcctaaagctctcatccatataactaagctacttcaaggttgtcagtgtgttctcttaaaaatatatagatggatctctaggatagtaaaaattattgagatcaaatataaaagtcttcgccaacgttttctactattacaacgctatgaaatttattgggcataatagaaaaaaaaaataggaatatataggccagtggtatttgccttatgcactaaggacataatatagcatgatttattagtgactgaataacttccatttttaaagaaaatagttctatagatttgaaaattaagtagaatcattcactgagctactatgtgcttgttgtctttgagaaaataattatatgatggagggaagggagcaacattgtggcatctaccaggtgacagatatttggaatcggttcttactttagttgtctctagagcctgagggaagcagtggtttccatattttttgttgttgtcacaaatgaaggaatttgattacttttaaaaatcagcaacttttattttacatggacaagaagtggtagaacttaattttaattcattttgttcttgtcatccagtctttctggcagactctcatcctttatacacgttaattgctgtttctgtcagtctttttttgtgactcaacagtttctgaggaagaaatggccgagcttacttaggaaactaaagagaggctcatgtgatggggatgatgtgaatgaagggggagagggtatgaggtgagatctcaggggaggtcagacatgctggtagaccactgtaaagacttgacctactgtaaatgtgatgagaagccagtaaagggatctcaacagaaaagaaacattgaagagattattggactgttttgttgggactagaccacaggaggtaagagtataaaagcagggagaacagctgctataatcttttcagtagagaaatgaacatgggttgtattagagaagctggcagtggaaggtctgattaaatggttagatttggaaaatgttttaagcatatagaggtgttggcatttcatgatggattgagtgaagagtatgaggaatggtaatatattgtatgaggagtaaataatacctctgcagttttgatttaaacaaatacgggaatactgaagaaagattgggtttggagggaaaggtgaaaattctttggaggtctttttctcatattaaattcacgtacaagtggaggtgttaagtaggcagaagaaataaagcagagggaagaggtagaaagtggctggaggatggaaggtgtagtcttagatacagtggttgacaacatttttgggagttcattaagttgtatttgagaagagacctaaatggagcaagggatcaagtccatcaggtcccaggaaaggcgtgaatgggagtctgaaggggagaaatggaactgcaaataattatttggaattatttatttatttatttatttatttattttttgagatggagtctcactctgtcacccaggctggagtgcagtgacacgatctcggctcactgcaagctccatctcctgggttcatgccattctcctgcctcagcctcctgagtagctgggactacaggcacccgccaccacgcctggctaattttttgtatttttagtagaaacgaggtttcactgtgttagccaggatggtctcaatctcctgactttgtgatccacctgccttggcctcccaaagtgctgggattacaggcgtgagccaccgctcctggctgatttggagttataaaacaggatgtttaaagccgtaggggcaggatgatattaactataaagtgagtgtaggtggaaatagggtcctaggatcaagttctgggacacaccaacgattaaagattaggaagatgaggattgtctagcaaaggacagtgagaaggagcagccaaggagaatgtatttcaagaaagaaatgtgttaaatgcttgttgataagtagagattaagctgagaattgattattagatttggtaacttggaggtcagtggtttggtgaagacaaaagtttaaatagaatgaacttaagaaacagcaaagggcgggaagaggagacatattccccattgaggtttctgtagtggtggtcatggtgtttggtttttctttagtatgtatgtctgtaaagaaatggggtagtagctggaagaagataagggatcagagcaagatttttgcttgatttgatttgctttttacaatgcagagttacccctggtctctcccttacccgttacctcaccaacaacttctaaagccattaaatgggcagatcaaggtaggcacgtgtgtttgccataaacccacatatatatatacacacatacatagacacacatatatgtgtaacattgtgtgtgtgtgttccatggttctgtctactgaaaggtcctgaaagccgtgatatcttagtaacagcattgagcatacctgtcccccaattttttgtttttaaataacattctcaaacaaaaagaattccctttggagaaatggctgatttcagagctgggacagagaaagtataatatgagcctggaacatcttgttgtgccagaaagcgaagaagtactcaaagaatgttggaaacacatcaataggatatgagccagcttgaaggggttcccattggccagtaatgatagtaacagattacaactcattgaaaaaaatagaaaaccatgagtccatacaaatataaataaataaaccaatatattgaaaaatttgataacgaatagtatatttatgcactttgtaagtacttcctcacaaagtactcattaattacaaagaaggaaagagtcaacttacagtggaggactctggtggcagataccaccttaaccacttatcaaagtgaacattatcagtaatggcacaaattgaaactatatgccacctgacaggatgcagtgaggagaatgcagtgtcacttttgtgacatccccctggggatgcaaaaacaatatctaatcattagtgaacaccaataacccaagttgagggatattttacaaaataactggtttgtaatctttaaagaagtatcagggtcatgaaaaccaacgtggtggctcatgcctgtaatcccagcactttggaagtctgaggtgggtagatcacgaggtcaagagattgagaccatcctggccaacatgatgaaaccccgtctgtactaaaaatacaaaacattagctgggagtggtggcacatgcctgtagtcccagctacttgcgaggctgaggcaggagaatcgcttgaaccagggaggcagaggttgcagtgagctgagatcgcgccactgcactccagcctggcgacagagtgagactccatctcaaataaataaattaaaaaaaactgctccaaacaaaaagatataacttactttagtgcataattctaaacggtgtttttgctataaagggcatcattgggataaatggtgaaacttgaatgggatctgagaattacatttaacttttctgtaactttgtgcttatttcaaaattttaaaaaattgaaaaggatgggtgctatttcactgggtatatatgcttggatggaaatgatagaaaaggtgaaaacatagtgaagggatagcgttaacatgctgtgtctagttgatgagaatagagaggctgttggtttcagatatgaacttggaccacttacccagggtaatgggagagaagaaaattctaatgtaaatacagggagctgggtagatttgctaatgagaacgtggaaattgtcttctgactgtttctctttcttgatgaaataatgaaggacagtatttggctcttagggggaggaagggatgttttgagaaaagaaaagaaagttgagttatggctgtatggtcaagaattgcagacattgttggtgggtttttttgtttttttaagttgttctttctttcccctggaagttgtacaataagttaattttattccactggcttaaagtaagtttgttgtaaagaaaaataaaagagtattttatttaaagagatgaatgaaatgtatccgatttcaaaatgttaaattgataggcgaaaataaagttaggtgctctgggactaagcaaatgagtattctagtcagactaggtttgtcttccttttcagtcgttcacgaagatttactcataaatagtttgtgttgcaactgagagtgcctaattttgtaatgaagcattttgttttttacttctaaaaaaaattctgaacatagctgtatgcactgtatcttatcccctgtgctgtgacactcactgtcagctctcattgcctctccaggctggtgagattggagagatgaaggatggagtcccagagggagcacaacttcagggaccggttcatcgaaatccaacttaccgcccaaggtaccgtaggtatgtcgcattttccactaatggccagttaaaggacttgtgtgcacaatggtagaatgaggactgtgtggttccgttttgtggatttattatatatctagaagatgtgaatgctttgactacatgccagagttttcaggtggtggtgtgacatttcccacctacttaatactagaatttttagttatctctgcgccaaagcgtcattttgtattctggaattataataagatgtaaattaatacttaatttttatcaaaataaatcagataaattattggtgggcaattctgtggtaatgctgcagatggaggaagaattgagtgtcagaggatatttgggatagtgactgttaatcactgaggcagtccagtagaggggttaaatcagggtatgatcaaatcgcctgaatttatcttcctactctacagttcattagatgtatgttcttggactgcattccagcctgcgcaacagagtgagaccctgtctgaaaacaaagagatattctatagttggggattaaaggtactaatgcagctaagataattagtgtggtacctgataaagtaaaggcctcactatgtattagatattattaccaccattgaggttaatattagtgaacgctgggttattctatttgtgctttattcctttggaagactgaattaggctagactccttccataagatccctttgaagcattttataatataagcctgcccattcttttatcttaccctttgtggtaagtggaaaagctacaacttcttcctgaatgatgtttatgctaccttgaaatttgtcagtatggctttattgaaggataaaaagtatattatattgggaaaggattccaccaatataattgtaaaaggatcgtatcctttttcttcacaaggttccctccagctttaggcataatcactaatgattaagtactagggactttgaaaataaaagagacggcatagaaatgtcttactggaacaaaaaggattcagtagcgtgtgaggctcagctttgtcagtccctggatatgtgatcttggaaagtcatatttgaccttttttaacctataaaagcagcacttttatatagctcagccgtatactttatcatgtaaacctcttggttttcttgttataaatctcatccacagaattaccattcaaattaaatatttaattttaaaaccgactagcacaggctctggcacataataatgtttcttctcatgtttaattcccttagtctctgctaaattctgttcatggaaggcagataccagactactcttcttttcttttttaattttcctattcttagtgcttatcaaagggcctgataggaacagagtatgtgttcagtatatgtatgttccttacaaatatgtattcaaatgaaaggggaaaatgatggaaaattaagatttttttttcgtgaaacctctattccatttgttgcattgacctgcgaataattctagcaataagtactcatcacttgacttttttttttttttaattttgagatggagtctccctctgtcacccaggctggagtgtgccaatctcgggttgctgcaacctctgcctcatggattcaagcaattcttatgcctcagcctcccaggtagctgggattacaggcatgtgccaccacgcccggctaatttttgtatttttagtagagatggagtttcaccatgttggccaggctggtctcaaactcctgacctcaagtgatccgcctgcctcagcctcctgaagtgctgggattacaggggtgagccatcatgcctggccctgatcacttgactttttaatttttaaaaataaataaaaccttattttctggagaagccctgtcctgttggcacctgttctattttcttctgtgttccctacagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggtaaatccaaccagtcagggcggatgttgccagatagtctttaatcatgtcagactttagcattctaaaagtggttttatcacatgaaacctgacacttaacaaatataaaaacattttgctcaagatccatatatatagggtatgccttgtacataacacagaccacatatttgaatccagttaacattctctgaaagaatgacccatattaatggggattcagagctaaaacatttggggttcttcaaagaagagaggcatttatcaagaggaagctgcctctaagcatgagttgaaagcagttgtatatcagactttatggagagtagtggtatttagttgccgttttgtaagctgttcttatatggtactaattttgttttgttttgttttttgtttttgtgaggttttggtttcgttttgttttggtagagatgccagggactgaatatggtactaatttgtgactcatacttaagagtagttaaatttttgcatgctaattttccttcacaggaaaattcaaacttttaagaactttcagtcttgaactttccactgtcatctgactttatctgatttatggctttgttttgcattttaggccaaggcaggtgaagcaccaactgagaaccctgctccacccacccagcagagcagtgctgagtaacaccaggctcctcaggcaccttcaccatcggcaggtaagagctggggcagcccagtcttgagttggtattttctttttagtatcactggtttctcaacaagagtacaaattagtctaaactagttctgcagttcatctgtgccaaccccttgtctctattgggactctgtggaaaaagtgatttggtggttaaatatttctgggattgacctcattttgataagctttggtgagggtataagcattcagacagagttgatgatactcaacttcttttttctagacaggcagttttttaactactagtaccacttaggaaaactgatgctaaaagtccctaacaaaggcctggttttagtaatcagaaacagtttcagaacctgtttagtaatcagaaacagtagaataaactaaaggattttttttccttccctttttctttgataatcaactttatttattttgaggcggtgcagcatagtgtataagagccaaggtttatctacccattgcaggctctactgtacctctcatttgctgggtgatcttgagcagtttatcctctgtctcagtactatctgctactggtaaaaattaggatactaattatatttactagggtcgttgcaaggattattaagtgaaataacagggagtgtttacaatagggtatggtaaagaataacctctcgtaaaaggatagcttgttattttcttgtcattttctacttttttctgtcttttaaaggtcttggacattttatttacatagaattatagccagaaagatcaactcaattataaattctgggtttgtttttttttaacctataacccttttaactgagactttagttcttatacttcttggttatcaccctttccattagcttttagttaagagagaggttgtaaactcagtgtcaatgctatttttcaaaaattgttaaaatttcatcaatgaagttttgggattattataagttcttgtgtcttaaggccatctgcttttatatccagtgatgtgggattttaatcagccattaattaggtaagcattcactttgaggacaatattctgttttatcttgggtagcatggacagtttgtcacagaaataagttccctattcaaacttggaattagctgattcagagtaacatattaataatataaaaatggccatacccttttatggcgtaacattatttctaggtattgtttctaaggaaataattttaaatattgggaaaaaatatttttacaatttacagtctgtctgacatttggtaaatagctaattgtgatatattcatattaggagatagggtgcagccactaaaatgattttgagtattgttcattagtaatggtaattttcttttatacaattttataaaatttttgctcttatgtactgacttttctggtttataaaaatactttattaaaaagtgagagtttccatttaattaacatatagcttacagatctatacaagatgtgattgtatttagagcatttgaagtactctttttctaattatatgaaaagcatataatttctgcctttttattctttaactcatggttactttgtcactctttataagtttgattttaatttttcccaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagg

SEQ ID NO: 35800 - DNA, 134193 bp, Homo sapiens
ggagtgaaaggtaagggggagcgagagcgccagagagagaagatcggggggctgaaatccatcttcatcctaccgctccgcccgtgagtatccgcaccccaccggccccaaacgctgctccggacccctaacgagcagattgtcccttcatattggtgtttgagagtggttgtgggggtgagaagggctttggaaaagccgccggggccctggctgaggcttctcactcgctgttcctcgtacatgttttggagtcagcagcaaggcccctattgttatcaaaggagggagggggtggggagcggggtcgaagctaggaaaatgctgggggtttaggcccgagcccagggcgtagacgtgcctctacatttttgcctggccctgttgggaaccaccgaagattgatgttgccattcgggttgctttttttgatgggtttgcgaagccccgagtcttctgtgtggccatgaagtgtaattctgtgccaccccgatttcttcgacttcttgagcttccgtggcagcgccggaggaggaggaacaataaatcgctttagaagcagccgtggcccttgtccacaggcgagattcaccgtgggggaactttgcgagccttaaatgtggagaagtggcgatcaggaagtttcagaatgctttttaggctcctgggttgctgtggccttttgtttccgtgtgagcttgtgtttttggtgggttcttcctttttgagcctcccggtgttggtgtctctcttcactcaaagaggggttcaccccttgctagtaggaaaatctagatacacaatactagttttagtcctcacaaacatgcttggtaaacatagatcatttgttttacttgtcagtaccattcccacgtcaagtgaggaatacactcctgtaacttttccctcctatagcccccccccccccccccgctgaaaaaacaaagccagaaacccacacacagcattaccagagaaggctttattctcccgtaacttagattgttaccttttattgttcaattaagaaaacactgttctcagccctcgataccattttgctcaattcctgttattactgggattaattaagaataagattttatgaagcttttcctgggttctgttttaaagtcagttaacttctgaaacaataggcttagcattttgtttcttgaaagcacctaaaaacttactaagacaggcccaaccccaagaaatgtggcttccgatgcagttttcgtaagcaaaataaacattttgaccctttgctaattttaactttataaaacactggggggctgttgattctttatctgggctcttgggaaacgctctccggattctgaactttgagttagtgttttgctttagcgacaattgaattcattttgttcaaggccacagctttttgaagttggaatttgtttagtttaggtttaaaatgaactgttttaagataaatttatgaccacagaatgtttgttaagtgtggtaaaaataaacaccttttaaaccactaagcattttagtaaaaggtgagccatggaaataaagtaaaccgtgttcctttgaattcaactcaattagtgatattttaaaaaactttgtaaacatttgaaagctgtgaaagagtagctggactgagcacttctagttgcttaaagtacttataaggtgtcatttgtaaaaaaatcacattttaaatgctacacgtattagtgagcttttctgatatttaggatactgagtttttaatttttgtgccgtatttgccaaaataccacaaaactacccaagataacatgttaattgcttaggtatttgctcactttgaaactgttctgccaggttttctctggtttgagaaactgccttgcctctttaggtaaagcaggaagtcttagggcatacagatagctttacaaaagccaattgtttcgtttgaacatttttataggagtcttttctttcccccattccttttagaatgaaggtgtgtttagtgtgcgtcagtgataaactcctcttttatgtggatattctttgttagataacttttttcttttaaaaatttttatttgtataatttgtgaggtacaagtgtaatttgtacatgcgtgtattgcgtagtggtgaagccagggctttttgtgtgtccatcactggaataacgtacattgtcctccttaggtaatctctcattatccttctctcagcctcctagataactattttgagaaggcttttatttcagaaaagattgcatttgctgttttaggaattctgttagggactggagttgccttaactaggggtaactaaattctaagagtcttaagcacgatgactttaaatttaccaaaaacttttatatttatctcattttcattaagaaaaacccaaaacattgagagtcatagaggaaggatttctttcattttctagatgaggaaacaggtagttttgtttagtgaaagaacttgggttttggaactcttggcctgctctagaacaaagattgttaggtcgagatttccttttagaacagaatgggactgtctagtattagtactaagagagtaatgaattctttaaaaaaccaagcagggaggcattaggctggtttgcacttttgaaagaccgatggtgaaaccgggctatgactttttggttttggtacttgagcagggactagtgtctaggttagactactccagtaccctgctaaggttctgatggattggaattcttaacctagactaggcatttccaaattaggctttaaacaaattacaaattccattgtgtcttcttaggctggcttcaaaaacatgaatttagttgtgagaagcaaatgctactttatcagaaggtttatttattcaacagagagatagtagatttgttattcatgtgtttttgaagcatcacagtgggggttgggagaagagataaagcatttgtagcagtagactgttaggccgatggctttgaaattagaccgtggctgtggacaggtgtgtcctaattggtaactgatttatttactttgtagctttttttttttttttttgagatggagtctcactctgtcgtccaggctggagtgcagtgccttgatctcggctcactgcaacctccgcctcctgggttcaagcgattcttctgcctcagtctcccgagtagctgggactacaggtgcgtgccaccacacctggctactttttatatttttagtagagacggggtttcagtatattggccaggctggtctggaattctgacctggagatgcgcctgcctccgcctcccaaagtgctgggattacaggcgtaagccaccgtgtccggacactttgtagcattttttaaaagcacccacaggctggcaagtgttctatcttaagtacagatgcagtttttggttttaaggaactttagtgtttcatagtaacatttgagggattctttgttggtcttccagaggagtagaggatacaaatgagacatattgttgagttactcctgcaaggggttagtagaaagaagtaagcttgggaacgattagggtttgaatcctttctctgctacttgctagttgaatggccttggaaacatcccattttcctcctgtaccttagtgttttcatttgtaaaatagaaataataatggctacctttcaatgcttttgtgatgagacaatgtctgcgatatattcattacactattaccgtgttgaagcttctgtttgtttgtttgtttttgagacaggaactcactctgtcgcccaagcgggtgtgcagcctcccgctcctgggctcaaatgatcctcccacctcagcctccctagtagctgggactataggcacatgccaccatgcctggctaattatttttagtagagataggtcttgctatgttgcccaggctggtcttgaactcctgggctcaagctgtctgcccacctcagcctcccaaagtgctgggattgtaggtatgagccaccacacccaactgaggcttctggtttgtatagtgaggctttcttttttttttataatttaaaaaaattattttatttatttatttattttgagacagagtctcgctctgtcgcccggctggagcacagtggtgcgacctctgcctccctggttcaagtgattctcctgcctcagcctcccaagtagctgggattacaggcgcgtgccaccaagcctggctaatttctgtgttttcagtagagtcggggtttcaccatgttagccaggatggtcttgatctcctgacctcatgatccacccgcctcggcctcccaaagtgctgggattacaggcatgagccaccgtgcccaacctccattggccttcttagagccttattttttaataaaataatagagatgggggtctcactgtgttgcctaggctggtcttcagctcctggctcaagcgattctccctgcctaagtctccgaaggtgctgggatgacaggagtgagccactgtgcccagcctgtagtgaggctttctacactaatatgaagtgtttaaatttggtttggtctcatcctgtttatagtagttgaagtactaatggcataatgtgattacagttaatagttgtaagttactggtaaaaatattaatgcttttaaaaatcagtgacaactgaggagagggcttaggctaaaagcattctgctgctgttcttggtcagagggttttattgtttctttaagaaatatcctatcaatatattggaggttttatttatttatttatttattattttttttttttttactgaaacagagtctcgatttgtcgcccaggctggagtgcagtggtgcgatcttggctcactgcaacctctgcctcccgggttcaaacgattctcctgcctcagcttcccaagtagttgggattaaaagtgtgtaccaccacacccagttaatttttgtatttccagtagagatggggtttcataatgttggccaggctggtctcgaactcctgacctcaagtgatacacctgccttggcctccgaagtgttgggattataggcgtgagccacctcgcctggccaatatgttggacactttaagggatcctttcaaattacacaatctgagccattgctacttatatatgggtttaggcttttgtttagttattagcatatgtctgctccagctgtaaagttgtgattgattgattgattgattttttgagagagagtctcgctctgtcacccaggttggagtacagtggcatgatctcggctcactgcaacctttgccttctggattcaagccattctcctgcctcagcctcccgagtagctgggattacaggtgcccagcaccatacctggctaatttttatatttttagtagagatggggtttcaccatgttggccaggctggtcttgaactcctgacgtcaggtgatccacccactttggcctcccaaagtgctgggattacaggcatgagccaccacacccggccgaagttgtgatagttttaaaaaggcttttggggctgggcgcggtggctcacgcctgtaatcccagcacttccggaggccgaggtgggtagatcacctgaggtcgggagttcgagaccagcctggccaacatggtgaaaccccgtctttactaaaaatacaaaaaattagccacccgtggtggtgggcgcctgtagtaccagctactcaggaggctgaggcaggagagtcgcttgagtctaggaggcggaggctgtagtgagccgagatcgcgtcattgcaccctagcctgggcaacaggggcaaaactcttgtctcaaaaaaaaaaaagcttttgttcatttaaaaactgtcagttggtttgaggtataagtaagttgggtagactgatagaagtctaattctgtattgctatgtgttggttaacaacataaacttctctgaagtggtagtattgagttctgatcccaataccttgccagagtgcatgccaccaacgacatttatttattgtaaaagacatggggttcatgtttttatcttagtgtgttttatgtttcaaaagatggaaatattaaatatttgtaacctgtttgtccttaggtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtaaaaaaaagttcactattttagctttgacattcctttataatcactgtccacttaggatatctgctttcaatgaatgtctttaaaaacttaaattgctgatttcatttggtacaaacagttacttgttataaaggttgatcattgtaatactgttactgggtcatttatcattctggtgctaaatagtaaatagccaattcattcattcattcattcatttgagacagagtcttgctctgtcacccaggctggagtgtagtcgcctgatctcggcttgatctcggctcactgcagctgctgcctcccaggttcaagcagttctcctgcctcagcctcctgagtagctgggactacaggtgtgcaccaccacgcctggctgattatgtattttcagtagaaacagggtttcaccatgttgtccaggctggcctcgaactcctgacctcaagtgatctgcccgcttcggcctcccaaagtgctgggattacagttgtgagccacccacgcccggcctatagaatgcatttttttttttttttaagacggagtctcactcttttgcccaggctggagtgcactggcgcgatctctgctcactgcaagctccgcctcccaggttcatgccattctcctgcctcagcctcccgagtagctgggactacaggtgcccgcaccatgcctggctaattttttgtattttttttggtagagacggggtttcactgtgttagccaggatggtctctatctcctgacctcgtgatccacccatctcggcctcccaaagtgctgggattacaggcgtgagccactgcgcccggcctacaacgcatttttaagaacactttttttggaacaaaggattcttttttttactgttgacataagaactgctagggttgtttataggatagatacatatttttgaatcttttctcttgggtgtgggtgacttgattttaagatgttgtagttgaaagtagggggaagttgataacatcagctgctcaagtgaaatttatttgaaatgggactgatatattgtgtcagagagaagtggttgtggcttttaggttttaaccacctttgtcctcttgttattgtttaatttttaattttaacatgttcagtcttattaatctaaaaccatagtgggaatcatagcatattttactgagaagagaggttagccttatccatgtttcctgatttcttgataatgaccaaccaaaagattagactgttttgatcagggtattctttgaaattgggtataggttgaatttggaaaggttcattttgtgtcacccgtcagtactgattagcgagaactgacatttttcattaggcttctagtgcttctgttttacttcagaaaaaatcaggtacaaacatacctgcaagtctgattttattatacttcctctgatccccccaaaagtgaaccatagttgtttttttttttttttttttttttgagatggagtctcgctctgtcgcccaggctggagtgcagtggcacaatctcggctcactgcaacctccccctcccaggtttaagcaattctcctgccttaccttcccgagtagctgggattacaggcacccacctccatacctggctaatttttgtatttttagcagagagagggtttcaccatgttggccgggctggtcttgaactcctgacctcatgtgatccacctgcctcagcctcccaaagtgctgggattacgggtgtgagccaccatgcccagcccttttttttttttctttttctttttttttttttttttgagacaaggtctggctctgtcatccaggctggagtgtggtgatatgatgatattggctcactgcaaccacggtctccctggttcaagcgatcctcccacctcagtctcctgagtagctgggactacaggtttgcaacactacacccggctacttttgtattttttgtagagacggggttttgccatgttggccaggctctactttgagcccaggctcacagtgatccacctgccttggactcccagagtgctgggattgcaagtgtgagctactgcatctgaccagttctttactatagtcgaaacaaagacaggctgggtgcagtggctcatgcctgtaatcccagcactttgggaggccgaggtgggtggatcacctgaggtaaggagtttgagaccagcctgaccaacatggtgaaaccctgtctctactaaaaatgcagaaattagccaggcgtggtggcgcatgcttgtaatcccagctacttggaaggctgaggcaggagagtcacttgaacctgggacagggagtttgcagtgagctgagatcttgccattgcactccagcctaggcaatgggtgaaactccatctcaaaaaataaagtaaaaaattagctgggcgtgggggcacatgcctgtgtttccagctgcttgggagcctgaggtggaaggattgcttgagcgtgggtggcagaagttgcagtgaacagagatcatgccactgcacttcagcctgggcaacagagtgggaccctgtctcaaaaaaaaaaaaaaaaaaaaaaaaaaaaaaaaaaagaaaagaaaaggaaggttttcagctgtaaggctgaaagaaggctcacccctgcaatctcaacactttgggaggtcaaggcaggtggatcacctgaggtcaggagttcaagaccagcctggccaacatggtgaaaccccgtctctactaataatacaaaaaaattagcctggcatggtggtgcacacctgtaatcccagctcctcgggaggctgaggcaggagaatcgcttgaacccgggaggtggaggttgcagtgagcagagatcacaccattgcactccagcctgagtgacaagagcgaaactctgtctccaaaaaaagaaaaaagaaagattttctctttctttgggatgaagatatgcacagaatttggtgattgaattagaaatcttatatcctggaaagatgaagtaatggaggaaaagtacagagtgcctctggtttgggacacagtgattacatttgataggacacctgttgagtttgaggtagaagcagaatatctgggtgtatactgtaggcagctctacctgtagcaggaaatcaaggtaggaggtatttgatttgggtggcatctgtgtagtggggcaaaaacaaaccctgtaatctctgtactatttggctaaatgttattcaaaaatcataaacattggttttttaaaatctgtaataaagatctataagatcttttgttgtgtttcctaatgatagactgatgggtggaagctgaaaggagagtcaaggtgcctggcaggttctttgctaggtgagcaaatcaaactctaggtcagtccttggcagagctctaagatctgattattgctgtgcaagttaagaagcgtttattgaaggcttactcaggcctctgtcttacactgagccctatcataaggaatcacatctgacttactgagcagttttatccaggtcagttagcaaacttgagttaataatagtaaatggcaaaacctgtttcccactcaggtggcctaaaccagtgaccttggaattggcattcatcattacaacacaattctttgggctggacgcatgaaataatgaacaacgttggggaactcagggtagttggtatattgcagttgtggaccacccacaggttacttttctgtagtcattatagtgtattgtactggttttagtgttgttctcaccttctggactgaactattctagatcagagacttgtgtttttcatgccccttttccaggaggtattatgaaactttcgtgttgattgaatgagggaagacgagaggttcttcagttttgcgctcaggtaaaggagtgggtcttacagctcagtcatcctgctgggaaacacatggcaacaggtagaggccacttgataggcagctgtgctaagggtagcataattgaagagcaaaggggcacatctctaggtggagaatctctgcccttattagccactgttacggataggaggtgtaagagggtgcctgatctgtcatgtgggtcagagtgaaaaagaggttgagaaccactgatgataacggaaatatttatatgttctaggcattgggctattgtatttcctatatataatccttacagcaatcctatgaaggagataaatacccttttttgaaaagtgagaaactgaggctttgttaccaggtaatacctggtttttgaaatcagtctttgattccagtgtccacgttctagatctgtttctgcttccctaggcaagataaaccagacaaaactgtgcaaccaagtggcacattacagggccaaagaattgttttgccataattttgcttgaaatttagagactgtaaacttaataatgagatgaatacaaatgttgaccattctcctataattgcaggagtacttgcccccaactcccaaaagcagtaatggtaaagtccatttttcttcagttctgttttttattacatatgtgttctaagtggtaatgtggatggaaaattatctctgtagagacagaatgactcaatataaagtgatcctattgccagctcattctaccctaccactgggcctttttttttttttttttttttttagtggccctttggcataatggaacaaagtttgagatcgaattggcaggatgctttcactagtgaactagcgaagtaaagaatatcacaggctgtgatgccagtagcattggagggaggggaactctttgtcatgccaggtactttatttctctcgtaattactcccatttaagagcaattgcttttacacttttttctttttatttattgagacagggtttcactcctgttgccgaggctggagtgcaatgggcaccatctaggctcactgcaacctctgcctcctcggctcaagcgattcttctgccttagcctccctatcctgggaccacaggcacacgtcacaacacctagctcatctttgtattttttgtagaggtggagttttgccatgctcaggctggtctcaaactcctttttttttttttttttttttttttttgaaataaagtcttgctctgtagtccaggctggagtgcagtgacgcgatctcagctcactgcaacctccgcctcctgggttcaagtgattctcctgcctcagtctccccagtagctgggactacaagtgtgcaccaccacgcccggctaattttgtatttttagtagaaacaaggtttcaccatgttggccaggctagtctcgaactcctaacctcaggtgatccacctgcctcggcctcccaaagtgctgggattataggcatgagccaccgttcctgggccacttgtatacttacattaaaaagtttttcattttttggctggacgcagtggctcacacctgtaatcgcagcactttgggaggctgaggagggtggatagtttgagcccccaggagttcgagagcagcctggacaacatggtgagatcatgtctctacaaaatatacagaaattagccaggcatggtggcgctgtgcctgtggtcccagctacttggagggctgaggtaggaggatcacttgagcccaggagacgtaggttgcagtgagccgagattgtgccactgcactccattttgggtgacagagttgagaccctgtctcaaaaaaaaaaaaaggcctcccaaagtgctgggattacaggcgtgagccactgcgcccggcagagagccctcatttttgggccaaactgaggtcttcggagggaagtgagggaaagaagtctcatgaaaaaaattttttttttttttttgcctgtaaaattatacccatagtatacaattaagataatgtggactgggcgtggtggctcacgcctgtactcccagcactttgggaggctgaggcaggtggatcacgaggtcaggcgtttgagaccagccaacatggtgaaaccctgtctctactaaaaatacaaaaattagccaggtgtggtggcacgtgcctgtaatcccagctactcaggagaggcaggaaaatcgcttgaatcgggggcagaggttgcagtgagccgagatcccgccactgcattccagcctgggtgacagagggagactctgtctcaaaaaaaaaaaaagatgatggatattgggccaggcgtggtggcttatgcctgtaatcccagcacttttggaggccgaggtgggcggatcagttgaggccaggagttcgagactaacctgggcaacatgatgaaaccccgtgtctactaaaaatacaaaaatcagccgggcgtcgtggcgcgttactgtaattccagctgctcgagaggctgaggcatgagaattgctctaacccgggaagcagggcagaggttgcagtgagctgagatcgcacaactgcactccagcctgggcgacagagcaaggctctgtctcaaaaaaaaaaaaaaaagataatggatatggagcaaaatactagaaaataaagctgggtacattggctcctgcctctaatcccagatactcaggaggctgggtcaggagggttgcttgaggccaggagtttgagaccagcctgggcaatatagtgagacactgtatctacaataaaaaggaaaaaaattagctgggcatggtggcatatgcctgtagtcctactcaagggaggatcacttgagcccagggagttcaggcactccagcctgtgtgacagtgagatcctgtctctttgaaaagaaaaaaaaaatgaaaaaaaggaaatttaaaaaacaaatactaggaaacactagacacatcttcccacccaaatgagttatgtatttgaaaatgttactcattttgggctgggcacggtggctcatgtctgtaatcccagcactttgggaggccgaggcaggcggatcacgagatcaggagatcgagaccatcctggctaacacggtgaaaccctgtctctactaaaaatatgaaaaattagccgggtgtggtggtgggcgcctgtagtcccagctactcgggagtctgaggcaggagaatggcatgaacccgggaggtggagcttgcagtgagccaagatcgcaccactgccctccagcctgggcgacagagcaagactccgtctccaaagaaaaaaaaaagttacttattttgacagtaatttttatacctttagatttttttctttcctgaataacattgaaaatttcattactaaaagcctaaggtcaagtctttgacttgagagtgttttattcttgtattgtgaaatctgttttctctgtaaactgctgtgggatagataaactggttgatgaaatagggcaaaaaaattaaagtcgattggttgaactgtagcctctgtactggattatgagggacagaggtagaagctttgccctgggggaagggaaatttggaggacagttccacagagcttacccactttgcttgcactcttttagcactaggatatatcagtatccatcatagattgacagcctataggagataattccagagaaccaggcaaaaaaaaaaaatcagtgggtgaggccaggtgcagtggctcatacctataatcccagcactttgggaggccaaggcaggcggatcacctgaggtcaggagttggagaccagcctgaccaacatggagaaaccccatctctacaaaaaatacaaaattagtggggcgtggtggcgcacgcctgtaatcccagctacttgggtggctgaggcaggagaattgcttgaacctgggaggcagagtttgcggtgagccgagattgtgccattgcactccactctgggcaacaagagcgaaatgccgtctcaaaaaaaaaaaaaaaaaattcagtggatgaatatattttgactccacttgtaccttctttttctttcacttggtgtggccatcttaacaatgatattctgatacccacccctgacatgtcaaccagtcttactcttcagtgctgttagtctttttttttttgaagggttttaaaaattttatttttattatgtattaaaaaagagctatcatggtttctttcattggggtggatgccttggataatccattcaaggaagatcacttcgtccaacttaatgcagcccaatttaatgaaacccattttcttcgcttactgacagaaacactggtggggcatattgaggccgtaatttggatcagatcttgctggtctgagcatacgcaacaagagagagaaccctggctgaatttttgcgagtggctccagtagagctgctggtgacccatcttgctctcaggagtgcagtgagacaaaaggaaagagctccagttaatttttataccttgtaattaacagggactactatgttaaactgggagggagcccaagtatttcccaaactggggagtcttgacattccctagaaatgtctttctgttgtacctgctgatggactctcttagacaatgaatcttgtctacctgggtagattgccttagcatttgtgctagtagcatttggttaacatgttaaagctgaataatccatctttcatattttgtttctcttacacatgtactcttagagccttttcattatgctcagaattcacaaggcttaacattatgtgcttggtcaaaggaatcatcagcaggccttcttcaactataactttttcttttttttgagacagagtctcactttgtcacccactggcactatctaggctcactgaaacctctgcctcctttgtacaagcaatctggtgcctcagcctcctgagtagctgggattacaggggtgtaccaccatgcctggctaatttttgtatttttagtagagacagggtttcacaatgttgtccaggctggttttaaactcctggtctcaagcagtcctcgcaccttggcctcccaaagtactgagattaaaagtgtgagccacgtacctggcctgactataattttaacctagcctgattataactttaagaattaccttgttccagtgtaaacaaaagaagttcggctggttgcaattggctcacgcctgtaatcccagcactttgggaggctgaggtgggcggatcacctgaggtcaggagtttgagaccagcctggccaacatggtgaaaccccgtctctactaaaaaatacaaaaattagccaggtgtgttggcgggtgcctgtggtcccagctacttgggaggctgaggcaggagaatcacttgaacctgggaggcggagattgcagtgagctgagattgcaccactgcactccagcttgggcgacagagcaagactctgtctcaaaaaaaaaaaaaaaaaaaaaaaaggaagttcagtcagatgctcttctctaatgctgaatggtacttgattatatatgcctctgaaatggcaacttgtagagatatttatgatgtatctttaccttgtttaattttagaaggttttttaaatttaattttatttttttgagatggagtttcatcctttcacctaggctggagagaagtggcaggatctcagatcactgcaacctcttcctcctgggttcaagcagttctcctgcttcagcctcccaagcagttgggattatacgtgtccactaccatgcctggctaatttttttttttttttgagacggaatcttgctctgttgcccaggctggagtgcaatggcgcgatcttggctcactgcaacctctgcctcctgggttcaagcacttcttgtgccttaacttcctgagtagctgggattaccggcacatgctaccatgcccggctactttttctgtttttagtagagacagggtttcaccatgttggccaggctggtctcgaactcctgacctcaagtgatccacctgcctcagcctcccagagtgctgggattataggcatgagccaccgcccccagccaatttttgtagttttttgttttttattttttcagacagagtttcgctgtcacccagactggagtgcagtggcacaatctcggctcactgcaacctcctcctcccaggttcaggtgattctcctgcctcagcctcctgagtagctgggattataggcatgtgccatcatgccagctcatttttgtatttttagtagagacggggttttgccatattggccaggctggtcttgagctcctgacctcaggtgatctacccgcctcagcctcccaaagtactaggattacaggcgtgagccactgcgcccggcctcaaaaggtttttgatgtgaaattagtaaaattgtatgataggtggtagtgagatgtgactatgggaataaaaggtcatgataggaaaataaattggagtaaagttagaaatatgcaccagaataatgggttatagaatttaccctgatgggccgggcatggtggctcaagcctgtaatcgcagcactttgggaggccgaggcaggcggatcatgaggtcaggagattgagactgtcctggctaacacagtgaaaccccgtctctactaaaaatacaaaaaattagctgggcatggtggcacgcgcctgtagtcccagctacttgggaggctgaggcaggagaattgcttgaacttgggaggcggaggttgcagtgagccgagatcgcaccattgcactccagcctgggcgacagagcgagactccatctcaaaaaaaaaataaaaaaaataaaaataaaaagaaaaaagaaaaaagaatttaccttgatggtcctggtggctaaagaaaagaggaaagcataatgattcctgagattcttacttagaggaaaaaacagcagttagggagagttgtgtttggaatttcagttatagatgtggttgaagtgctttgtaaactgtaaagtaataagattttttttatttcttttttttattttttattttattttattttattgtttttgagacagtctcgttctgttgcccaggctggagtgcagtggcgcgatatcagctcactgcaagctctgcctcctgggttcatgtcattctcctgcctcagcctcccgagtagctgggactataggcgcccgccaccaagcccagctaatttttgtatttttagtagagatggggtttcactgtatcagccaggagggtctcgatctcctgacctcatgatccacccgcctcggcctcccaaagtgctggtattacaggcgtgagccactgtgtccggccttttaaaaagttttttagcggagtctcactcttgttgcccaggctgtatagtgcagtggtgcgatctcggctcactgcaatctccacctcctgggttcaagccattccaatgcctcagcctccccagtagctgggattacaggcatgtgccaacatgcccagctaatttttgtacttttagtagagatggggtttcaccgtgttggccaggatgtctcgaacacgtgacctcaggtgatccacccacctccacctcccagagtgctgggattacaggaatgagccaccatgcccagccagtgggatgttattacttgtttttcatgacacctttctgtattttcagaagacacacatgtcttttgtgcatgtgtccattttctctcaggcaacagcatttgctgaatactctgcaggctaagcctgagtacaaaattaggtttctgggtgtgtggaaagaatactttaacaattagaatctatctagttattcactcttgtgaaaggacttaaacattcatacaggatgaaagaactgacaacatagtgccaggagagaagtcagtgctgaagtgctgaggatagggtaaatcatcttttttttttcttttccttttgagagatttctgatctcctctttgttttttacattcagtttctttgacttctggatattgtaaagagccataatagcactgtggcttcagctcagtgtgtagttgttggctgccctggcattttgctccttgctgtgaatgtactctttttttgagattgggtctctatctgtcgcctaggctggagtgcaatggtgcaatctcggcttaccacagcttccacctcccgggttcaagtgagtcctgccacagcctcctgagtagctgggactaggggtgtgcaccaccatgcctggctaatttttgtatttttagtagagatgaggtttcactatgttggccaggctgatttttgaactcctgaccttatgatccacccgccttggccttccaaagtgctgagattacaggcgtgagccactgtgcatagcctgctgtgaatataatcttacacctccatgtaagaagtggtggggtcagtgattggcaataggttgggtaagtttaatacttgggaatttggttaaagaacttggccctgaatggtgtaaatgtgttggtacttgcagttgggccttgtgtggtggctcatgcctgtaatcccagcactttgggagacggaggtgggtggatcacgaggttaggagttcgagaccagactgaccaacatgctgtgtgtggtggcaggtgcctgtaatcccagctacttaggaggctgaggcaggagaatcgcttgaaccccggaggcggaagttacagtcagccaagatcgcgccactgcactccagcctgagtgacagagcaaggctctgtctcaaaaaaaaaaaaaaccaaaaaaacaaaaaaaaaaaacccaaaaaccccgctgcagttattagacttctccagaggaatgcgcttcatgttttttgtgtaatatttttttgaaaactgttgatttttttaattttgttttgagagagagtttcactcttgttgcccaggttggagtgcagtggcacgatttcggctcaccgcaacctccacctcccgggttcaagcaattctcctgccttagcctcccgagtagctgtgattacaggcgtgcgccaccacacccagctaattttgtatttttagtagagatgggatttctccttcttggtgaggctggtttcgacctcccgacctcaggtgatctgcccaccttggcctcccaaagtgctgggattacaggcgtgagctaccgcccccagcccttttttttttctaaattattttgagacagagtcttacgctgttgcccaggctggagtgtagtggcacgatctcggctcactgcaatctccacctcctgggttcaagcgattctcctgcctcaggctcccgagtagccgggattacaagcatgcaccaccacgtccagctaatttttgtatttttagtagagactgggtttcgccatgttgaccaggctggtcttgaactcctggcctcaagtgatccacccgcttcagcctcccaaagtgccaggattacagatgtgagccagtgggctcagcctgaactattgatttttgttgatagcttattaatggttttactagatttagtagatgtggatttgtctgttgccattagtaagtgctcttttatggtccaagtacctttcttaatatttttatgagtctcatcaggaaaactgttctaggtttttggaaattgggggccctaaatatttttaaattcatttttattcattaattaatattatcatcttgtacagatggggtctcatgttgcccaggcttgtcttgaacttctggcctccagcagtcctcctgccttgacctcccaaagtgctggtattacaggtgtgagccatcatgcctggcctgttaaagattttttaaaatagcagctttggccagtgcagtggctcaagcctgtaattcccagcactttgggaggctgaggtgggtggatcgtctgaggccaggagttcgcgacctgcctggccaacatggtgaaaccctgtctctactgaaaatacagaaaaaaattagccgggtgtgggggtgggcgcttgtaatcacagctactcaagaggccgaggcaggagaatcgcctgaaccctgtcggggcggaggttacagtgaactgagatcgcaccactgcactccagcctaggtgatgacttcgtctcaaaaaaaaaaaaagcagctttacagatttgtagtttatccatttaaagtgtataattccagctgggcacggtgggtcactcctgtaatcccagcactttgggaggccgaggcgggtggatcacgaggtcaggagatcgagaccaacatatgaaaccacatctctactaaaaatacaaaaactagctgggcgtggtggcgcatgcctttaatcccaggtactcaggaggctgaggcaagagagttgtttgaatccgggaggcggaggttgcagtaagccgagatcgtgccattgcactccagcctgggtgacacagctatactctgtctcaaacaacaacaacaacaaaaaacaaaacaaaacaataaaaattagctgggctggagcctgaggcggagcttgcagtgagccgacatcatgcaattgcactccagcctgggggacaagagcaagactccatcttaaaaaaaatatatagttcagtagtttttagtttttagtgtattcattgttgtgcatatatcataatcattaattttagaatatttgcattaccccaaaaatcctttacccagcagccgtcactccccagtcttaggcaaccaccagtccacttctgtctctttatttgcctattctggacataagtgaagcatgttttgtgactgccttcttttacttagcataatgttttaagggttcatctatgttgtatgtagcatttatcagtacatcatttatttttattttttattttttagatggagtctcgctgtcgcccaggctggagtgcagtggcacgatctcagctcactgcaggctccgccccctggggttcccgccattctcttgcctcagcctcccgagtagctgggactacaggcgcccgccacctcgcctggctaattttttgtatttttagttgagacggggtttcacagtgttagccaggatggtctcgatctcctgacctcgtgatccacctgcctcggcctcccaaagtgctgggattacaggtgtgagccactgcgcccggccttctttttatttttgtataatatttcattgtatagatctgccacatttaatttatccatttatcagttgatgggcctttttttcttcttttttggctattatggataatgctgctatgaacatttgtgttcaagtttttttctgtagacatgctttcatttctcaggtttgagagtatataaatttgtaatgtataggtacaaaaataacaaatttcttcactaggggcaggtgctcattagaaatgggggatgggaggattagtttatctacaacttacactatggatttggaatttttccaagccacacattttactggggctaatgactactttcttttctctctgaaggaagtatttggaggctaacactgtaaataaacttgtttacaaacccgggaagaggagtgcttaaactgtagagaacaggtgttttcagtgagctccgtaaactctttagatgcaatgaatatgcagttgattgatctgctggtgacaatttttctttattaaagcaagttccctaagaattttaacaaggggacagttcattaacctagtcttggttattatatgtatttaaaatcaccaaattgggtgttaattattaagaaatgttctctgtaatcccagcaatttgggaggctgaggcaggtggatcacctgaggtcaggagttcaagaccagcctgaccaacatggtgaaacccccatctctacaaaaatacaaaaatacaaaaaaaaaaaaattagccggacatgatgggggggtgcctataatcccaggttctcaggtggctgaggcaggagaatcacttgaaccctggaggcggatgttgtggtgagctgagatcgcaccattgcactccaacctgagcaacaagagtgaaactgtctcaaaaaaaaaggaaatgttctttaatttgttagagtttattgagtcaaattgcttcccccacccagttgtcccaaattagggagataccacttttaagggtcagaagccttgtaaaatacaaaacaatgaaattaatatgtcgttcctttggagaaacttagtttcataaagagaggagggaattataaagataattgtttctggctaggcgtggtggctcatgcctgtaatcccagcacatgaggcaagtggatcacctgaggtcaggaattcgagaccagcctagccaacatggagaaaccctgtcactactgagaaaaaaaaagaaaaatcatctggtgcatgcctgtaatggcttgactcttggaggtggagtctgcagtgagccgacgtcgtgctactgcactccagcctgggcaacagagcgagaccctgtcttttaagaaaatggtctttaagttcagtgtagcccttaaaagtgatgtacatggattaaggactggaagaaagtactgcaaagtgtttatatttgtatgcatggagagattacaggtagtatgctttgctcttgtccattttgtattttctgaatttcaaacagttaaaaaagaaaaaaagacaaaccttataccatctgttaagagcttggtctgccattttgagtgaaagcagatggtttacacatttccagtggagtttagatgttagaaaagaccttggaaatcgaaattatttagcttttttcccctgatgaagtgctgtcctttgcattagttatctctcttttaatttttaaaaaagttagtagatatgttgaatataggttgctgaaataggttgggtgtattcaatgagatctagaggcaattttattttattttattttatttatttatttatttatttatttatttttgatacagagtctcgctctgttgcccaggttggagtgcagtggtgcaatctcggctcactgcaacctctgcctcctggattcaagcgattctcatgcctcagcctcctgagtagctgggattacagggatgcaccaccatgcttggctaatttttatagttttagtagagacagggttccaaccatgttgaccaggctggtctcgaactcctgaccttagatgatccacctgcctcggcctcccaaagtcctgggattacaggcgtgagccactgggcctggcctagagatgattttattttagtattatttcctttctgtatctagaattaataacgagtaatcatatgctttgtcctggaagtgttctaatatttttacatgatttgagccactcagtactgtatgcacatttttatctttctcatttttttttaaaaaaagtatgttagtccattttgtgttgctataaaggaatataggagactgggcaatttataacaaaaagaggtttatttgtctcagttttgcagactgtacaggaagtaagttacagcatctgctgctggtgaggcctcaggacacttttactcatggcagaaggcacagtgggagcacatgtgtcacatggtcaagagagggagctggagagagaagaggttccaggcacttttaaacagccagctcttgtgtgaattaatagagtgagaactcactcattaccatggggaggatatcaagtacttcctgagggatgggcccccatgacccagacactacacactaggttcacctccaaccttagaagtcacatttcagatgagatttggaggggacaaacatccaagctatatcaaagtataatatcctttccccacaccccccgccccccagaggatagcttttctttaaaaaaaaaatttactttttgactggccgtgatggctcatgcctgtaatcctagcactttgggaggccaaggtgggaggatcacttgagtctaggagttggagaacagctggggcaacataccaagacccccatatctgttaaaaaatatttaaaaagcctaggagtttagttttcataagtgctcagtgaatggcatgatgctattcaaaattgaatttaattatttccttcaattcctgtactgtattctgtttctgtggttgatatatccatttgtggcatgttaggagctatcctagatttctgcctcctgtttctgccgacaatagttccgagattatacctatgttgctttatttgataggctcatgtttcttgcctggagatgttcagtagtcttctcactggctttcctgcatctcccgttttcttctttgtagccattgtctgtgccactgccaaattgatgtttttgaagatacgatctgcttatttctcacccttttgctcacgcactcgtgtgtgtgtgcgttttctttcctgttgcttttgggataacttctaagctcctcctcatagcataggagacctttcatgttattttttttttaaagataaaataaatttttattttaaatttattattagttttagagatgagggtgttcactttgttgcccaggctggacttgaactcctggcctcaagcagtcccttcccccttgtgtagctggcactacaggcatatgccttcgcatgcccagctgtcttttgtgttttggtccagcttgcctctccagtccttactggcgctccatttcggctatactaaagtatttgtagttttgtgaatacccatcctatttttatagtttgtgcagtttctcagcatactagtgctatttttatttatgtagttttctctttggaatcccctaccttcttcatttacctggccttttcctcatctttcaagcttcaactaatgtatcttcatctctgataaatgtactcctttactcccacttttctccaaggttgggtgcctgcctttgatgccactattgtatgtcatacacatctcattgaagctttatcttcctgtattggagtttaatatttactttttcccttaacatccggtgctaggaagctgtttcaataaagagattcttggcggggcatggtggctcatgcctgtgatcccagcactttgggaagccaatgtgggaggatcgcatgagcctaggagttctagaagagctgtggcagcatagtgagacccttgtctctattttttaaaaaaaagagattcttgggcttaagtccagtcctgctgaattagaattctcaatgataagacacagttcatgtattttgtttttaatatttattattattatttttgagatggagtttcgctcttgtcgcccagggattacaggtgtgagccactgggcccagcatgagtttttttaaatttcttgtgagatagagtcttgctctgtctcccaggctggagcacagtggcagcatctcagctttctgtctcactgcagcctctgcctcctgggttcaagcgattatcctgccacagcctcccaggtagctgggattacaagtgcgccaccatgcctggctaatttttgtgtttttagtagagacggggttttaccatgtcagccaggctggtcttgaactcctgacctcaggtgattagcctgcctcaacctcccaaagtgttgggattacaggcgtgagccactgggtccagcctaacatctttttatatacacccatctatagcctacgttatagaatccttacacatacataacatttttctgtgtttaaaaagttttagcctgggtaggctgggtgcagtggctcatgcctgttatcccagcactttggaaggctgaggtgggtggatcacaaggtcaggagattgagaccatcctggctaacacagtgaaactctgtctatactaaaaatacaaaaaaattagccgggtgtggtatcaggcgcctgtagtcccagctactcgggaggctgaggcaggagaatggcacgaacccgggaggcagagggagcttgcagtgagctgagatcgtgccactgcactccagcctgggtgacagagccagactctgcctcaaaaaaaaaaaaaattttttttttgttagcgtgggtaacagggagacctcattgctataaaaaaattaaaaagtcagccaggcatggtgacatacacgtgtagtcccagctactcaggcagctgaggtgggaggactgcttgaacctggcaggttgggactgctgtgagctgtatttgtgccactgcattccagcctgggtgacagaatgaggcattgtctcaaaaagagaaaaggaaaaaaaaaaaaaaaatatatatatatatatatatatatataaaattttaaaacattttaaatggctatataaattctctaagtatatgctttaataattactgctgtatttagactgtttccatcttttcctattacagtaccaggttaaagatgtttgttaacaaatctgtgcccatatttctcatgatttgcttaggttaaattcctagaagtggaattaccagatcaaagggcatgaatattaatcaaacccatattacatattgtcagatgtccagaaaagtcaaataaagcaaggtaaagttgtgtgtatttgtatgcgtgttttaaagaaggataagaatcatcttaaagaacctagctctagcagtactatttcaccacttgtatgactaagggcagtttctcacattacaaatatttgtatgtaatgcctgtcatgtttttgatactgtgctagacgctcaagggattatttttagggagataagacaaatcaccatagcactgttaataaggtgcggtttggtacttggcgggtgttacttcagatgttaaggagagtgtagaaagtagtgtctaccatggtctttgaacagtagtctacatttctgcaatgcctagtccatcgcaaagggagagcaaatcaactagagaagtaatcgcaggttaaagtttttcccccttgtttaaataatttctaccccctcagttcatggagactaacactgtaggcatgcctggtagctgatagttctcctctgaacatatttctctctctcttttttttttttaacctttagctttaaagatcatctgcattttcttctgtaataaaaggtatccacccatttggccatgtttatttattctttagcagttgaagtattaaatgatgccagggtttttttttttttttgagatggagtctcactctatttccgaggctggagtgcagtggcgaaatctcggctcactgcaacttccgcctcctgagttcacgccattctcctgcctcagcctcccaagtagctgggactacaggcccctgccaccacgcctggctaatttttttgtattttttagtagagacggggtttcaccgtgttagccaggatggtctgctgacctcctgactgtgttagccagatgatctcctgacctcgtgatctgcccaccttggcctcccaaagtgctgggattacaggtgtgagccaccacgcccggccctaaatgatgccaatttttattttaaatcctgaataatcttatattccttctttctttttttgagactgaatcgtgctttgtcgcccgggctggagtgcagtggtgcaatcttggccgcttccttggttcaagcagttatcctgcctcagcctgctgagtagctgggaatacaggtgcccgccaccacgcccagctaattttttgtatttttagtagaggcagggtttcaccatgttggccaggctggtctcaaactcctgacctcaagtgatccgcccgccttggcctcccaagtgctgggaggcatgagccattgtacccagcctaaattcattatgttttagatctttaactttctcatggggaggtagatacccagacttaataaaccttttcactgtccacctgctagtcttggaaaataattttaatgaagcgtcaccgatacttggacagtttctgtcacgtcagcagagaaatatcaacaggagtgattgtaaagtggctagtcttatggtccaagtgttacgatctttgatccacttttcaatttatttcaagatctgatctatattattttctagctcttctggtttattgctgaatagttgatgcctggtttttccttgtaggatattgtggcttcataaagagtgagaaatctcacactgagtattgtcttttagtttcttctgaccttaaccccttgtttaagtcttgtgtacaatacactggttggtatctgttctcagcacaaaaaactatgtgaagccagtgttcagggaagaaaccacaaccatggtaatcagcagtatctttaccttctctcatatggttatctgactcatcaattactcttatcttcatctgaaatgggacagtcatactcttcttcattatagctatcagacaactgcccttgtgctgaaccacccacattaatgtattttaggcctggtcttgatgtaagttctttgcctcgtgtggtttttcctacccttcgtgtactctgagtgtggctccaaagacctaaacgtgtcctcatgtatagccaggaacttcatagcattcttcaaaacagaacactaagctgctccccagtggagagctcgaggcctcagagcactccgaatccctgcctcccctgctgtccaatcccatttttagccaagtgccttgactggggagcaggatgtttgcctgaacatattttttgtagagatgagagtctgctgtgctgcccaggctgatcttgaactcctggcctcgcctcaagtgatcctcctgccttggcctcgaaagtactggccatgtagaggtgtgagccaccctgtatggtctgctcttgcctttgatgacaacaggaacaagtggtaaaaggcataaagagctgaatttgggccgggcatggtggctcacacctgtaatcccagcactttgggaggccgaggcaggcggatcatgaggtcggagttcaagaccagcctggccaacatggtgaaaccccatctctactaaaaaatacaaaaaattagccaggtgcagtggcacgcactcgtagtcccagctactcgggaggctgaggtaggagaattgcttgaactcgggaggcaggggttgcagtgagccgagatagtgccactgcacttcagcctgggcaacagagtgagactaaaaaaaaaaaaacaaacttgagtttgaattctatttcggatctttatcagttacatgattttggacaagtaatttctgtaaaccttggtttcctcgtatataaaatggaataacgtctgtttcgcagtgccagtgcctggtgtttagtgttgttgttattgacagttaataaatgatatgaacattcattcataacatcatgcaataggttttgcagccatttataccaaaagaggttttttggtttttttctcctccagtaattaggaaagaatgatttatctatattttgtttaagggctgtaataacttcttgctattcttttctttttttttttatttgagatggagtttcactctcgttgcccaggcaggagtgcagtggcgctatctcggttcactgcaacctctgcctcccaggttcaagcaattctcctgcctcagcctcctgagtagctgggattacaggtgcacgccaccatgcccggctaattttgtatttttagtagagacggtgtttctccatgttggtcaggctggtctcgacctcctgacctcaggtgatccgcccgcctcggcctccgaaagtgctgggattataggtgtgagccactgcgccccaccaacttcttgctttgcttccaaaatgggaataatattatctgtgttttcagggtagttatgacttttttttttttcttttgagacagacttgttttgtcacccaggttggagtgcagtggtgcagtctcggctcactgcaacctccgcctctcgggctcaagtgattcttgtgcctcagcctcccaagtagctgggattacaggcatgtgccatcatgcctggctgattttcatatttttaatagagacaggatttttctcatgttgcccaggctggtcgcaggctcaagggacccacttacctcagcctcctgtgtagttatgactattaaaagagatgataaagtgtataaagtatttatgggatcaggaccagacacaaagtaagtcttagtaatagttgttattaatacagatatatcgtgtgcagaagatgctgtagaacagatttactaggtttttttccctttgttgattaaattcaaattagattaattcttatattctctttccttttctcattgctcaagtttctcctctttgcctgccattttctcactggtatttcctttccataatggttcctggcatcaacgattctgattatattgttctgatctcttttagtgaaatggaaccatcatgatctaggtttctgtatgcaaaaaatccttgagaacaaaagtaggtgtggagatgaagagcctatctttatgaggaaataatctagcaaaggcagttaaaagtatggaaatctactctagttaacaaaaattcaggggatttagtgaaagaacactaaggactctctgaacctcagagcaagaaatatatatgtgggcttcctgaatacttggaggctttctgtttttttaaagggcactgtagtcccttgtctctgcttctttcagcacatttcttttctctatgttgactgctaccttttgcttatacgtcaattagccaccacacctgggtaatttttgtatttttggtagagacgggatttcaccgtgttggccatgctggtcttgaactgctgacctcgagtgaaactgtccacctcagcctcccaaagttctgtgattgcaggtgtgagcctgtacatttgttttaatatggaaattttcagtgtgatttaatgaactccccaactcagtgatactctgttgtaactgagtttggtttctctaatcaggcaacagacaactagtcaaatcggctccagtaaagggacgttcattgtaaagacacactgagcagttcaggacaagaatgccagtaaagcaagtacaagaactgaaccagaatgctagcaaaacctgtgtcgtttttagtgattttattccagaatgcatggtttaacataatgtttgctttattctgctttttaagattcaatgttcaataatacctgcttgaaaaatggataaattgtaattattcaaataattgaatttctatttggatcattaacttcttacaattcagaattcctttgtgcccaagtctgtttgaatttattttccatggctgggtgcggtggctaatacctgtaatcccagcactttagaaggcgggaggattgcttgaggtcaggaattcaaaaccagcctagatgacatagtgaaaccttgtctctacaaaaaaattaaaaacaattagctgggtgtggtggtgtgtgtctctagtcctggctactcgagaggctgaggtgggagtttgaggctgtagtgagctgtgattgcgccactgcattccagcctaggtaacagagccagaccctgtctcaaaaaaataaaatgggctgggcgtggtggctaacacctgtaagcccagcactttaggaggccatgctggatggatcacttgggcttagggcttcgagacctgcctgggcaacatggtaaaacctcgtcttcttcaaaaaatatgaaaattagctggatactcgggaggctgaggcaggagaatggcgtgaacccgggaagcagagcttgcagtgagccgagattgcgccactgcagtccgcagtccggcctgggcgacagagcgagactccgtctcaaaaaaaaaaaaaaaaaaaaaaaaaaagaaaattagctggatgtggtggcacatacctatagtctcagctgctcaggaggctgagatgggaggatcacttgagcctggaaggtggaggttgcagtgaggtgagatcgcaccactgcactccagcctgggcaacagccagactccatctcaaaaaaaaaaaggaaaaatcagtaaggtcgtcttctaaacttcctttattttttggctcgataaccaatatggtctcctaattctcttcctagccctgtatttagatttccaccttttatttctgccagcctacactgtagtcaaggaaaataacgtttttttttttctttttttgtatttttttttagagacaggattcaagcgattctcctgcctcggcctcccgagtggctgagactacaggcatgcgccatcacgcccagctaatttttgtatttttagtagagacggagttttgccatgttggccaggctggtcttgaactcctgacctcaggtgatctgcccgccttagcctcccaaagtgctaggattacaggtgtgagtcaccacgcctggcccactttattttatttttgaaacagggtctccctctatggcccaggctggagtgtagtggtgttaccttggctcattgcagcctccatctccgaggctcaagcagtcctcctgctttagcctcatgagtagctgggactacaggcacatgccaaaagatttgtaaagtgatacttttaatttttcattttccaaaatgtggtaatgtagttccaggtttatctatttgattaaaaacctttttttttttttttaaaaaaaagatcacgccactgcactccagcctgggcaacagagcaggagtctcaaaaaacaaaacaaaacattaacctgagactcaaatagattgctagagaaaagggaagtgtagaaggaacttgaaaggcttattctaccttgatgggagcatttactctgattataattgacagctagcttttctcctttatcatggaaaatacttctcccttctaaaatatttcttacaaatatttcttacagtgccttcattttttgatttctcttgattcttgagcatctttttctgagtattagttttgtttcctaggaagaattttgtctggagagtctgccctgtggcagtgactgtacaaaatacagctcccagtatgaataaataagttcccaaatagttaaaaacttttgtgagagaatgacttggtttatctcatgtagtcaacgtgggtgactggtttaaaatgtagtttctgcactagcaaaactcttagaagttgagcctcctttctcaacaattgactgtaagaggtagggcaggagggtggtatacagggatagggaaagagtgtggttcttatataaatgaggcagcgggagataccctgaaagagggaggtggggagggtgagtagagagaaaaagagagggagagaagaaaccagagagagagagagagagagagggccaggggaggcagggagcgagagtgcgcatatccaaaagagtgtaaatagatggtgaaagagaatggtggcaggaagatagtgtagaaaggaatggaaaatgctacaagggcaggatgagcaagttttgaaggtaggggaagagatagtgaaaagcaaaggcaagaccaagagagcacattcatcgaagcccacagcagaaactgacagcagttttatgtagtaaaataatagaatattggaggtggaaacttcctttgactgccagggggcagcttggtggtacagaaagggccttgaactttaaatgggaagacttggattaagatcctggcagtgccatgtaagtgctctgagccttagtttcctcctatgcttttccctacctaacaatggttggagaaggcatttcttggaggatcagtttcctaatctctaaaatgggaataatcactgtgaggttgttgtgatggctacataaatatacacagtgcatactttttttcttactcctcctacttagtttccttgggacatataaatagaatttttaatatttctggttgaaactgtatttgtaggtttttggatttccaagaaatgtctagctctatttaaatgtataattagattccacagaaagagctagatacagagctttgtgcatttgatttacatgctttgtcaatgttaatgctggcctaaaggtttatcatttcatataacgtgtagagttcctagctaacatcctgtcttcatcctccctaccctcctttatttttattatatacagtttatgagtctatttattgtgctcatctaataatctaaacaccatgtaaaatgatcatagctcctatttcagggcctttttaaaacaccacagtattataagccttgtctgtctctttgtgctcatgtaactaactgaactttactcttactttgagttttataaatttcaatttttagtgagcattcccaatcttttgtatcttagtgatacggtgtgtctcatttgtagcatagtattggctgtgcgtttttaaaatatgtgactgaaaacaataatgcaactgtatctttttgcagtgttagttctgacagttaagattcttaggtgatataatgtataggcagctaggcagcatgttattaaatccttttttttttttccggacactgtctcactctcacccaggctagagtgtagtggcgtgatttctgctgactgcagcctcgactgcccgggtgcaggctatcttcccacctcagcctccggagtagctgggaccataggcgtgcatcaccgtgcccagctattttatttttatttttattttttaaatttttgtttgtagagacagggtactctactacattgcccaggctggtcttgaactcctgggctttagtgatcttgcctcaaataaaattcttaaactgattctcttaattgtattctggctcatgttctccatactcttttctccattgcttggccctaacttgaccctcaatacgtttatccagtggtagaaattgtaaacagacattggaaggtagtggagatcagaggagggagtttgagagactcctgcttcaggtagtcaacattgtttttcatgtaggcagaagagcaaagcctacatcttttttttgttttgtttttttttgagacagaatctcgctctgtcacccaggctggagtgcaatggcgcgatcttggctcaccgcaacctctgcctcccgggttcaagtgattctcccacctcaacctcctgagattataggcgcctgccaccacgcccggctaatttttgtatttttagtagataacagggtttcaccatgttggccaggctggtctcgaactcctgatctcaagtgatcctcctgcctcgccctcccaaagtgctggggttacaggcttgagccactgcgcccagccttttttttttttttttttttgaaaaaggatctccctctgttacctagattggagtccagtggtgcgatcacggctcactgcagcctctagctcctgggcttacgtgatcctcccacctcaccctgctgagtatctgggtgtgtgccaccacagcccaactaatttttatattttttgtagagaggggaattttgccatgttccccaggctgggagcctacgtctttaataaacaaaggaatgtactcttgaatcccttgcccaggggtaggtggtgactctagcctcagacagcagagacatgcttgctgctcataacaaagaagaccagtaaactagttgaattataactgttttgaataatctatttcacacatcatccttgatgttattaccttgtaggaatggctttggagatagataggtaaattgaagcctaaagagattgttatgctgtaggtaggattacatttaacaattagtaaggtttggagggattcttgtgacatgttattttctccccctggttaggtttggggagcccccagggatctcccaatatggagagatattgggatacttcattatagggtttgcatccccctttcctgaggtttaccaaagagaaatagtggattgaatcaaatgcactccctaatttaacttaactgttcacaactggggaggagccatgatcttttgactcattaggtcacatagtcatcttgaaggcatcattgctcttcagaatgttggtcttattaaattaaaaagtatgagaaatagctaacataattctcatgatggaatttgctttttcattcatttggattttgtgtttttcatgttttgaaaatataagggaatgggaggggagaaagtaggggtcattgctgaaccctgatggttaaaggtaagtgaatgtttaatctcttagtcacttgatcattgctattgtctttgccaatgtctgaaagtaaacatagaataaattttcaattgtgtgtaatgtgtatgtaaaattcaagatgctgacttgaagatttttccttctctattctaaacaataggtgcgttccatggatgaactgaatcatgattttcaagcacttgctctggagggaagagcgatgggagaggtaagtgaactggtgtgtcagaaaagtgggtctgtttttaagggaaggttggagttgtctttcatcaaatgtgtccaaatctagtctccagaaatatgtgcttgcttttccttgttgccattctcatgataggaacgggatgctggagaattttgccaaaactatgtcattaaaagaagaatgttaaccataacctaatgtcttaaaagcaaaacaaagtagccaaaatgtgagcacaaattattgaatattaatgtcagctataaattgagacattttaagtttaagaagtattttaattttatatgcattaaataaaaggccaacctttacttcattttccagtggctaggttttcccccaacccaccccccccgccaatggcaaagggagtcttagattggctgctaatcagaaaatgtcagtaacctatttttagagtagtgcctttttttgaggaagttgtttagagctccattgtgaaagggaagttgttaggtttctagtggaggaattacagaaggtagagagctgagccagtcatccattacaggaaattcagaaataagaattttgctttgactgtaatgtttaaaatttgcagaaacaaaatttacttttatccattacatcaatagagagggttgctgtaagtcttaaaaaggaaggggagtatagatatctaacatgtagccaactgctggctattgtagctgtgacaataagcatgtattgatgacaaaggtagaatatacagtttgaattaactacttaaaataccacaggcccacaagtgacatttgttgtggctctcttgttctggaaagtgacgttaggttttctcttccatttcattttttgtgtatctaatatttgatagctcctacatcgattttaatatttcacaagagggagaattactttattctagggtcctcatttataccatttattagatacatttgttctttgattcagcaaatgtttgatccccaggcactgtgctaggttctgaggtcaaaattaggataattactcttctgagtttgaagcaaatattccttgattgcctttgtggttaggcagtgaacagttaaaaattgttgatgtttaaactgagatccttgctttctttgttacaagattttgtttccaactttctgaatcttcttgtggccacagagtccagtgtcctatcatcttgagttcatgcatttttggtctgttttcctcctagagctttaggagatgattgggagatgtccttgtgtttcctgtgcctgcctaatgtcactgacacaatgcaaatcaataaaccctgtatggtttagaaagtctaaaagactttgtcactaagtttttggagcagatttgaacagaaagttaacatatttgttggatattaagtatagaaagagaaactatatgtattgtctttcttactcctataattctaagctggtgtattccaccaaaaatccaattccaggtgtttttctttcttttttgaattttttataaaaatagagacagagtctcactatgttgtccagactaatcttgggctcaagtgatccttctgccttggcctcccaaagtgttgagattacaggcatgagccactgtgtccagcctgtttttatttttaaaaaattaatgatacaagataagaataatgccctattattgttttgtgagcaacagtttataatcactgaatgcttaattttaattgaatagcaaacaatttcagtagagggtaaagtttatttaaatgacaagttgacagtgttaaattctttttttatcatttttttcttcttccagaaacgcctttttttttttttttttgtggtatatgtatataattccgtgggcatgaatataggcatatgttaataacaaaacagtatattccatcagtaatgctgtgtcattcttcttcctttccccactattcacaagtaacagtaacaactaccatttatcaatcataggtagatgctaaggggcttttatgcattatctgattaataactctatgaggacagttctattatccggataaggaaaaaggccaagagagatgaaataatttgccaaaggtaacacatctagtaagtgataggattcttccctggcttcctcccactgcaaggcatgtgcccttaattagggtaaatgaagttaatgtttgtaaaataattgagaggtaaaacatttcctaagtgtggagtgaggtttctgtattcaaggagttctttctttagctagttaaggaaacaatgaatatacatataaacagaaagagtaaatttttttctatgtatggttggagttcagagaaggcaggatcattattgacaggactagttagactttaatggaggaggagagatattccttaaaaagcatcttctagtttagttaggctttggataggtacagattaagagaattttttttgcagcaacgggagaacagcacaaaagaaaaaatgaaaataagcttttttttccttttcttttttttttttttaagagactgagtctcactctgtcacccaggctagagtgaagtggcacaatctcggctcactgtaacctccgcctcctgggttcaagcagttctcctgccttagcctcctgagtagcttggactacaggtgcatgccgccgtgcccggctaattttatttttgtattttagtagaaacagggtttcactgtgttgcccaggctggtcttgaacttctgagctcaggcagtcgcctgccttggcctcccaaagtgctaggattacaggcttgagctaccgtgcccggtggaagataagcttttataataaaaaagaacagcttctaattaacttcattaaattttcttcctttttagcaataaaacatctctgagagggagtgtgtataaatacagtatttactggccgggcgtggtggctcacgcctggaatgccagcactttgggaggccgaggtgggcagatcacctgaggtcaggagtttgagaccagcctggtcaacatagtgaaatcccatctctactaaaaatacaaaaattagctgggcgtgatggtgtgcgcctgtagtcccagctacttgggagactgaggcaggagaatcacttgaacccaggtggtggaggttgtactgagcccagatagtgccactgtactccagcctgggcaacagagtgagtgagactccgtctcaaaaaaaaaaaaaaaaaaaaaaaagacaaaaaacaaaccagtatttacccatataaacactagaagtaaattgcatgacttttaagctaggcaccatatcttcgtttgagttatttggtttctttgtggatgtgtgggcacctatgcgcgtgtgcatctgtgtgagtcattagggtaaatgctagttatgtaaagaatgtatggagtctttagaattcaaatagaattggttccattcaaagtaattgatttctagtagttgaaaattagtgctggttgactcttgttacgtttttttcttcaaagccactgttggcctcttggtgtcactttgaaaggtttagagtatttcttagaagaaatcttgctaagaggtgactacttaaaaatatcactctccaagctgttcttagctgaaggactcatagtacaagtgctttatgtgcttcctattctacaaagctaatataaaaaagaagataggaaaagatcttaggatcaaggccacaaattatttaaaaattttgtctactttccttgttagcccctttcatttggcttaaagccctgagaagtttaaaggcacatactttagcagcttttatttatatatgaagagatcagtctgctaatcgatgattctagaaaaggatgtttgtagtagagaggaaggctcactgaccttgggcttctgggctctatttctaaattggtttggtttatgatcttgcataacctgtttgctccacctttaggttggcagcattgttactgttcatgacctagaaaaggatggatttttaaaaaagaagctgtagttggaaagtactttgagaggttgacagaaaggtactttgttcgcataattggttttttaacttttaaaaatcaaggacctttttttcccttaagattctttaatgttttatgtgtagtgaacttgacaacttccagggaagttaaaatagtagtgaatactagcttatttctacaacaaatggattgtatttagatatgtgactcttcacctttgtcttagaaagctgaagcatagaaaaacatacccttgattataacaagtttgtaaacctgacaaaggaaatctagaaagtgctcctatatacagagtgataacaaatcctaccttattcacaggaattaggataacctgagatatatttaaattgtagctttatattctcattagacattatatagtacttgatccataggtgtgggatagcagagtggcttatagagggaggaattggatagtgatttgggtgagctgttaatccaaagaaaggcaaaatttggtgggatagaggtagcattggattgggccagaactctgacgccacaacttcttagagcctaggttcaaacattcatcttctttgcacttacttttttctacccgtaagacaaagatgttggactagatagtttcctaggaccttttcaggtctaagattctgggagcttgcccttctttctctctttaaaaagatagaaaagaggaattgttctggcctttttaggatatagtagagagtgtctaaaagatatccttttagattgactttcccccctgtgatttagagattttgtaacttttcattggggtttttttttttttttttttgagacagagtctcgctctgtcaccaggctgaagtgtggcgcgatcttggctcactgcaaattccgcctcccgggttcaagcgattctcctgcttcagcctcttgagtggctgggagtacagatgtgcaccaccacacacccagctaatttttgtatttttagtagacggggtttcaccatgttggccaggatggtctctatctcttgacttcgtgatccatccaccttggcttcccaaagtgctggaattacaggcatgagccaccgcgcctggcttcgttgggttctttaaagtgacttattcactgtctgcagctgcccaagacactgaagtgtccatcagagttcgtgggatggtaatactggagtcaaggcaagtattagcctgactccagtatggagactaaatctgttaaatttttttcccacatctttctattatggcaaacagtgtcttaatagaattggaggcttttgaatagctaaaagtacttctagaatccacagctctgggagggctaccttaaattaacactggcagttctttgcaattagggtgccataaaagcagcacagttgactccaaaatggactgagttttggaaagatgtctgccagcaaaatcatatagactttcttgctgaagggatgaaaaattaataatgccttgaggtatattaatataaaaatatgtgaccaagcagtgtaattaattcccctttttcctcaaaatgtagccttttttttttttgagatggagtttcactctgtcacccacgctggagtgcagtggtgcgatctcagctcactgcaacctcaacctcctgggttcaagcaattctcctgcctcagcctcccaagtagctgggactacaggtgtgtgccaccattcccagctaatttgttgtatttttttttaatagagacagggtttcactatgttggccaggctggtctcaaactcgtgacttccagtgatccacctgcctctgcctcccaaagcgctgggattgcaggcgtgacccactgcgcccagccaaaatgtagctttcacgtacaataggaatagtaaaaacaccctagttcccttaactttatgttttttgggtatttttttgacatcttgttcttgaaatgtttattttagaaaaaacagctaaccacgccaagtggtctggaggaacaagatcttggtagatggcttattttaggttaatgactgttagaggtaaagtgacctttttatcagtattgtttgaggaagttcctgggacccaaaataataattttgggattgggattgggcactttgaggaacgagataggagaaggtgttttctaacccaggaaatgtggtcataactgatttggaacgtagttcccaggtctgtcctgactttgagaccaatgtgcaaaccccacccattcttctgtctgtcttctaacctgcactgggaagaccaggaacatactactgtatgtagatgttaagctgtcttggaatgtttgaatgcagcaaatcatactcttgcagcagaagatccacatgctgcttactttgtcttcattaaatttcttccctttcatcaacctcctttggctaaaatgttactcttttatccatactagcatgctttattggagggaagactaataaatggtaacacttttcaatataatgatctatatgatatcattatcgatatgaatctcccagtaggtttttgagaggtattattcccatttttttttagatgagcagaatgagccctaagattaaatgactccagctaaattcttaagtgtcaagatggggattatcttcaaattctgttttttttttttttctaggctcggaagtaataatagctacaaaatattgagtgtatacaattttcccagaactatgctaatcacctcatgtatgttacagtttttagggtggtcctgcaatattatgatgccttttttttttagatggggtgaacaaggattagagaagttaatgtaatcattaagcctctgtttgaacccagatctcttataactcaaatcctgagtttttctggttggtttctgcatattcacagtctacttattcaagatttagcttcagatatcagctcccctattaaagcttttttgctccctcccattagaagctgtgaaggggaattcaagtagcaagtgatttgtagtattcttacaaagatgatacaaatgatgatctgtggcttatcaaagccccagatgatacccagatggtctgggctttatcttttgcatgctggactctaaagtactgtttcaacaatcatggcccagtttgttttatacataatgatttgtgtatatatggtgatgttttcttttttctcatacaaaagtttgttgagggtggggcttcagctaataatgtgctttgtaaacaatagctgctaaatatattgtattgaaagaatcatatcagtaaatattttttcctaagcatagtttcctctttatttttccttttacatcagaaattggtatccttgtctatcccccaagggagctcagttcaatttagtaaatattggttgtattttctgttcacatgacttttctgctctcagggatgttggagtgtacagggagagaataaagaacagacaaaactgaaagcatatattcaggctgtctgcaaatatgtacatttaaaagctattcattagctacttttgcaaaaatatagaagacaaacaataaatcagcagtgctgttacccaaattgaatccgatatataaaggcatttttaaataaaggatcttttgtttaatatagttgttacgttgttacagatcgatggtactttctctgggccatctgttggagcatggaaatatatcctcattatatatacagtaaccagacataatgatgtttagaaaaatagaattacttttgttccattgctttctcaagctggtattaaactatgttgtgtgtaattccttcttggttactgtaaccttgctaataaggaaccataacatcaaagcaaatccattgtattttgattaattggtgcatgatgtggttctcattgaggtgaagcatgtagcaaaagtttattttctgtgttgtattccctatatacatagcaggcatatctatgaaatatttgtttcctataatgaaggaaaaggggaactcagggttgagatccttgtctttttcagatcaaaaatttaaaattccctgaggctaactgggtgtgggtttattagagtatttggtcccatcttgatgtggagtattctttgttatctcagtcgggctgtttgcttcctgctttgggggtgtgagggggtcatgaagcaatctagatgttttcatcattgtatttgtgaactttacagtatcctgaggggtctggagcttatcttttgtatactgggctcacaagtactgtaatatgtaattattaaagtgaatacctattataaaatgaatgtggttatgctatagatcaaaccatgtagtcaaaataaattgttataccaaaaagacacttgcgcttgcatgtttattgcagcactattcacaatagcacagacgtggaatcaacttaggtgcccagcaacagtgaattggataaggaacatgtggtacacctacacccataaaaaaagaatgaaattatgtcctttgcagcaacatgggtgcagctggagtccattatcctaagtgaattaatcactggaacagaaatccaaataccacatgttctcacttgtaagtgggaactaaacattgggtacacatagacataaagaagggaacagtagaccctgaggactccaaaaagggaaagggaaggagggaggcaagggttgaaaaactacttattgggtaactatgttcactatttgggtgacaggttcagttgaagcccaaatctcagcatcacacaatatattatagccatgtaacaaacctgcacatttgctctctgaatctaaaaaaaaaaaaccttgtgtagtttattcatatgtaaaaacacgtgaccttatttataggtaacctgtagataacataacatcccttatatgctgttcctgtatcatgcagaaaagcccgattcactctgggaatttcatcattttatcaacatactttactgtcagtctgtcaggttttatgaagacagtagagaagagaagtttcttggctctgttccattaacaaaatgtgaaggtataaagaaacctttactttcagattcagaagggcacgtgtatgggagcctgttcaggttaattcatgacaaaataacatggagtgtaaggtgctaacagtatttctgaatgttctttaatggacttgctttatgaaagtatgaatgatatcttttgatgtgcttggtttctaggatgaagtcgttgacagacagggttgtattctttggtgtgtgcagaaaacaggaaacccctgtgcgttttgaagtttaatggtagtcatcaagtttgcaattctatctaatatctaatttgtggttgtcctaaaatttgtttatttatttatgtttttgaaacagagtcttgccctgttgcccaggctggagcgcagcggcactatgttggctcactgcaacctccatctcctgggtttaagtgattctcgtgcctcagcctcccaagtaactgggatcacaggtgcctgccaccacacctggctaattttgtacttctaatggaggcggggtttcaccatattggccaggttggtcttgaaaatctgggctcaagcgattcgctcgcctcagcctcccaaagagctaggattacaggcatgagccaccacacccgacctggttgtcctaaaatttaaaagctaccaaattcttatctcaacttgattgctctttttgctcttactgtcgcccagcagcctatagaggatcttcagggcagcctcaataccctttgaatgcataaaacttaaacttttgatactatatgcacacatttggatctgtttgtgtttttattttttatttttgaattttctttttcttcatgtaccccacaggagacttaatggattctgttttcatttagcttttgcactcagctgtctctgcagaatagattcctaattaaaagaactccaatgatagactggcttatgtatacttagtgaattcattcttgatcatcataatgggcaatgactcttctgaaatttatagcttttattttgttttactttatttaaaatttttgagatggagccttgctctgtcacccaggctggattacggtgccatgatcttggctcactgcaacctccgcctcctaggttcaagcaattctcctgtctcagcctcccaagtagcagggactacgggtgcatgccatgacacctggctaattttttgtatttttagtagagacggggtttcaccacattggttaggctgggtctcgaactcctgacctcaggtgatccatcggcctcccaaagtgctgggattagaggcgtgagccaccacgcctcgccagcctttaatttttttcatttttatttttttgagatggagtctctctctgtcatccaggcttgagtgcagtggcgagatctcggctcactgcaacctccacctcccaggctcagatgattctcctgcctcagcctcccaagtagctggaattacaggcatgtgccactacacccagctaatttttgtattttagcagagatgagagtttaccatgttggccaggctggtcttgaactcctgactttaggtgatccaccacctcggcctcccaaagtgctggtaattcaggcatgagccaccgcgcctggtaaaattatatagcttaaaaaaacaaaaacaaaaacacttgctttgaaaagagtctctcagcagcaattttgtccttgcccctacttccacagttccttttcttaccatttcacatctggattactacattggcctctttgcttagactcccaatattcatttgctttccttcaccccattttatggaggactgtcagatcaatcttttaaagataaattttataatgttactactgttgcctattggattagagccctaggggtgctttttgtagtctcactgacagctgacattagtgatttttcaccctcttcttattgctaccctgtgttgatggccagtttccaggtgggcacctgctccacttgctttcatttctgcctaccttggttcattgtagaaggtcctttgcactgtctcactcactctaaatcagggttgtccagtcttttggcttccctggaccacattggaagaatgtgatcttgggccacacataaaatacactatcactagtgatagctgatgaactaaaaaaaaaaaagaagaaaaaaatcgcaaaataaaatctcataatgttttaagcaagtgtatgaatttgtattgggccacattcaaagcagttctgggctgcgggttggacaagcttgctctaaattctgtccccttctttaagatacttcttgaccatcctatcccaggttcatttcttcattggtgtggttggttactcttcctttcttcatctgtagtaggttgtgaattttagcagtctatactccattattaggcagtgtgcttatcttaaaattacgtgtccgtttgactctggtttttctttttaatcttttaagttccttcagggcaaagaatgtcttttactgctttttttgttttttccaatagtggctaatgcaggctgtgcattttagggtgtgtgcaagtagtacttttgggcatcagcaagtacttcaaatactgaaatttattttttcaatagtcagaaaagcagtgttgatttcccagttgtgggagagaagatcagattacctcatcttgtcctatactctgcgatctccttgatttcatccttagtggaggaagtgttatttaaaggcattagatacaggtatcaacagtgcttataaaaggtgcttaataacctgggaaaacctttaaaaaatctgttaatttatatactgcataattataattatgcaacagattaaagtttgctttttttaaaagcagtatattagatttcagccaaaagaggcattttgttaagacaccaccatgtctatggtaatctgttttcagtagtaaccatttgaaacaacagggtaaaaattttaagcagtaattactgcatgccagattgtgatgatacctagtagagaaatatgaagaaaattattggagatgttgattcttagacagtttttttggtgatttgaattaaattaatgagaacacaaattttaacatttaacatctttacatgtaagtattgagtaactgattaaagtggatgcacttcactctgcttatatgtagattatttttaataccatgaatatatacatatatataaatgcaaaacgagaatttggaagatcttattccttcactgaaagagaaggtgaaaacttaaaaattctttgctttatatacttatttttaattaaaaaaactggcttgtgatggaacactcaacatttttaacattccttatttaagcaacaattttcaaaatgagttggaagtttattacaggttgggtatctcttacccagaatacttggggccagaaatgttttggaattttttgatgtttggaatatttgcataataattactagctgaacagcccaatctggaaacgtgaaatctgaaatgatccagtgagcatttcctttgactgtcacattggcaatcaaaaagttttggattttagagcatttcaaattttgcatttttttggattaaggatgctaagcctgtatcagcttgcttaaaaatatttgaaatttaggacatgagctctcttcttaaaattgctattaacttttgcccttttgaaattgtattgaagtggccaggcgcagtggcttatgcctgtaatcccagcacgttgggaggccgaggcgggtggatcacctgaggtcaggagttcaagaccagcctgaccaacatggagaaaccccatctctactaaaaatacaaaattagccaggtatggtggcgcatgcctgtaatcccagctactccggaggctgaggcaggagaaatgcttgaacccaggaggcggaggttgcggtgagctgagatcgcatcattgcactccagcctgggcaacaatagagaaactccatctcaaaaaaaaaaaaaagaaaaaaaaagaaaaataaataaattacattgaagtggctgggcgtgatggctcacgtctgtaatcccagcactttgggaggccgaggtgggcagatcacgagatcaggagatcaagaccatcctgagtaacatggtgaaaccccgtctctactaaaaatataaaaaattagtcaggcgtggtggcaggtgcctgtattcccagctactcgggaagctgaggcaggagaatggcgtgaacccaggaggtggagcttgcagtgagccgagatcatgccactgcactccagcctgggcaacagagcgagactccgtctcaaaaaaaaaaaagaaaaagaaaatgaaattatgttgaagtgaaatgtatctgcttgagagatatgccttatttatttgcagtgaatttcagaccaccataatctcagttttatttattagagaattagttgaaaatcataacaaaagtatattttgaattaagtaatccacaatcccagtgcactaacaaacactcttctgcttttatttttctttccagtcttgatccaaaagggaagaatgcatgaggagaagcagtctttacatgtacaattttgtattttacttttaaaatttaatgttattttataaatattacatgtagtcattatggctatttttggtgagcttacattgttgtactacaacttgtttgcttgcttatttatttatttaaagagacagggtctcactatgttgcacaggctagtcttgaattcctggcctcaagtgatccttctgcctaccaatatgctgggattataggtgtgggccactgcaccaggcccacagctaatttattgttgaatacttagtttgcagtttgctttcaacttttttttttttttctgagacacagtcttgctctgtcgcccaggctggagtgcagtggtgcgatcttggctcactgtaacctccgcctcctgggttcaagtgattctgctacctcagcctcccgagtagctgggattataggcgcctggccactacgcctggctgatttttgtatttttagtagagacaggttttcaccatgttgtccaggctggtcttgaactcctgaccgcaagcaatccgcccgcctcagcctcccaaagtgctgagattacaggcctactttcaacttttttaattcttttttttttaattttaatgtttaaaaatagagattgggtcttggcatgttgctcaggctggtcttgaactcctcaagtgaccctcccacctcagcctcctaaagtgctggggttacaagcatgagccactgcatccagcctcgacttttttttatttttacaagcactttgaatgtagattttttttttttttttttttttggagactggatcttgctctgttgcccaggctagagtgcagtggcacaatcatggctcactgcagccttgacctcctgggctcaggtgatcctcccacctaggtcagcctcctgaatagctaggaccacaggcatgtgctaccacacttggcttttttaagtttttgtagagatgggctgtcacatgttttccaggctggtctttaactcctagactcaagctatcctcctgcctcacctcccaaagtgctgggattgcaggaatcagccatcatacctggctgtgacttttgatacgtatgtagtttctgaggcccttccaaaagaattacgctaaccaggaatgaatgaacttggcttttcttaaagatatgttttaataagttaaagctttaaataaagctttagtataacttaatatcagtatagttcttagtatttataaaagcacttcatatactatctcacttgatttcacaacaacagtctgtggtatggagagactacataagttgtgaaaaatacaaaatttttacaagtaagactaccacctgtgattatcagtggttaccaatcaaacttcctcatttcagttagttctgaaaggtcctttctctgagttgatgtcatcttctcttaatgtactgagagtgtggtgagatatatactaagagattaataattgttttggttgttggtctgtcttaccagctagttaaatatcaagcatttgtttcctgcattggctgcattccagtgaaactaagcttgtgttgtaagttagagatgctagataataacatgatcaaactgatcacgtctgcagggttgtaacatccatgttagtagtatttcttaagatgctcaatttctgctctgagagatgctctgtgcagcctgtattgagtgtgtaagcagttacctaatattttattccttttgagtacagagtagttgctggagagcccttttactgttgagatcatcagtaaacctcattgataaatccctattcaaatattagtggcggtatggtcaaacaagtccaggcaataattgtcttgcctctgcagttcctgaaaagccgtaatcatggttcttgtagtgttgttttgttggggtagttaatgtaatgaggtttgtactgacatggcctaggtgatgccatgatcactgtgtctgatagtttgacataggagcatttcattgacaaatcattagtattgtgatgtctattggctgctactttgctcttttaaagaaggatagtagctgattttttgtttactgtttcagcattgtattatgtcattacatgtgttatctctttcattgtacacaataggtcattttataggtgagaaaaagcagaagaggataaaattcacacagctgggatttaaaactagtttaaaataaagtgatttcagagcattcatgggtctttatcactgttcttaaaataagaagcttagagtttcttgatattctccactttttattgtcttaatccatgttttaagggttcttggtgtaggggtttatgacatgattgattgttaagtgttaagtgtggttttgcgtattgttcttttttgttagatggaaaggaaaaaaggtgtttccagacaaatttaaaagaagtgtctcaagtggctgacattgcttgtaaaccagtgcttgacttctattttgttttccagaagcctcatagataagcttactgaattttttttttttttttttttttacttttcataagtttttttattttataaacttacgattcagggtgggataaacagtgtacgtgtgtgtgtttctcccagagatttgagagcacacactattggtggggcagttaggaattccacttaatgtttcattacaagaaagagtacaaggtctatttattttattgctggggatgataggactccccaagtcatggttctcagtttgtagatcttgaaatggactgttattactaattcagatgactgggttgcgatattgaccccacactaaccagaacaacaagaggctaatgtatgaaaaccaaaatgcagtctgctgattttttttttttaaggaaaaaaaacaactcttagatggacaaggatggttgtgtttggtgattggcatggttggctataggaggaagccagttctttaagaaggtggcttggtaagcagagttggagccagggagattacttgggtgtttttagtgtccagtgtaattaagctactatctaaccagatgcattaattgctttgataagaataggcttctttgtgcatcatatgccctgcccttaaatgtgtcacctggataatactggctacatctgattccttgggtctcttttgcttttgttggaccaattcctaattcctgttatcttcttttggaattgtcacatcatttaatcctcttactgctaagttattctttaaaacaaactctacatctctcttgtgatctgttacttttcgccttgtcaaaaaaactagtctttatttccagattcttgatggggtggataggaactatcttttcataggttggatgcatttacatttttggttattgtgtgttaagtgaagatttggcaactgctggtatttatgccagtgggttggcaaactaggatattttacccaacgctgtggatgatgttacctccagagagcttactgttgaatttgaaattgtacttggataacacattatcatttggttttataattcagtagtttctaactccttttaatatgatcagatttgaacagttaggtatcttttagctgactgttgaatataagtgattgctactaattctcagtaagctcaacatgtctaaattgatttgattttgccgagttaaaaaagccagtcttttactttttttcaattgaaaaggattttagtttcatcacttacatttaaatattagaaatggaacaagaagtgtttcttgaaaacagactcctaaagaagtgtttcaaatatacaaaaatacttccacatattcacaacagtgttattgctgcttaacaaatcaccctaaaatttagtggcttaaaacagcacagtgtgtgtgtgtgtgtgtgtgtgtgtgtgtgtgtgtgtgtattttaagagatagggtctcactctgttgcccaggcaggagtgcagtagtgtaatcgtagctcactgcagcttcaaacctctgggctcaaggagtcttcccacctcagcctcctgagtagctgggactgcaggggtgtgccaccactccggactgatttttaaaaagtcttttgtaaagctagagtctcgctatgttggttgctaagtctgatcttagactcctggcctcacccttagaaagcactgggattacaggtgtaagccaccacgccctgcctaaaacaagacagttgtttaagcctcatagttgctataggttaggaacctaggcatgactttcctgagtcatctgcttcagggtccttcacaagctgcagtcatgatttcaactttggctgcattcatctcaaagcttgcttggagaaaggtctgtctcaaacttgcttggagaaaggtctgtttccaaactcactcatgtggtatcaaccatcagaatccattctttgctggttgttggacggaggatctcagttcttaattgtgtgtaaatgacccagggcagaggcagagttcagtgggaagctgcggagcaacagctttgtatatgtagctgttgtccagagatgtctctctcttggcttcatgtggcgtctgtatagggcagctcacaacatagcagcagtcatcatcagagtaagcaatcaggacaatagatagaagaggacaagcaagatggaaatcacagcttttgtaacatcttgaaaggaacatcccatgacttgtcttatgttatttcttagaggcatgtcataggtctagcccacagtcaggggaaggggattactcagggtatgagtacttgtaagtgaagatcattaagagtcatttcagatgctgctaaccacagcagttgagtatagacgcatatgttttggaggaaagggagaaagactgagtaagattcagagacttttaagagctttgctaattttgcttctgtctttgcccaagcaccttggttcagtcttttgctttcttttttttttgccatagtggcaaaaaccacacttttgcaccaacctaatagcactttgcttcatgtttgctgtattgttgtttccttttgagagaatttaccctgaaaatagcctcgcttatgtgttcacctgcttctcctggctttgcacattatgacagcctggtatactatcatgaaaggtgacaggatcccagaactgatttttgaagccttgagctgaaaggctgctgctttctgtaagcaattttacaaattatggataagactatatttacatatggaggctggtacttttggaaactgttccttgaggtgtttttttttgtttctgtttttgttttttttttttttttttttgagacagagtcttgctctcttgcccaggctggagtacagtggcgtgatcttggctcattgcaacctctgcgtccctggttcaagcaattcttgtgcctcagcctcccgagtagctgggactatagatgtacaccaccatacgcagctaatttttgagttttttagtagagacggggatcttgccatgttggccattctagtctcgaactcctgacctcaggtgattcacctgcctcagcctcccaaggtgctgggattacaggcgtgagccaccatgctgggccctgttccttgagttttaaataaacatttacaagtttctgtgaggaatgaactcttaaaacatttaaaggacaagaatggttttgatcaccttagcgttctttgcactgttatgtggagcataaaacaagtgagaccctccttaggctgacattctttcttctggaatacaaaagagtagttgcttttgctttgcacaaaatacgggagaaaaaaaatcagaattttaattggagaaagggtataaccaatgaggaaagaaattttatttgtaatcttcggacaggattttttttttttttgaagatggagtctcgctctgttgcccaggctggagttcagtggcatgatcttagctcaccgcaccctcccactcctgggttcaagctagtctcctgccgcagcctcctgaggagctgggactacaggcacacaccaccacgcccggccaattttttttttttttttgtatttttagtaaagacagggtttcgctgtgttagccaggatggtcttgatctcctgaccttgtgatgctcctgccttggcctcccaaagtgctaggattataggtgtgagccaccgcgcccggccttgcaggggacaggacatttttgagactaaaaggagaaaaataagtttaaaaataattattgaattgtcctttgcatagtttacattaattttcagtatcccctctgtgacctggtttgaccgctgttttgcctaggtgtgatgtttttgaatacattattgagaacctgttgtgctaggcactcatcaacaatatttctaatcatcacagcaacttgaacgatattttcttcatcaataaaaagagaatgaggttcagggcagtttagtaagatttcctagggcacttcaaagttgtccagtttagtgcttcccgaccctaatgctaccctcgatcggggctctttcccattttaccctgatcctcaccctcccccaaatgcccttagggtaataagtggtacaccaggaagactgctacttataactgttcattttcaaggaaacttaggtatctgtgcaattaaataccagacaaatgttttttttttttctcaatcttgtttaattagtaaacaacaaattaggtccttaagagcaaaatgtatggcaaactgctttggtccaggcagtaacccaagtccatgagatagattatagagccacttaaaggtagatgaaaattatgccgagaaacccagaaattagatttgggaagcagagatttattttagtgagagcagagtttaattatttttccattatcattgggttatgggttaaatgggaaagttaaacctttatcgtcaaggagaggaaatgttttgtgctttctggttttttattgtgttcttctgagaaattcaactctccaggtatttttgtgctcaaaaatggtggttaaatactatctcaaacatcttagtttcctgtgtaatagcagttgaaaacataattagaggaaataagagggggcattttagtcagtaaagctgatgaccagaaccaagaatgatagagttctgtggaattttactttgtaagcctggtcactggtgctttgatcttatgcaaaactgtactgtgtcttgcttgaagggtactttgcatttttttgttgaagctagtataaacttctcatgttggcttatggccagcgatccctgtttctctgaagcatggagtgatttgtgaagtcactttaatggcattaccaagtattgttaaaaaattaatggaggttagaagattttatttcccttccagtaatgaaggaatagcttttctgtccttccaaaatcttggaataggttagtgttgtggttgggaagtattttggttaatggagtctctgtgtataaaggaagtgaattttgcctctggcattccatagctgaggttcatagctggttcatgctccagcttgagtaactttgtctggtagttagtacacgtatagagagaagtgttttaatagttgtaaatactttctttttcagtaagagtccacttagtagttagctaatagggtcactgttagttcccttccccactccttaaaaatcttggcatgggttaagcgagtaattctagatatttaagttcagcctctattggatggtttgatcagtgtccccacccctgccccccaccttgccttaggcctctctgtgacttttaccaaatatatagcagtgttctgaccacagttgtgtagttggaacactttaattaaagaccttcagggcacgtgagcatcttcagtacccttgtctaaaagaaagtgttgactgctgtactttcatcctttatgaattctttaaaagcatctattatttttaatttgcagcagctcttgccaggtaaaaagttttgggaaacagatgaatccagcaaagatggaccaaaaggaatattcctgggtgatcaatggcgagacagtgcctggggaacatcaggtaatctagatctagcatctgtactgtgatttatgcctgtcttagagctcctttcctcagcaattggcaagtcatgaattttacatcagtgacataagcatgtcaagcagtgtcctctcctgtagtataattgccattaaggagcttatatgatgtaatttattaaaacataattaacacaaaatcatatcttcaatattttttgaagtgctagccacaggggaatggtcttatttgaaacgaccataatttcagctgtaacgttttgttctgtactgctgtcagcatacttggaattagaaaatccacacctgccatttgaagttcatgtttctttttctccccttgcccttgtgtaccgtgtatggaatgatctatctttaaacgtgattgggaccaaatcaagtcactgggcatggacattcttctggcatactacccctgaagagggatggggagaacttatagaggcagacacactgacagcagaaaaagtgacagatgatagggaggaaggagacagaaaacccaaaagccaatgtcgtgtattacagtacaacgtaagcatggaacctcatgatgacagtgaattatcagaaaagaacaaattatattgtttttaaaaagggcagtaaaatcatattttgttttagtaatactaataaaatatattaaaaagaaatccttttacttataaaggggtaaaaattttatccactcagctagttaaaccagataagctagataaactgttgtattcctctgctatcctggataaatgaggagtgtgttccatttccttagcttatgttgaatatcatacagtgagggacatgataggaggttttggctcaactgaccatggcaagtttcctgattccattggttatccatgagacatcactcataatttgtttgagcctctggctgcactgtatcatgcttgtgtatcttttttgtagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttgtaagttggcttgaggaacttgttcctatctctctctctctctctctctctctctctctctttttttcccctaaagcaaaacatgcctgtttagtttccttagatgttcacagcattaattacagggtattttcaaacaacgtttgttgtaaatagaactcagcaaacatagtaggagatgtaaactcaacttttaaaaactaaagtaataatgttttggtggggggacacattgatagtattgtgagataagaactgaaatctggatcaaagttcattggtctatcagaaaacaccatttttactttaaaataaaagcaaaaggggggtggtgaaggaattaaaaaaataaagctgatgctgggatgttaacagggaattccagatttgagagcagtgatttgccaatacccgagaaaccttaatatagatcagattatagggctattcttgttttgttagctacgatttaattatagaatcctctttggccctccttgaacggctttgtttctcacacctggcctgtcaagaaattagggattctgttaattctttcttacaaatttttttgattcattatcactgacctctctgatgctaaactgaagtcaaataagtctctgtgtctatagcctttttctttttaagtcttaagcatttttctatgagcatctgtgatagcctttctcaaaacaatttctttctttatcattaactttctagatcgagaagtgttaagatgtatttccatttgagtcttcctcattttgaattctgcgactgttgtcatattccaggtcacagacaggaaggccatgagaggcacatgaatcttcttccctccctttctcctgtctaaacttgttttgtactttttcaaagacatttctccctgcagtcattttgggctgatatcacctgaaaacagtcatttaaaagattttaatgtaatttgtgggaaagaacagcagaagcaccttctttcccacaaattgagaattaatattataactgtctttctttaatagcatttgttgctcagtatttcttagtgttatacatcttttgctgggtatcagaggcttggtcctattttccctattccacattaaattttgttagagtaacagtagttcatttttggtgcagctttctcaagtgtcaagtacagttcttaagtactagctattctaaagctgacctgattgcttttcagtgttttgaccctgcagagacctaggtcaggtttagtagcttgtgaatcagataggagatggctcctgttatttgaaccttcccaaggggctgcttgggaagaacaagatctaccctttggatgtgagttacttctctttcttcaccctatccccagctcacctctttttctgtcctcactctttcctcatcttatgagcacagattcctcagcagaaattagtgttgtgcatcagtaggttgctagtgtggtgaactggaacctgtgactctagctgtgaattctctgtcatgtgtgtgatcagtttctaattcttgggcactaaccaggaggcatgtgcctgcattactgtgaagcttgtaggaggcagaaaaatagttggaattaggaggaagatacatggtgggattgaatcattttgccacttatttttctctctttaaacagtcatctcactagacggttattttgatgacaaaagctgtatcatttgtcttgggagactggtgatttacctcttttacaaaagaatcgtgacagaggaggttaagacttcaggctagatagatggggccagaagattggactttaaccatcaagataatttactgagctgctgaggtatgcataaagataaatgaaaattctgaagtatgcatgaagataaatgaaaattctccaaatctgtgttccagcttcttttagaaggaagattgtgggtaatggaatattatcccatagtttgacttagattgcatctatagagtgatacaagaggactgatctagtgacatcaagccacttgttggcatatacagtcttctggtggatggagacctgtggctcagtgaactgattattattgttattattattgaggtggagtttcactcttgtcgcccagactggagtgcaatggcatgatcttggctcatcgcaacctccacttccagggttcaaacgattctcctgccttagcctcctgagtagctgagattacagatgcctgccaccatgcccgggtaatttttgtatttttagtagagatccggtttccccatgttggccaggctggtctcaaactcctgacctcaggtgatcttcccacctcagcctcccaaagtgctgggattacaagcgtgagccaccgcgcccggccagtgaactgattatcagctttgtggttgtatcctcttgattttatacctaacctgactttgctctgcctgttggtcaggatgacacctgaccaaagctctttttgtggaagcctgaatcactttatttttgtcatagtatgcatacatcttcttgaggaaagtgagccttttcttttaaagtctagtctgtcatttaaagtgttgaattcagagaaccaggaagataggatttctgcttcttgtagataattgttctaaaggaggagtggtacttggtagtgtatggggtcagggcatccacgtatttttacttttggggtagctgtatcaacattaattccagtaagcctcactttaatcctgagagctgaaagcatcatctctgatggtatagtgattgtagacctcaaagcaagtaactaagaagttattcttaacacactgacaacagataattgagactttaacttttcaggtaaaggtgtttagaactaaaataaatctctatgtagtgttttaccattttcagtgaactttgctggttatggctagattgaagctgtttagctctttgtctagcttgaattcattttgattgtacaaatggtctcagtttagtggttttggcttctgtgataagaatacattctggctaacaagaagaatctggcaaccatattttgttctgagcattcactgtaaatttttggtagtattccacataggaatctcaaactttaggagagcagctttcagaataatagagctcaaaaatatcaatcaagtcttttatttttcttttcttttgtatcctttatttattcttggagtagaacaggtgctcaccccacagccccccatggttcagggtggttacaaaatcagatgtaattattttatttttgaggcccatgggtgagattgccatctaaggaccctgctctctggaataccagctgatctttttcaaataggtggaagcctagccagccaaaaaatggatcatgatttctaccttgctggtttatggtgcccagggaaatgagaagatcactctaaactttgattagggtaatgaccaccttaacctcacagaagaaagatttttagaaaaaatatattgggaaggtctttctgtttgttctgtagagagtatctgctttttgatctggaggatgtatacacattcgtagtatacatctatttgggccgtgaaacttgtttgtctaggtttcactgcatttactttaggtaaccagtgctacttaactttcataggttttgtttgaaaacttctgtacaatgtaatgcagatagaaatcaggggtttgagtttcaaatggaccttaattcatctgcaaaatgagaataatcaaaactcaacaaagtctaattcatacggctgtgtagcatatgtgaaaatgctttgtaaacattagaagtcttactaccaaagtcagtgggccgacagcattagcatcacctgggagcttatcagaaacgcagaatctcagatcatacctgagagcgaatgaatcaaaatctgcattttgacaagactacccagatgatttgtatgcacattaaagtttgataagcactgctatcatacgcgttatctcagaaaactcagctggacaaagagtctaatgattagagccttaaaagtttcctaggggaaaaaacatagtatgtctagcaatttttaagccttggtggggagggctggtgagggcattgtgaaaaaggcaatggggaaaaaatgtgaaaattggataaagtatttttttaaaaagacaactgtactttcatgaatttctttgtttagtccttggaacaacactttgaggtagatactgttgtctctattaatttatagatgagaaaactgagtcttagaggggaaatggggggctgaattcaaactttgtttgttctaatttcaatttttagctgtattgctttcaactgtgccatactggcattgtttgtgagtaggaatcctcacaaaaggatcagatttaatatgttaaattaaggagtatttcacatggccagcagtttcaaacttataatttttaatatttgaattttttttttttgagacaatctctttctgtctctttctgtcacctggaatgcagtggtgtgatctcagctcactgcaacttctgcttcctgggttcaagtgattcttgtgcccctgcctccccagtagctgggactacaggagtgcatgtgccaccacacccagctaatttatttatttattttatttttatttttttttgagacggagtcttgctctgtcgcccaggctagagcgcagtggcgcaatctcggctcactgcaagctccgcctcccgggttcatgccattctgcctcaacctgcagagtagctgggactacaggcgcccaccaccatgcccagctaatttttctgtatttttagtagagatggggtttcactgtgttagccaggatggtctcgctctcctgacctcgtgatccgcccgcctcagcctcccaaagtgctgggattacaggcgtgagccactgtgcccggcccacacccagctaatttatatttgaaattttaaattaccagtagagctcgacattgttgtacttcaaaggaatcagacatttcagttttatggcattttgtgaaaatgggtaagtgtgtgcaggagaaaccagtgttttagttaacattgttatagtttttggactcagtgtgtcaagcaggtataaaatactttgtagaaagaagggaggaaaatgactaatcccattaaatatgacttctgctgtgtgaagctttcttttaagatcacggcagtaagagtagtaaatagatttgaaatcttctgacttcattcagaattaataggtatattaggaagtattcccccctttatgtgagtcttttgaggaagttgagccataagtgcatggattctgacctcaacaatatatagttctacctacgtctgcttttctcccagttctttgatatttagcaatttctctgcctctctgtaggtctgggatctctcagcacccatcttggttccactcttgagattttgattgggcttggccacttgcaatttgagcattttactgaagtttgtatttgagcactatagctttgggttaacattcagctaaagaaagcccataattaaaagatgctgttaagcctttttcatttattcatttagctaatagacttttccagtactgtatgtacttgataatatataacaaaaaagcaaatcacaaaccatgcctttctgatgcttatgttgcatttaattaccttggttctcaattgtggatacttacccgagctatttgaggagaagcttttcacaacatttgcaggaacctctacagaccaatcagatcaatctctggtgcagagggtgggcccagccacctgtgaatttaaaaagattgcgatgcctaaccctaatcatagaaccactgctttgtgcaaatgacaatgcccctgggagggccatattggccgtatacttgtatttgagatttaaaccacttaattgggacatttaagatttttattcttgatgtcatgtatagtgttacaaagaaacaccatcccagtgcgtctctttattactattatattacatttgtgtaaaatggcttatctttataaaacttttaggcatgcattatttcattgttattcatgagtaaacaaagtctcagagattaaatgacctgtccaaagtcctgtgaccagtaagtgttagcagttgagatagaatgtaggttctgtgcaccctggttcagcacctttttttttttttttttttttttttttttttttttttgagacagagtcttgctctgtcacccaggctggagtgcagcagtgtgatcttggctcactgcaacctctgcctccagggttcaagcgattctcctgcctcagcctcccgagtagctgggattacaggtgtgcaccaccacgtctggctaatttttgtagttttagtagagatggggtttcaccttgttggccaggctggtcttgaactcctgacctcaggtgatccgcctgcctcggcctctcaaagtgctgggattacaggtgtgagccaccgcacctggcgggttcagtatttttttaaaagactgggctaggtgttatggctcacacttgtaatcacagagctttgggagaccaaggcaggaggatcacttgaagccaggtgtttgaatctagcctgtgaaacatagcaagaccccatctctacaaaaaatataaaaatcagccaggcatggtgtgtgcatctgtagtcatagctccttgggaggctaaggtggaaggatcacatgagccctagaggtcaaggctgcagtgagtcatcattgcagtactgcattctagtcagggtgaaagagcgagaccctgtctcaaaaacaaaaacaaaaacaaaaacaaaaacaccacacagctatgaatagtttatcttaaatatttttcagaagtgtaaaattttcataaaacttagcccatttatacctttcttctattgtctttagggtcttcatgtttttaagagaccattttaaggatcttgaacctgatactgctgtctattaatgaaataaactcagggtctcactttgtccccagactggagtgcattgccagtgcatattttgttctgagcattcactgtaaatttttggtagtattccccataggaatctcaaacttcaggagagcagctttcagaataacaggagagctcaaaatatcagtcaagtcttttatttttcttttcttttcgtatcctttattttatctattcttggagtagatcaagtgcccaccccacagctcactgcagctttgaacccctgagctcaagtggtcttcttgcctcagcctcctgagtagcaaggactacaggcgcatgccaccttgcccagctaatttttttaaaaactttttttttagagatggcgtctcctctgtgttgcccaggcttgtcttgaactctaggcctcaacctagatccttccgcttctgcctcaaagtgctaggattacaggcatgagccactgcgtgcagctgatactatctcttaataacagacttttgacagaatggtttcctatttgtgcttttgtttttactcagaagtcagacttctgctggccatttttatggagggccattgttgatttcttgagtttcttttttcttttaagtaaactttatattgaaatatgacctatgttcagagaagtgtacgagccataaatgttcgtcttgaatttctgcaaaatcaaaacacccatataacaccttcccagatcaagaattagaaacttcccttgggttccccactctctaaaagaaggagcccaccattttggttaggcatcaatagcttattcagagtagaaaacccggtattttgtaggaatggcctgtacgatattggtaaaatgcaacacattgcagggaaatatttgaaaatctggcccgtggcagtataactgagaatgtaaattagtggctgaaagtgtaacttagcagtcaagatttcaggccatgccgggcgtggtggtgcatgccggtaatctttgctactggggaggctgaggcaggagaatcacttgaacctgggaggtggaggtttcagtgacctgagatcgcaccactgcactccatcctgggcaacagagcaagattccgtcttaaaaaacaccaccaccaccacaaaagagatttcaggccagtcagcatgtagaagagctgagcaggttctcagtaaagcccttgtgaagagcccctgaggaaagataatgcagagcattgatatgactagtgcacatcccctgcaaccagctgtcttgcttgttgttgaaacttcctactgctgctttatcctcctttctttcctttaaaaaaaaaaaaaaaaaaaaagacgagtttcactcttgttgcctaggctggagtgcaatggtgtgatcttggctcactgcaacccctgcctcctgggttcaagcgattgtcctgcctcagcctcccgagtagctgggatttcaggtgctgcctaatttttgtatttttcttagagacagggtttcaccatgttagccaggctggtcttgaactcctgagctcaagtgatcctgccttgcccttccaaagtgctgggattataggtgtgagccactgcgcctggccctttctttccatttttgcctacagaccttttgaactccttttgagaaattggagctgaactgtttcttctgagccagtgatttgatttgtagactgcggaagatgatgacttaggcgtggcagtgggatgattcttgtaatattcttttgctgttgacattaatggtttctgattcaggcagagttgtcatctagaccatattaccacctccaggactcttatttaatgatgataaggacaacaggaagatcattcttattttaacagttcagttttgcatgatttttttgttccttttaattttcttcatcatatttattgagcttttatcaggcactgcagtcagtgctagggatataaaaatgagtacacagctttagtcagttttgcctctgcagtatggaggaagctattgcctttggatattttgaaagatctttttgcctttagaaccctatcatattcctatctctgctttgaggaatctcaatgtggtgcataattggttatcattcagtccttttaaatcaataacagccacatactttaaagattctattctgaagggcacatctcaatggccgtcaaagctgtggtttactgttttgatgccacatgaagctaagttgtatatcctttctcagttccttgtcatatttgttctttttttatattatctttttctgtatcacatttgaacagagaataactttagaagtaaaatgggctctaaagtagtagttgaaaggtttaagaatgtcagcctttctgggccagtgatctcttaagagcatctgttggttttggatctacaggcctgtccacagtcagtctatttataaccgagtgtctgctgctgtgtcctccattgttgatttctccccattgacatttggttttggtgactgggaatgctttgcagccactctcatcttctattgagtggatcttgccttgtaccaggaacttgaacttggtccatgtgcatttctcttccttaaaccaggagtcagtcgtggggaaaagcaaggctgcttccctctagttttacaagaacaaagggttaaacccttaaccctttggtgtaaggttctgcaaatctctctgtactatgtcaagtcactataccaaatcttttcctttggaaatcaaggtacatgtactttatatgtccagggcttaacttgggatgtcggtaagaggagatagacacttcagagagaaattcttttgtatcaaatgcttcaatttaacatactcccacttagagatctcatgaataatctttgttaccagtagatggtagaagatagttattagaatacttttggtgaaagaatctcagagttaacttgttttgaggcattaaaaaatttaagggtcatcagtgaattgatgcatacctgtgaggcttatagggtagagctgggaggtgatgcaaattgacagggcatatatcccaagatcaggtacagaataattgagttgatatgatgttagaccacacttggctcaatatttagaagtaagggaggaatttacatagtgcagtggagaagtatgaaattctttttacaggcttaataattttttttttctatgctattagctgtcatacctggggcttattaagagtcatgctattatacagagttaggtttgggagtagagaacttgaccaagagctgcaaagttatggctgggctttgggtaggaagaaaaaaaaggaaggaagaaaaaaaaggaaggaagaaaatgggttggtgggacattggatatagtaagactgttctgaactctgtaacataaatgtatgtctgtctccctcatttggcaagaccttctgcagtgttcctgcctctgtgttgtttgttaattagattgtaatgtgtgaaagggcacaacactatcctcttctgagtagcatctagtgtagtctggtgcccacaacggttgcccgttattattagttgatgacgattagtgaagctgaagctattttttaaacagggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttaggtttgtatgttttacacttctgatttttgaatatgggctatgggattttgtttgttttgatttagttttactttgattttcgttttcttcccctcttcatgttttctttttaagaatccaatctagtgtaggctatgctacaaagattgtaaattaactggtgaggtggaattttctaaaaggtgtcaatgcctgaagcgttgccaaaatgatagattttgcatttgcatagaactttaaaatctgaagaaagattccagagaagactatttcagtgattctcagatattaaaatcacctaggatagatgccttggaacctttcttaagtttctcccaaattaccgtattagagagctatggttactaatggaatatgtcatatccctctggtggtttagagggaaaaacagttgagaacttgtgcattatctcatttgagtctcatgagctctttttgaggtaggtggaccaggtatcattttccttattttgaagagccagagatgcagcttaaatgatttgttcttaatcatatctcttctgcagatgcctctcattccatctctggtcatgattaatgtacaggttttaccctattatttaagttacacagtattaaaataatgtatatttatcttccacaattggcacatattcttgaaaaatctataaaaatccttgtccagttatatatacaggtagaggatttttttttaatctccagtgtgatagtacaggtagagaatttaattttgagtaattttaatatcagtgtaaagctaatgtgtgtgcatgcacacactcacacccctctgcttattctaatgtctgccaaagtcaaaatgaaaatgtattttggaccatcgttgtaggacaagtgtcagttgttttgtatccctaatctaattattgttaatcttgcatgtgtaaataattacagtcttaaactttttaaaaattatttttatttatttattttttggagacagggtctcactctgttactcaggctggactgcagtggcatgaagttagctcactgcagccaccacctcctgagttcaagcagtcttcccacttcagcctcccgagtagctgggactacagccgcgcaccaccatgcctggctaatttttatatcttttgtagagatggggttttgccatgttgctaggttggtcttgaactcctgagctcaagtggtctgcctgccttagcctcccaaagtgctgagattacaggcatgagccaccatgcccggcctgaattacaatctttggaagaaatttaaggcacagggtaataaatacttacctaaggtctttcagatgagttcaggtgtcctctccaccttgaatatccagcagcctgtagcagtattttgttgtatttaaatgggggctggtggtggtggtggtgagtgtgtgagtgagagaaagaaagagaaggaaccagaataatacctttaatatgtaccagctactggactacaggattttttggggtagggggttggaggtggagaagaagggcattgaatgttgccacaggttacactcttctgtttatataatattatatattagtctgattttggatcatataatcctgaagtccttttatataaggtgatggtagaccctgggttacccagaaccttgtgtcctacaataattatcaatagtgccctgttttttttttttttttttaaatcttaggcatgtcctggtttggatgataaattacatcttcccattacttttaattcttagaattgtctccttaacaggggcatatcctagataatgagttcatcttgtactactttggaatagtctgcttatttcggtttcttagaaaggggagttagttttaacattggtcagtaataccaacgacatgtaaaaacttttttcattctgtttctttcctcacaaatatgccaggaagataaaaactttttagaatcactgagttgtggaatttcccccagaaaccaactttttccattgtctctgtatttaaagagtagatagagtagatgttgcattttgatgcattttgggatctgctttcatggatgctatagacagtgatttttccactttatttcagttttcctcaaacccggcccccttggtgaagggatgtaaattaatagcaattaatgtgaatttaaggggtgagttatatggaattgccggcaatagaagcatcaatttagaagatgtaaccctgtaagccctgtaaagtatctctggttattttatagaaatagttttaaatactgttgataatgagctatgttgaggacattgtccttaaacttgggttgctgtagtccctccccactgaaaataaggtttaatgccctttactttctctgtttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacaggtactgtgtgtgtctctgtcaccctctctactctccctccagccagcacgttgttcaagtaattaagaatggggggatgggggaggtggtggcattgtttcaggctatccatagctagcccttgtgaacctgttagtgatgtaggtttacagagtcccctcatgaagctggtccctatgctgaggtcactggcaagaggccaccgtcctctgtatgtacttcctttggttcttctctctcctcagcagctggggagtggatgaggtagtattgcctcttgtaacacaaccctctcgggtgctaaattaatctctgaagatttatgtggttgtgatgctgttggtttgttttgtttttaaaatagtaaactctactatccaccgctgtcaggagtgtagtgccaggtcatcttaccagttgtgtcttacagttaaacaagttactccagatagcatagacaaggatctggcatctttcaaaagtattagaatgcgatcagaggaaaccacacacacaaatcattcaacttaaaatctaccatgaaattgcttggctctttttctttttttaaattcataagtccctgaagatgttgtatgtctaccttctgtttttgaagacatgtaggactacctctaggattaactgatctctgtgtttatttatttattttttaaagaaaggtcagctgtctgaactacaaaagaggggctgttagtttcccaatcttgttaagttctcccttgtggcggaagcagtttgattgaccatgaatttctgttactctttagtagttttgtaatagatcgttaatgcagacttctaggtttgaaaggttagcatctcattttgaagtttagaaattctatgtagggaaattagcttatggtctttggagattattatgccgtgttgtacctttagttattgtcataaatagctgatactaaatgaattttgattgatagagtaaaaagttaaacatatgaagtttccctttaagtctcctgtgtcgtttatgaacaataaatacctttaagggattgtgtgaatgtgcatattcatataaggttaaattaacaaaatatctttcagagagagtaaactgaaagtgtacactcttctccgtgcagttcttagtaggtatgcctgcctccccatatgaattgactctctgtgctttttttctctttatggccatttttggttcttagcttccattcccagtgtaatgcaatctaacactttctgtgttttttaagaagggtttgtctcagatttcttatgaacaaaaatatatggttctctcttttttttttaaactgttctttacttcataatcagagttgatattcttttttgatttattgatctttggtttcaaaataattttaccagtttttggagactggacaattattagaacttgaacagaaatgtacttctatgtacccacaagtagttagcatgattacatcatagctaccacttattcaaaaatataaaaccaagggtgccctcaccatatatctcagcagttattgaaagtaaacattattttgaaagttaatctcttgttggattcaggtttcctgtgcatgtcttggttgctgcaacatagaggcatttttacacagacataccactgtcatgatgtgagtgttgttttatctcatgggccataattcttttctgagtagtttgttttatacattcttgtaccgggggccctaatagcatacctgggaaccactggcgtaagcctcctatatctttaagaccctcaatctctcggtgttcctgtataagagctagtagttgtcaagaaggaacgattccttttctattggaaattggtgtttgtttcttacattttatcccttatccttttagttttcattacattttattccacttttcatttctaatttacgtccacctcatttgtcaaggttcagtactgtcaccttcctttcttagtctccaaaccaaaaagctgtcatgtctgcctccctagaactccatagcattttgtgtttcctttaagagaaggtgttaccatgttttgtcttgtgttgtgattactcgtctaatagtccttgccagattgtaagctccttgagggcaaagactgaaccttaccccatttcctctgcattgctttagcagaacaaggtttcaggggactttcccccatccctattataatatctcagtgcatcctctgtacgtaatatgcttcccaaaattaaaatttgaaactagcctttcaggaggtctggaggctactctttgagaactaccgtgttttctaatatgtgtgtcctttggatccagcttaccacttatatacaaataactatgctgtataatatccaggaaagttacttcttggatcagaacttaatattttaaggctcactctgttgtcatctgatcagaagccatggtctctctcatgagaaaaatgtacataattctctgacactcagttttgtagataacttcagggagaccacagatttgtgttctacagatacagccttctgttcatatcttttgttctttgtagccaaccatatctttcatgaatagagtaagattccctttcttcttcttgatttgctctcaggttagtcattgtaactcactttatcatttaaattgtgcatggaagtactcgatgacaagtgatgagaccatttatgcccatattcttggaaccctgcaactatggagagtgtactctggtctcttgggaagggaaggactttgtggaagaagtggttcttttttttttttttttttttttttttttgagacggagtctcactcttttgcccaggctggagttcagtggtacgatcttggctcactgcaacttccgcctcctgggttcaagcgattctcctgcctcagcctcccgagtagctgggactacagacacccaccactgtgcctggctaatttttgtagttttggtagagatggggtttcgccttactggccaggctggtttcgaactcctgacctcaggtgatctgcccgccttggcctcccaaagtgctgagattacaggcatgagccactgcgcccagccagaagaggtagttctttagctgtgccttgaaagacttttttatatacgaagaaaatgagaattctagtggaggaaatagtaaaacagatatgtgttcagtagataatgtagaagtagtcagtctggttggtggttaggttgaagaaaaataactagagaggttgaagagatggtgttgtgagtcttatgctgtgttgcctataggaaatgagaagacactttaaagcaggaattacttaattattatagtttgttttttttgtggttagtgtgagtttagcagcagtttgaggcattctcttactcttattattcagttaactgttgactgttgtgtccttctaggaaccttgggttctgaatgaaacagtagtggaatatttggggaactaagtgctaaattaatgggttctgaatcttatcagacaaggggagggctcaatgaggacaaaggttgcatgcaactgacttgaaggacaggtggaatacattttgttgcaggtcagagcagaggtatggagctgggaatgactgtggtgtagtcctaggctgaagagagtagaagacgagtgtacaagaggacaaggaggtacagatgcctttgaaaattgagtcccggaggccttgagaaccagctggaagtctcagacagtactgatgattgtgagggttggaccagaggtctagtgcagcacatacttttctgcacattctgctctttttatcttggctttctgaaataagcaacaaaggtgatcatttttcttggtttagagtttgctgcaaatggtaggtttgctttatttgtgattttttagaataggaatctggtttggaggttgacaaaataagtaattctctcttttgttatattttctttcaatcttggctttgatttggtgtaataagctggtttcatcaaacttattatcagcctataatgagatacatgacatggagcagcctgcaaatagggaaaaggtaattttcatttaattcattgcaaacttagttcttgttagctgtgacatgggattttgatgagtcagttggttgtctggtcactgttaatcactctgaatttaacccttgtaaggtttatttataagagcaggagtttctaattcttttttgtttgtttttgtgtgtgccgtgaacttcttaataagtgaaccatgtggactacttctcagaataatgtttaaaatgtataaagtaggattacaaaggaaaccagtggtataaaaatagctgtcatatttaaaaacaaagttaattatatatttacttatttatgatatgatgcatgaaatagaagtagatgtactagctgtcataatgagcacaagtaagatgttgagatacttgtaacaactgtaaagtaacatgaaagtatatgtgatttctgtttgtgataatgtcacaggtatattgctaaagttaatgtagtttgttgtctacaatcataattgaagaacatgctaaatttcaggtaaatgtgcatgagataaagatgcagtattacccacccaagtacaaatatcttgggttcagaacctctgacttggagtattttgtcagcttgaaatgctcgttgttatttctaaaatgttcttcctttgtctcaaattcacttcattgtcttcttaatcctggaaaacagctgtgagcagttcatgcataatgtgttcataccattttgtactgtgatgttggagcagtatttattttttacaaaatgctatacagttgcctgtttccttaaatgcagtttagaaaattattactaggttttggctaggcgcggtggctcacgcctgtaatctcagcactttgggaggccgaggcgggcagatcatgaggtcaggagttcgagagcagcctggccaatatggtgaaatcccctttctactaaaaatacaaaaattagccgggcgtggtagcacacgcctgtagtcccagctactcgggaggctgaggcaggagaatcacctgaacccaggaggcggaggttgcagtgagctgagatcacgccactgcactccagcctgggcgacagagtgagacgccgtcttaaaaaaaaaaaaaaaaaaatttgttactaggttgtattatgttacaaacatggcacaaaccaaagccaggattatatcagtgtagaattaattgtattgttgatctttatttagaattcagttaatctaaaaatagcctaatgtagtatgtttcacaaaattggacactgttgtactaaaactcatctgttaagcatgaattttaacaaagattcaatattctgaaaatgaaagttgaagtatggtattcattcctgcacgaccacagtcagaggggagtggaaatcggcatgtgttaaaagtgtggcagtgtgattaaatgtcattctcgtgaggccaagtgtgtatatacttttaatgtaggtatttaatatgctcaactttctctttaacttacaaatgattattctatcaagtgtcatgtgtatagtaactgacaaagagtgactagtaattgatcagttgaagcttaacttctattgttatttgacttcgttcaaattttacttatggtgaagtttttctcaaaaagtattaataatacttagtgaagggatgtgttttgttcttccctaggaccttagaaatcatttgttttggaatcagattcttcatctgccaaagaaatgcacagatgatgatgatgatgattttttttttttagtttagcagcatggtttaatttgtatgcgcctacgaaaaatcattgtaatcattagttgatcattgcagtagttcaaataacctggtataaactgggcttttatctagaagcttcaagcagtaacaagatttcacaaatttcatatgctgaggaatgactccaaaataaacctttttcttaaaattttagaatcccatcattgatatagtgcttttactgtttcgaagggattttctctgtgaaccctgaaaacaaccccacgaggtagggcagctattttatttttacacataagaggccaagcatggtggctcatgcctgtaatcccagcgctttgggaggctgaggctggcaggacacccaaggtcaggagtttgagatcagcctggccaacatggtgaaaccccgtctctagtaaaaatacaaaaattagccaggtgtggtggcgcaagcctgtaatcccagctactccagaggctgagacaggagaatcgcttgaacccaggaggcggaggttgcagtgagccaagatcgcaccactgcactccagccccggggacagagtctcactctgtctccaaaaaaaaaaatcagtgaagtttagggacttgtttgaaggtcatctagtacaagctatgcagatagctattattttggtttctagcttcaggctgtctcttttgaactttgtattagaaacgcagggccttttaataggtggagttgtctcaccttcaaattcaactacatagctttttcttaaagtagtataatgcagaaagtactcatccgtaaaaacaaaaatggttttctttcttccctgttatctttgtgacccactgatagcagctggtggtcctggtgcggtgagattttgactctttttttttttttttttttgagatggagtttcactcttgttgcttaggctggagtgcaatggccatctcggctcacctcaacttccgcctcctgggttcaagcaattcttctgcctcagcctcccgagtaactgggattacaggcctgcaccaccactcccggctaattttgtatttttattagagatggggtttctccatattggtcaggctggtctcgaactcctgacctcaggtgatccgcctgcctcggcctcccagaatgctagcattaaaggcatgagccactttgcctggctgatttagactcttaatacagactaggaggagtcctgccctctgcttttggtctgcttgggctgcctggctctgggaaggaactgtaaagggtgactctcagaagggctgagtctgttgggggtgctctccccattcatcagaaagaacatcacacataaaggactcttataaatctttacatgtgttaattttaatccccacagcaacctgccatgttacatattatctttattgtcatattaaagaggagaagagaatgaggcacagagagattaagcgatttgccagaggtgacatagcaagtcactggtgagctgagatagaaaccaaggctgtctggctccagagtcagtgctcttaacccctgtctgctatgtatatagtctcaaactggtaaaaaagtcagggctggcagtacattttattgtggccggtggccaggggggagtgggggcggtagtcttttgcatttactaactccttatttagacattactcctccaggtttagaaaaaaaaagccataattttttatgtcagcaactgctattgataacaacaacagtaataatagtagtagctatcttttataagatgccaactacatgtcagtcactatattgggtgtttttggctgcccggattcctttctggaataagagctctgtagactgtttttaatatagtaagtgacagagaaaggaggcaaaccagcttgtctacttcttaaactatgccttcagtatttattaggaacctcgatatgcttgaagtagatgatacattttccccagcattcagactcttgaacaacttgtgaaatctacccaagtgaattataattaactgcgtcacatttatcattatactgacctttgagcatttcccccaactcacagtattttgtttctcagttatgggatattcgcttgctttgtgaaaaacatgaaaatgttagcagagctcagtgctttgcccagcagatggcatttgtgtgagtttttcaggatcctttggaatctgtcacttgccaattacccaatttgttttgaatactctgtatttccagttaatattgcaccatttacataaagagaatgtgccaaaattgctgtaatctgttctgtaatcaaatctgtctgctgtagatgtataatttacttttgttaagttgtttactgcaaaatggtctcaagaaaatccttttctattcaccataattactaagatattaatcagctctcaaacataggctatatggggtctcttgtaaggcttgtttgcttttagttaaaagtaatagttcctgctttcagaatgttttaatgtggtggtgaaaaccacaagctaatgttatatggaatgattacttttgtggtattcccacatgccatgtatttccgtgtatatttacagatacagtacacatacataaaatgacttacatgtaatattaaaaaaatatatagcccaggtgtggtggctcacgcctgtaattccagtcctttgggaggccaaagtggaaggatcatttgagcccaggagttccagaccagcctgagcaacgtagacttcatctctacaaaaaagttcaaaaaaaaaaaaaaaaaaatgccaggcgtggtgacatgcgcagctacttggaggctgaggcaggaggattgcttgagcccaggagtttgaggctgtagtgagccatgatcacgtcactgcatttaagcctgggtgacagacagagtaagactccgactcttcaaacaaacaaaaatatatgaagtgaggttaagtcagatggaatggcagtggactactgtttttggttaataaatcgagatacccttaagagttgtgttctgaacatactgtctttttttccccagttccatgtcacagcacctgcctaataataggtgctcgaaaaacatctgttgaatgaaatgaattcttttgtttgcagtagggcaaagaagggtagagagaagcagctagcacaagctgatatgttaaatgttgcaaaaggttttaggccaagaaaattccagaaacccattgaagaggcaatacatgtttagtggaactatgagatgttttcacaaccttggaaataatttaaaagtaactttctactgttttacttatttcccactcctggctgcccctcttgggtggactgcctcctgttggagggaatactgtgtgagacacatctttagtaaaacagaaatgtgaaaccaacttgcagaaatcacaagcacactgttaccaaatagtcttgactggctcccttcctggaggacaaatgttttgataatgtctgtcagtagattcagttcccctatttctttttaagacttgatatttagtaatactgtttcttttttgccagcatcgcagtgaagtttttctttaacttttggggaaaaacaaaacaaaacaaaacaaaaaaaactaaagtatttttgaaatctgtgcatggttacttttgacattcatactccaaaagcagagactaagactaaagagttaacaggtgaaattggccaatatcttcaaagtattcactttttgttttcttttaatctaaaattagcctcatgtttgaggtgtagagggtagccaaatctcaggataaaatctctccaccacctaagataagagtaagtccagtcatgacaataattaagctgagttgctagaatgacattatctcctaatgtctgaaacaatcaggtctctttatgaggacatctgtaattcaagatccatggtgtctgttaaacatcatccagcaatgtcagctgagctgttgaaaaatcctgtaggaagagcaggtaggttgaaggtcctatccagggaggtcacttcagtaagtgctttcagtctgattttagcaaacattgaagtcttcagtatgactccttggaaggaggcccattaaggtgatccacaaattaggttactggcatcccctttctttataccaatactattcatactaaaatgtaatctccatcagggcaggattatgtattgttttattgactgtcatatccctagttccttgcacagtgcctagcaggtatcatttgtttcataaatatttgttgaattaatgagtgaatgactggttttgtattaacgtagaatcgtaagacattcttagtgttgttaaggcctttgaactttcttttctttagaactaagaagtgtgctaggtgtgagctcataatccaagttttgttagtagctgctgtgtttctgctgttttatttttaacatataaagaatagtatcccagaagactctggagctcccgaaagttgggcaggtgtcttaatttactcattaggataagctactagttgaggaagttattcaataccattttcccaggaagaggcagctcagaggatgaagtgaacacttttcatattcttctccaaaatgtgagtaggtgaggattaattcagttatttgtggggtcttgaaagcactgaaaggagattcagcactagggacaatgtgacaaatcagttggtagtacatttgtctaatttttaactttgccttggatcaggcaggacctgtagacctgataatctttagggcttttgaatgcatatatatgagatatatagatagatatatagatatagatatagatatctcatatgtgtgtgtgtgtgtgtgagagagtgtgtatttgtggttcaggggacatataatctgtgaagcggtcagctcatggaaccaggacacagtaaattgaagtaaagaaagagagacagggagaacagaagtatgaaacattttaatcccatgggaatgaagtagagtgtgagaacatttattgttaaggtgtcacgcctaaacaagtgcttattaaaatttttagtcagagaggtttttaaatgattttgtaagacagtttccctaaccacaccgtgtttttcctcttgcctcagctgttccaaagacctaatgcgcttgctgtccagcagttgacagctgctcagcagcagcagtatgcactggcagctgctcatcagccgcacatcggtaagtccttaagcccatagctctttcatgataggtgtggccgccattttaggataactggttgctgtgaaacccagtaatttaaactgattataaaagttcagacaaatccctcagacagagtaagtggcctcttccttttgtccagttgtctccagccacattagttttgacatagcttgtagacccgcatcataacatttcttcagtgttcagccattgccctacctcagatgtttcaggatttaaagtatttatcagagtaatgactggtgactaccattagctctttcggtaagatttggatgacattgattacataagttgtggttctatagactaatatatcagcttcttattttgtgaacaaacagtataaatccattttccagtaagtatgcattgaaaaaatttaaaagtattctcatataattaccgattttaaagtagctttgcccttttcctttagcagttgttaaagttttgagcgatgtattcatcgtactgcctagacgtttcttccccctggaccttcttaaggtctcttagagtgcattaagtataaacaagtagaagtagaatttttttttttaatgtgtcaaaatggcatgattgagtagaaaggagatagctaatcttggatgtgataggctatagaagaatatacttacttccaacctaaataaataaaggccaggcataaagtccttgggtctgataatgtatagttgtagatggtaatctttataaatacccatacattttatttcatgaaaactgtttggaaaattgttttaaatagaaataaatacttcatcccattttaatattagtctttaaaattgttctattgtaggctgttacaattttaataatcttttagaaatgctgaatttataactatatacagttttaagttaaatatttctttagcaaaggtaaaatttgactatataaacatttcattataatctttagtatagcagttatctttttaaaatttctctttaccctcaacctgtcccgtcttctcttttttcattttttccttatctactgtctggagtgaatagcgaaactgtgtaggtatttgatagggctgcagttttagtcaagtttgtttttactgacaggtatgttttcagcaggtttagctcccgctgcgtttgtccccaatccatacatcatcagcgctgctcccccagggacggacccctacacagctggattggctgcagcagcgacactaggtgagacattctgctgcatgagggattttctcacctgctgaaaagtcatttgagatgggcgtgcattctttatactctttcccaaatccatgtctccagtggagattatccagattttcaatgccatctacctgccagcttaatatctctccgtagctgtatcataggcccctcagacttgaaaatgttcaaaggcaaattaatcacatacgccttgcatatgtgtttttgatccatggagccaccagatactcatttatattttgggaatttccccccttgcccagatctcctaccacctctagtctatcatatagttcaggtacttttactggtctctaatgtatttataatttccttgcctctctcacctcctcttcccctctaaattgttcaagaaaatgatttcaaacttagatcttacctcttcatctttctgcttaaaccttttattgatttcccttttttctaccctagtatgtcatactacagttattaccaaacatggctgatcattacaacttacttggagtcggggtgggggtggtggtgttttgttccttggaatcagtatttttaaggagcttccagataattctgtgggttagctagggttgggacccacagtatatagggctctatcaccatgcctcatacatacaggtctctacatatgtaccacccaattcccttcctagttgactgccattggctaacaccatacattgtagcagtacagatctgattttagtttgctgcagatactgcattggtttaggcccctgtctttggtcactgtggtcttctgtagtaagctctttttcccattctttgcctgtgaagtgccctagttggctaattactgcactgtttttatttgcttgtgggatgtatacatgagttttttcccctctttttttttttctctttctttctctctctctcttttttttttttggagacaggatctcactctgttgccgaggatgggatgcagtggcgtgaatacagttcactgtaaccttgaattcctgggcccactggattctcctgcgtcagcctcctgagtagctagggctactgtgcatcaccacacttagctaattgttaaatttttggagagatggggtggtctcgccagcgttgcctaggctggtgttgtgtcaaattctcgggctcaagcagtcctcctcccttggcctcccaaagtgctggcattccaggcatgagccactgtgcccagcctatgagtgtttttttctttcccttgagactagatttttaaaagacaggcatctttgttatttgactgtgtgttgcacagttaccgtcaccgtgatgggaccataaatgtatgatgggttgaattcaacattaggacaaacaaaatgtcttccagtttagatattcactgggggaagatccctccaagtcaagttcatcatgactaaatattacttcgaaattttactacttattatgtaacatgtaatttgcaattatgaacttaaatgtagcctagcatttcttagattttttaaaaaattgtttacattttggcatggttatgatgggaagatagttaacatagggtcatctggctgtccgtggtcatcccccttttgggggaaaacagaaagctcttcgtaggagaatgatctctgctaaccatcattaatatttattgagcacttaacttttgtcaggcattgtcctgaatgcttttctttcatatgatttttcagatgatgattttagagattagaaatttgtggctcagacagctgccttatttgttgttttttgtttttttgagactgagtcttgctctctcgcccaggctggagttcagtggtgcgatctcggctcactgcagtctctgcctcttgggttcaagtgattgattctcctacctcaacctcctgaataactgggactacaggcacccaccaccacgcctggctaatttttgtatttttagtagagatggggttttgccatgtttgccaggctggtctcaaactcctgacttaaagtgatccaccctccttggcctcccagagtgctgggattacagttgtgagccactgcgcccaacctagagagaactgtctcatttgaagtcacacaatttaaatgttgtagagttggggtttgaaccaggtttaactccaaagctcatgcgtatgcttcactatagtatatagaatgcctgtgctgtctgtcttgaattgtcttttctgtactttctttagaagtctttactaatttatgttacttgaaacaaagaactggtcttagggttgacactgctgctgtcactgagatggtagttcggtgatcagaatcttgttttttgtatatgtcagttgagccagggtgaaaatgagttaatactttcacaaataacaggaaatgttaactgttaaaactatgaaaatgtgtattctttgagggtgtcagtcacacaggaattgaagtgggcatcctgatgtgccaagctcagttgatttgccctgggatgttttcctaaatttaaccttaggccatgtgaccagcgtatagtagtagaaatgccagttgagaaaatttagagagtaatgcagatgttaatggtaatagcagtccttgcccagtagaggctcgcttttgttggcttttgggagagcgttgggactattattgcaggttgcaaccactcattcaaggtagatacggctgtactcccaacatgtattacaggttgagcatccctaatctgaaaattcaaaatctttttgagtagtaacatgacaccataagtggaaaattccacacttgaccttgatctcatgtgatgggtcatagtcaaaaccacaggcacataacacacagttcatctattcagcatccccaaaggaaaagtaaaattacccccaggctatgtgtataaggcatatatgaaacgtaaatgaactttgtgtttagacttgggtcacatccccaagataactcttggacacacacatagtctacaatctgaaatcggtaacacttctggtctcaagcactctggttaaggaacactctacctgtttacccatttttacaggtgaggaaactaaggcacagttagggtcttttttgtgtgttttttctcttatttatttctttaactgcccaagaccaccctgctttataaacactaatcaaatgagtatgaggctctatcactcttttttttttttttaaacttgaatacatggcttttaggccgttcagtttctgacaaattaaaaaatgttttaaccccttttcttcttatagtaaaatagttcatagtgtaacagcttttcttagcaacacctttattctgtacccaggtatagtgtttcagtgtgcacccttgcttgtaaacagcttcttaatcttttctaagcccacaggtatagaaaacaccaaattagaaatgtcaaaacatatttatattgggcagtggtacaatttgacttatttgtgttttggaagcttaaaatgggggaaacaagaatatgtgtctatttattttggcttaatgaattatgtgtttctccagaattagctgtagcatcagagtagctgtaatatttgaaacagctcttcagaacttcagtcagtgtaaggaaggtttggttactgttaatgaatcaagttggaaatatttaactctctgctttaaggaagttcaacttggagatatgtttcagcagatttgaagaattgactttgagcccatttcctggttagcaaatgtgtctttggtgtttcttgctaccagcttcgtcatagaattctataattagatttctgccacacttgggttgatatctgcataattttgttatatctctgttgtgtactttatgtggccgactgcagctgtactttgttgccaaggaaaatgaacagataatttggattaaagcagaatgcttaatttttttttttttttttggagacacactctttgctctgttgcccaggctggagtgcagtggtacaatcttggctcactgtaacctctgcctcctgggttcaagcagttctcctgcctcagccttccgagtagctgggattacaggcatctgccaccacgtccggctaattttttatatatttttttagtagagatggggtttcaccatgttggccaggctggtctcgaactcctgacctcaaagtgatccacccaacttggcctcccgtaatgctggggttacagagaatgcttaattttgtttaaggttctcaacaggtctgtaacaagtcaaggtgttgtattttttgtttctatttgtgttcaacgttgacttaaatttaaaatttcacatatcagtgtctgaatgtagttgtgttgaatgcctttgtgactttaaaaatagaaataggggccaggcctggtggctcaagcctaaagtcccagcaatatgggaggccaaggcagatggatcgcttgagcccaggagtttgacaccagcctggggcaacacagacctctaccaaaaaaaaaaaaaaaaaaaaaaaaattagtcaggtatagtggcatgcatctgtaatcccaggtattagggaggctgaggtgggaggatcacttaagccggggaggtcagggttgcagtgagctgagattgcctcattgcattccagcctgggtgacagagagaccctgtctcaaaaaacaaaaaaacaaaaaaaacaaacagtaacagcaactttgaagttgcagtggaggttcagttgagtgtctaggttttgttgtcagactgatagatgttctttttctggagttaatgaaacaacagcactccgttaaatcaccttaggtgccattcttatcattgaacataggatacatcctaaccttttgttctattccatcactttaagcacgcaaaccctccatttactcccttctaccaacagatattgtctctatgctacatcctccatctgttattaaattgaaccccttctatcagtgattcccccttttagttttctaatgtttcattccccactgcttcttcctctaggcctggattatattagaagactggtgtaaggatctcatataatgtttactattctttaaaaagagttaatgattagctagcataaattaatatatacttttaagttaatattttacagtaggatctattgagtcagatgtaattttggaaaggctgagatgagcctcagtagttcagactttctttacctttcttttgctatttttaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggtaaatgtagacaaaatttacctcttctaagtgggaatcgtagtattgtggataattaataggtaatattgcgcctaatagaaaaacactgtgaatgcatgaatttcctcttgtgtgtatatatgtgtgtctgagttcaggctcagatttaactactcttacggaatgtcttttatatattagacactattgtacctaggtggggtaacgatactaaccagttcacctatagggaaattgcttagctgcaagtggcaaagtggatcttcaaagttacagtaaaattttgttctgccatactgtagttgcttgctaagcaccactttcagatcatttcagggttttgcaaggggcttgacactaaagcaggggtactagatttttagactgcttatttgtagtacctattggattggattggatgtaaatcttaaactatcatatctgcattagctttttatttgagttgagaaaggacggtaaactgcaaaactacatcttttatttttttaaacaggtcatttcctccttgattgctagaataacaccttttttttttttttgagatggagtctagctctgtcgcccaggctggaatgccgtggtgcaatctcagctcactgcaatctccgcatcccggattcaagcagttctcctgccttagcctcctgagtagctgggattacaggcacgctacaccatgcccagctaatttttgtatttttagtagaaatggggtttcaccatgttggtcaggcttgtctcaaactcctgacctcgtgatccacccgcctcggcctcccaaagtgctgggattacaggcgtgaccaccgtgcctggccaataacacctctttattgatagaaactgtggtaaactagaaaacttgaaaaaaaaaattaccctaaatccttatgtcagaaaaccaatgctattatgtttggtatctgttattttagccttattatttaatattttacaaaattgtcattattgtgtccacgtggttttacattctgatttcatactttactgtgttatttagtgttcttttaaatgacatttttactaggtacatttaaatccaccaaacgatactttattttgactagtctattatatttgatatttcatttgtatcagtattttggtgttttaaatgagattgattaacatcctttacataagtttatccttggaaaaaattcctagtaatggagtttttctggagcaaataaaatcagcacttaggcttcgatacgcattgtcagataaaagctgtcatttgagacaaaacaccctgctcatatatgaatatattaaatgatccaaacaagaattttttgcttgacatcagtcttactcagagggtgtatgtttaattttttttttttttttagattccacacaattacagaaaaaaaaaacaggtcttgaaattccccccgttatttggacactattaaatgattttcttggcaacagatacagttcttgtaccatatatataaggaaattcagtaaataatttgttgacagaatgagtgatctgttaaaataaatttgttttgagacggaattttgcttttgttgcccaggctggagtgcaatggtgcaatcttggctcactgcaacctctgcctccagggttcaagcgattctcctgcctcagcctcccaagtagctgggattacaggcccccaccaccacgcctggctaatttttgtctttttagtagagacggggtttcaccacattggccaggctggtctcgaactcctgacctcaggtgatccacccgtctcggcctcccaaagtgctgtgattgtaggcctgagccaccacgcctggccaaatttctttttttgtttgttttttttgagatggagtctagttctattgcccaggctggagtgcagtgagctcttggctcgctgcaacctctgcctcctgggttcaagtgattcttctgcctcagcctcctgagtagctgggattacaggtgtgtgccgccacacctggctaatttttgtatttttagtagagatgggatttcaccatggtggccagactgatctcgaactcttgaccttcagtgatccacccccctcggcctcccaaagtgctgggattgcaggcatgagtcactgtgcctggcctattaaataaattaatttctcttctcttctcttctcttctcttccctcccctcccctcccctcccctcccctcccctcccctcccctcccctcccctcccctcccctcccctcccctcccctcccctcccctcccctcccctcccctcccctcccctcccctcccctcccctcccctcccctcccctcccctcccctcccctccccttcccttcccttcccttcttttcttttctttctgacataatcttgctctgtcttccagcctggagtgcagtggcgccaagtttgctcactgcaaccttcgcctcccaggttcaagcaattctcgtgcctcagcctccctagtagctgggattacaggcacgtgccaccatacctggctagtttttgtatttttggtagtgacagggttttaccatgttgtccaggctgatctcgaactcctgacctccagtgttccacccaccttggcctcccagagtgctgggttacaggtgtgaaccactgcacctagcaaataaatttcttaataactgctctttgtggataagtctgtatttatttgtgtgatcatctttttgtttaaatggctgccaaattattatgcatttggaagactaaagtaattaccatgttttaaaattaggtctaatacagtgaacaagaataatactaattgctgtttattgaaagctttctgtgcagagttaagtgctgtacatgtaatttctatttctcttattatgatagttgtacaacttcttgttttatgaaatagaatttcataattgagaggaaatcgattgaggaaatacaatttgtgtgcccagggtcacacaaatacaaagttgttaagatttgaacataagcctctgtcttgacaacttttcttctgaccatattgtgatgtcttgacttaaagaaaatctgagatcttgtgtttcttctgccgttaactagcttacaactagggcaagttggatggcttctctaaatgcatatatttttgttataaaatggacataataatcattaacttttcagttttctgtcattccctacaggttctgtcaaaccctactaagaagtttttagcattagtttttaattagcagccattgttttagttccttttttttgggtgccagtttctgattttaagtatttgaggaaaatatgatttttttggtaaactgccttgtcatagtaattaaaatgagaggttctttttaaactttgctgttggccttttgggcccttgtattttatcagaaagtatatgttgcgttctagtcaagctgactgttctaggatagtttttataaattcagtcattttgtgatttattagactttaaaatgttacttgtgaaactgtatattttgtttccataaaatcatggatttgacagctattgatgaaatgaaaatatatgaattttggcagataactgaaggacttttatttgtagttaggggtactggacagatttctagagagtggacaaaaagctaacactgttttccttccttattacaagactcatcaatagtcttagactacctctttaggtaccttgtccactctaccacacctgccctttcacagaacacctaatcaaacataaacctacttctttatattctgtgaaagcaatgctttcattgttttttaaaatcttcagcaattttgaactattagcatttgccatatttctgtgcttgctatttacttatcctagagtgagatctcttctgagttattgggtatgtaaattctaagtatttggcaaaaatgcttgctatttacttatcctagagtgagatctcttttgagttattgggtatgtaaattctaagtatttggtaaaactcacctgtacagccccccgactcttctatctacgtagtttgaaacacactttctcttacaaagttggttaggttctttaggtcagaaacaaattatataatatcttgataatagtgatttgctattggttattgatgatctcctgggtatcaggcagtgtggcttaaacacattatttgagatatttccagcaaatctgcaagatcatttgttaattcttacttattactgatatagaagtaaaagattgggcaaattaagtgtccacacatcccttcttgccagtgtggacagtgttggtcaccttatactcacttaacaaatatttaattggttattagtgttgcttctctttttacattttttttttaccactggtaccaagaataatttgtacccattttcttgaccatatgtctaacttttataaataacacagtgaaattgaaagtgatctgataagaactgtacacttgacaatatgacaaaacacattgttaggaactgtagtaattttagccttggtttgtgggttttgcatttttgcttgctggagtgtgtagatcttgtgagatagattcttcacatcattcagaataataatgattgctagcattttgatgtctgtgtttcattaataaaaagtagatccttgactgggctcagtggcttcacacttgtaatcccaacactttggcaggccaaggcaggtggattgcttgtgcccaggagttagagattagcctgaacaacatggtgagaccctgtctctacaaaaaatagaaaaattagccaggtgtggtggtgcatacctgtagtaccagctactcaggagaggtgggagcatctcttcagcctgggatgcaggggttacagtgagctgagactgtgccacactacactccagcctgagcagcagagcatggccctgtctcttccctgcactccgcgccacccgccgcccaccaaaaaaaaaaaagtagatcctttatcagagtggcataactggtattctgcactgaacttgactaatgcgtatgtttgtggaatttctgagagggaaatagaaatagtcaggtgagagccctaccaaatcgaatctggtgaactcatttggggccatgtggaccttgataaatatattagtgttaaagaggaaatattctcattccatcttttgtgtgcatgtgagactcagttgactttaaatgtgtgggtaaattacccctgttcatcttgtctggaacccctcccaacccccattaatactctttttttttcttttttttttttttttttttgtgtgtgtgttttgaaatggagttttgctctttttcccaggctggagcgaagtgtctcgatctcagctcactgcaacctccgcctcccaggttcaagtgattctcctgcctcatcctctctcgtagctgggattataggcacctgctgccacgcctggctaatttttgtagttttagtagagacggggttttgccatgttggccaggctggtctcgaactcctgacctctgataatccacctgcctcggcctcccaaagtgctaggattacaggcgtgagccaccacgcctggcctgttacactctttttttttcttcacccactttttgtcagagcactgacattatatagtatggtttattgtctgtctcattcgttaaaataaaagctccatgaggacaggggctttgtcggtcttgttcattgctctgtctcacttgcccatttgccacatggtaggcattaaatatttgataacactaccacttgctgatgccagatattccaaattcatcttttaacttaattgtcacaagaactttatgaggcagatgagataaaatgtttgaatgaatgaatcatcacttttgtgtgctttttgctgcttatagagataatgtgtttaaagtaagaatggtagaatgaaattccactctatgaaatgttattaattgaatttatacgctaacagctgtgacatataaaaaccattatagggaaacaatttacaattaagttttaaaagttgacccaacctgagcatagggtaggtcttctccaatgaaaagaaagtggttgagttatttctgtcttcctttcccaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggtgcggctgcattgttattcctaatactttggcagggaaaaaggctgcacgtttgaggtgattacagaggggaatgagcagtgctttcaccttgcttaggcttgtcatgatttggggactggcaaggatgatacacacttgccctcacttagactatagttcactgatgagagcattgttctgagccagtcttaagtcatattggaggtatctaaatgtccatgcagcttggaatatgtggtttttccttggtggattatctgttttctgtttcagaatcagggatagatggagtggccaagctagtttacaaggcttagtctttatgttgatgtttttgaacagcatgattagtgagaaatttctggtataccttgatagggtcatcccttacgtttttaaggtttctcttaaaccaatagtaggggtcctttttagctgtctacctctgagatacatgtttatatagatacatcttgaatatatgttgtttttggttcactgtcagctggtttggtgctttgcatgggattagatgtactttgatgttctacatgtgaaacaagtctttgagagatgtcagcgtatttttatggacctttactgatcatagagcatagccaatttaactgagccatttatgaattcaataaataactttaacctgtttcatttgttttttagttactgagcctttgtgtgttcttaggaagtcacctgcagtttttcatatggcttaaactgggatttggagattctatctcacataatattgaaagatcatgttatttaaagcctatctaggtttttcctgctattttgcaggatatttgttcttaaattattatgtagtatgaaagtactatgatttttataatcatttgtagcctctgtttattcaactatttaagtgatggagccagtatataaatctggccaattcaacctcaaagctgagtttgtgattattgacaatatgttggtgcccaggagatacttgtttgtttaacatatacatttctttgttggcttgatattcctaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcaggtgagcgcacatctgagtggactcctgccagagatctaaaagtggcgactgatagtgagattcttaaagtatgttgaaataaacttttggcaattctcagtatatcggttctaccctgtaatgtttcaaaaagagatcagaagcaataagtgaccttagtggattctcctttttgttggggggttggtgggttgggggaggggtggcatgtgccagctggttagaagcaaggtctgaaggtctggctccactgagaacatagaagttgcattactcacacaaaatggctttgttggcagaaatccaagtcattattttaagataattttagaggaggggttgttttttgccacaggggcaggagtggaggacgtgggaaagagtagtgagaagtgacaaaataatacatttggttgggaggagtaatagttttttactttaagtgtttatatttatttattttttaattaagaacaataacaggaacatctagaagacagcagtgtgctaaaataggaatttgaaggatgtgtatgtgcattacatggttctagaagaaaccctcaacatagatatttatggaatttaagattttaggaagtagttgtatttaatggatacatttgatgtttataccccttttaatctgtatactcttaaaagcaaccagcatagtgaacttgttctagtggtattttgagttcaaattgaaagtagaaacagaaaatagaagcttcatatgaagggatcaaagacagatttgtatggtttgtgtctgttttgaaaagataggcagcattaaaagattttttgaaaaaagataaaaatgtagtttggaaatgtggccagtccctttcatagccaaacggtttgctttcttcttcatagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcaggtagaaattagactgatatgctcttaagactgaattttaattatttttacaatccttctggaatactggcaatgcatggaaccacaggcagatctggaccaagccttgtgggaatccagccatcccacataatctgtgagatgatagactattgaaatcaagttatacagatgggacctatttcaatccatgctcatgtggctacttacttaatcagtttctttcagggatttgaaatctagggaagatttttgctgtatttgggaaaaatattgagggaactgtagaaattgatatcaaaaactgagggaggaggacttactaaagatagcagagctgaaatactccacaattgagactgagccgagttcttggcctgcaggccttaaagagttacaagttttcttcagtcttttgagtagaatttaaggtagacatgtggaaaattaggaggaaggatattagaccaagatatttttaatgttttgatgaaaaaagcaggagtgtagtatggtgaataatgggataattgcagagattataaaaaacaaacaaacaaaagtgatccctaaatagaagggcatgtgtgaaagaaagtatcttaattggaattgagggcagcattaactctcgattgaacccactgagaaaacaggctttcatatagaagtcttgtgtagtggggcagtaccccatttacaaatcttttttctgtatcccatttttctacttgaaccttttcaattgatgaaaggcattcttctagtccattttcttccaccttttccatagttcatgtggccgtcagagctttttaaccctcccttatcctataatatacgacaccataggaaggtaaatttggcatatgtttgatggtcatgttaacctgagccatgtcctctttattacttatctgcccctagtactgctacattaacagttaggctgtctctgctgacaaatttgcggtggtaaggagtctggatcaaagtgttaggaacaggtcactgggcttgttcttcgaagaacaggcctgttcttatctgcattgttttaattccattttagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggtaagaaccattactctaacaccaccttgaactctagaactctcttgccaccgatgacattacaagaactttgcataagcaaaggacagtccctttatactagaagtgtcctgggtgttctgtgccttccgtaaatacctcatgttattcaggctgtacctatagatagtatagcagttttggctttattatagtttgggtacattccctgtatattcagttagctttagtatgaacattttattctttggctacctgtgagagtatttcaatgtaaacaatataaacacaggttcatttcagtgaagctaggaaacacagagacagaatttaatcacctagtatcaccacctgaaataccaccacaattaatattttgccttatttcctttcaaaatttcccctctgctatatgtacatataatatcttgctttttcacaaaaagcattttatttttaaaattttgccatattttaaaatatttgtaaatataaactctcaaaccatatagtatgttaatgaggagatgtatatttccctattaaatatttagattgttttatgcatgggattttaaaatattaccatctagattctagaaaatagggagagaaaaagaggatcccaagcagcaggctataagaatgaaaagaaaattatattaccttttttttggtggcaaatctctaaatctttcaggacatgggagatgttttcttatctcaagcatggtgcatactcctctcccgcagttatgtattaagtttaaagtactgatttatttgctagatggggaaaattgaatgctagatgtagagtcaccatataatgtatcatgcaaaccagaacacttttgtgagtggaagggggtgctatgaataattacttggtgatgataggcctaaatcaggactgtcctgggcaaatcagcacatgtggccactttaccaagaagattctgttcttaaccagcaagattaaaagtggcttcatggactcagaagtgagaacttgactaaaaacaaacaggatgccttcgtttggataggcagactagaaagtgatttataagattcaagagaagtctgaagtgggtagggtaatagacttattattctagacctaggagtgatagctttgagtttgaaagaggcgagtttcaagtcaaaactatgtttatatatacacattggcatgtgtgtgcgtatcctgaagttttatacagtaagaactttagttgtagaactcattttctcaggttatatatgaacatcactttataaaagttactgtgacattcctgattagtaggtccataataggtagacagggggatggggtacattgcacaacagtgtttcctagtgacacaatgcctggctttaaacactgggggttaatgcagaatctggagagagctgtcaaactcccagtttgatacgtggctagaaggaaggaagtaatgttcactgacctggcatttacctgctggtgttaatggttttgggtcctgtacatacaacactggaaggtataggtattatttcgtgtctcaggacttaaatatcttgcctagcctgtgtcatctcagatttgaacagatttagaatcaagccttttcgactccaaagcatgcagtttcagtgtatatcctgttacatgatgtactcaggatatcttgaaccagtccattaccaaatccagaaatatgtatcttttaatttcttggtttaaaaacatgtgaactatgtcatcccatactacatactaaataaactgaacctgctaagtttttttttcataaagagccagatagtaaatgttttaggttttataggccagatggtgtctgtagtgaatatttaactctgctgttgaagtgtgaaagcaaccacagacaaaatgtaaatgagtgaatacgtagctatcttctaataaaaccttatttataaaaatagatgggccaggcatgatggctcacatctgtaatcccagcactttgggaggccgaggtgggcagatcacttgaggtcaggagttcaagaccagtctggccaacatagtgaagccccgcctctaccaaaaaatacaaaaattagccaggcatggtggcgtgtgcctgtagtcccagctgcttgggaggctgaggtgggagaattgcttgaacctgggagacaggctgcagtgagctgagatcgtgccactgcgctccagcctgagcaacagagtaagaccctgtctcaaaacaaaataagataaaataaaataaaaagctgtggttccttggtgcgtggaaatggagccagaaatactactttcatgcatgatacctttcctctttctaaagcatcagcaatttaatgtaatactacctcttaatttttgttttccctgtgaagaaggaaataactattagtgtgagttatttcttgtcaaatgacttgttgcctgcctagttttatgtttaacataacttctctttggaaacattcaccttgttcaagcagttttttagtgtacatttgcactggacttctgttgtgtgtagtgcatgtttcgtacatgccattcctgaggaactctttgtctcagtacagctttgcctcagctcagtctgtttcctcgagaaagtagaggtgtgctacttggtttctaacaatctccatacaaaggccttaaagacattttagtataagaaacataacatttctttctggcccacacctaatatagcttctgttgttaatactacttcactgctgccaccagccatcagcagtgatgagcagccatactaagcattttatattcattgtgttgaatactcaaaagaacccttcaccccttaaaattcagcgtggcttaattaatattgctaatgatatcgaccacaaaactagtgtttgaatgcgcacatcagcctatatctcgtgtggatcttttccccatcttgtcttttttacactttgtcccaggaggcagatatgtgttagtatcttttaacaaaatcagtgacctgtttagtaatttttcctattatttttttaaaaatcacttattgagtggcatggtttttcattactgattgtttaaagttcagactaaaaacaaacctttttgagttctattcccccccgtttttattgtttgggacagggtcttgctctgttgcccagactggaatgcagtggtgctatcatagctcactgtaacctcaaactcctgggctcaaaggatctttccaccccagcttcccaagtagctggtactgtaagcacacaccaccacacccagctaattaaaataatttttttttttttttttttgtagaaactaagtcttgctatgttggtcagggtggtctcgaactccgggcctccagtgatcctcttgccttggcctctcaaagcactaggattacagatgtgagctactattcctggctcctttttttctttattttattttatttatttttttgagatagagtttcactctgtggccctggttggaatgcagtggcgtgatctcggcccactccaacttctgcctcccggttcaagtgattctcctgcctcagcctcccaagtagctgggattacaggcacgtgccaccatgcccagctaattttttatttttagtagagatggtgttttaccatgttggccaggctggtcccttttttttttcatttttaaaatgttgtcttttaaaatgcactagttttttattttgatgaggtccagtttatcttggttttggaatagtatcgaagaaatctttgcctaactcaaactcttgggggaatattttctcatgttttgctctaaaaaaatttattgttttatctcttaaatataagtctgtgatccattttgagttaattttgggtgtcaggtcagggttcatctttttgcacatgcatttctagttgtcctagcaccattttcctttgtaattttggtgtgcaggtcttgcactgcttctgttaaatttattcctaactggatatatttttgatgctattacaaatagaattatgttccggttttatcttttgatagactattgcttgcttatggaaatacaattggtttttgtatattgatcttatatactgtggcctcgctgtagttgtttattagtagttctaatggtttttgggtggattctgtaggattttctacatataagatcatatcatcttaagaataaaagccatttcccaatctggatgacttttctttttcttgtctgattgcactgtgtagaacctccaggacagattgagaatcccaagtcaaaaatctgaaatgctgcaaaacccaaaacatttttgagcatcaacaaagtctttgttgaaagttaacaaagctcaaaggaaatgctcattggagcatttagaatttttgattttcatattaggatgctcagctggtagatataattcacgtattccaaaatctgaaagactttgaaatctgaaacacttctggtcccaagtactttggataaagggtactcaacctggactgtgttaaatggaagaaataagagcacacatctttcccttgttcctgatcttggcagggggtggaggtaaagtgtttgtcttttaccattaagcataatcacagttggtttttagtagatgccctttattaggttgagaaagtttccttctagcctaagtttattgagagtttttgttgcaaatgggttttagtttttgtcaagtgttttttatgcccttttttttttttttgagctggagtcttggtctgtctcccagggtggagtgcaatggtgcaatctcggctcactgcaacctctgccccctgggttcacaccattctcctgcctcagcttcccaagtagctgggactataggcgcccaccaccacgcccggctaattttttgtattttttgtagagatggggtttcacagtgtcagccaggatggtctcgatctcctgacctcatgatctgcctgccttggcctcccaaagtgttgggattacaggtgtgagccatctcgcccggccattttttctgcattaattgacgatcatgtggcttttatcctgtattccgtgaatgtggtatgttacattaattgattttcagatattaatccaatcctgcattccagatatacatcttaactgaccatcatgtggcttttatcttgtattctgtgaatgtggtatgttacattaattgattttcagatattaatccaactgcattccagatatacatcttactttggtcatgttcgatttggtgtgtttgtatttttgttgaggatttttgaatctgtattaatgaaggatgtgtgtttttctttctcgtgaggtgtgtgttgtggcttggtgtcagggtgatactgacctcatagcatgaaattcgaagtgtaccatccctctctgttttctggaagagtttgtggagtactagcattatttctttaaacatttgataaacttgaccaggtaagccagtcttagcctgggcatttatttgtagtaagatttttacttaacccatttctttacatcttataggtcttataggttcagatttttatttcttcttgagtcagttttgataatttgtgaccttctaggaatttgtccatttcatctaaaatgccaaatttgttagcataaaatgtactattttaataagtgaaatctctctctcaatcttcctctcccatcttccccatacatgcatatatacccatgaatgtgtacatataaaatatgttgtgaccctgaacaaggcagatgttgcaagtatttattttgtttgacttatgtgttacatgtctcaatttaacagtattattaatcatagttaataaatatgaattttcttaacaactagatctgtaactctcatttgtggtttatatgtgggttacatagaaaaccttaaactctcacctataactgaaacatccatgtctagtaaattctacttcccatctcaaagagaaaaaaagtaagggatgtggatatgagtgtccccaaagactgactgtaatggtttcatgccctgcctacccatggatctctttatcctactcccccgccctttctcacccctcatttcttagaatgcttctccatgcttacagttttttgcacaatcccctggctgtatcatttaaaaactcttaaacatcaagaggtagcaggtacagttttttgttgacgacacccaggcttttcatttgccctggaagaaaagtgttgtggttgttcattacttcagaaatgaaatatataatagtaaaaatgagctcaaaagttcataagctgtctagggcaaaaaaatgaaagcatttataactaaatttcaatttagttctaaacttagttctaaactaaaaagcatttagttttattattgtgatagaagtattatcttctcaaaatgtattctttctgtcctttatcttcagggttttatacgccttttagttttttaggaaaagcacagctcaaacagaaaatacctttctctgtccttgcttgaactgaaggagaagtttctaagttactggccagtaagcagtagtcatgtatgtgtttaggtatttccccattctgaattgaaatgaatattttgtgatttctcacttggttctttgaaggagacgtatcagctgtaaaaccaaccatgtgacaattaacgtattttggactcattaatcatgcactaagatgatcagttttcagggttatttaatttagagctaccttggtgttgtgttggagaatgaattggagagaacttatttttaaaacattttgatgaacattgttgcttctggttgtattaaacacagaactagatactggggaccatgggaatttttctttaaaagtgggaaggcagggctttgcccattaggcatctattagatctatgagtacaaaaagcaagtaaatgataacatttgacgtagcatgggcatgacatactacatgaccactggcagaaatcccttatatacaattatgcaaaatagctgaagcacttattaatttaaataaaacatttaagcccttactctctgtggaaagttgtcataggacacactcctatgaaatccaccactgtccctttgaagccttatgagaaatgtttcttttaaaacagttgcaaatttaaacacttccagagtgttgcacccaaacccccagagctatagtggtttgggtgcaagtacatgttggtattcagactattgtgaatcggaaagcacatttgtgcattcgccatctaaatgagattcagtcaacaaatacttactgatggtcagatatttatttactatttgtcacgcatttttttcaaaaacaagatattacaatttagagcaaaaatttaagctttggcttaatgttgaaagaagtactgcttggctcaaacaaaatatgtctgtgaactgtcagtttgccattgccatttataatttagtacctaggaaaatttcacttcagagatgtctatatttcttagtaataaaagctgtgtgtgtgtgtgtgtgtgtgtgtgtgtgtgtgtgtatgaatgtccttgtagtatgtacttgtctgacatctaaggagataagaggcaaaaatcaaaacttcacggtaaatgtattaaccgtttttgtaggcgtattaactgttgttcagtccagtcctgtgtgtggattagtcattatgtttttgcccataataacagaacatccaacaaagagtggcttaaacaataagtgcatttattggcctttataactggaagtatagtggtagggcagtgttcagggttggtttgtcttgtcattaaacattgtcaccaaggacctggctcctttataatttaccttccattttggtcagtgaccagtttcttaaaatccctttaaattgttttcaaaacattgtgtgttcgccccataccttcttctttggtatgtttgttgctattgccacactttccccatacctgccaacctaccctgttaccacctctttgtccatttctccccagcctcagacaggtaagacagaattgtttctgaaatggaataaagaacagtcttggccgggcgccgtggctcatgcctgtaatcccagcactttgggaggctgagatgggcggatcacatgaggtcaggagtttgagagtagtctggccaacatggtgaaaccccatctctactaaaagtacaaaaattagccgggcgtggtggtgcacacctgtagtcccagctacttggacggctgaggtgggagaattgcttcaacctgggaggcggagattgcagtgagctgagattgcaccattgcactccagcctaggtgacagagcaagactccgtctcaaaaaaaacaaaaaacaaaacaaaaaaaaacagtcttatgactgctgttttcttttcagttaatctcctttcttccttaaaaaaatcacttttcatttgaattcagaaatactgtggaatttgacaagaatgttctgtagaacaagaaaacttgatgaaactgagtcagaaaatgaatttcagaccccgaaagggccttgaccctggagtcaagagccctgttctgaattctggccatgacaattttgggttttgtatctttggatgaacatttcacctctctgggcttaattttctgttacataaatgggagttgcaaactccttttccaaaatgccagtgagaattccagagaaagtgtatatgaaaaacttctaacatagaattgggcttaggacaaatactaagtaaatattttacaaatttctgcattgagtcattttcttttggtttcatcactttgattgagacccagacttttgaagctgggccctggaattctgtgaagtccagcctgggtatctttttgtggctaccattaaaccccaaaccagacatttattaagacttgtgaagagttgagaagtagttaatattggatgacttttctcgtgggtttttaattgttattcatctaaactttttgtggtttatgtaatatttcttacctcctttggccttttgtttaaaaggaggtgggggaaacaaccccagaaaggcttggcatcttttttctattgcaatcaaaatttaaaatgaaataaaataagaactgttttttgttttgttttgttttggtttggttttttttttttttcagatggagtcttgctctgtcgcccaggctggagtgcagtggcacaatctcggctcactgcaagccctgcctccggggttcgccattctcctgcctcagcctcccaagtagctgggattacaggcacctgccaccacgcccagctaatttttttttttttttttgtattttttagtagagtcggggtttcaccgtgttagccaggatggtcttgatctcccgaccttgtgatcggcccgtctcagcctcccaaagtgtcaggattacaggcatgagccaccgtccctggcctgttattttgttattttaaaatactcataatttattatgctgctatactgtttttttctgtttgtttgtttttgtttttttttgtttgtttgtttgttttttttggagacaaggtcttgctctgttgcctagactggagtggagtggtgcaatcatggcttactgcagcctcgacctactgggctcaggtgatcctcctatctcaacatcccaagtagttaggactacaggtgtgtatcaccacacccagctaatttttattttttatttttttttagagatggggtctctctctgttgtccaggctggtctcgaactcttaggctcaagccatcctcctgcttcgacttcccaaagtgttgggtttacagacatcagccaccacgcctggcctgctatatgttttgatacgccttttggtcatatgtttgttttatctgtgattcacaattattcccttgtcacccatcaaaacagcattatcagtggcatgaaggttgttggaactacagtcatttcaggctgtgtcacaatagaaattgttaagagctgtccatttgtaatgaaaactcgaaaatttttcatttttaaggcatctcctgtcttgtactcattatgtctcatccatggcctggaatgtcttagcgattttcacacttctatttagtggcaaaatcattccttcaaagacagctttttcatgggatcccctgtataaaacagaccaatctggatgcctgattttttagagtgggtttcagatggaaatgggggttattcaagaatgaaaggaatctccgcagatctcagaatggaaaaccactccagtctgagtttgttttgcattttctgagtttttattgctggtgctcaggtgctaggttcacctggtcggcacatttcttcctcatttcatttactaggggccatgctaactgttgctccagccttactagcagtctaccatcaacggtaaaagcattcccttctcaatctttgtgcaaaagtttccttccaggttgttgagttgacccacgaaagtcatgacgctaatagaattgtcttgacacaaaaacaacagcattgaagaaatcagaaatggtgcaggctttcgggtgtgggaatgcttttttctctcttgaatgaagttgctgaagagtggtcttaagttatcctgttctgtaaccaacaggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccaggtgagtacttggctttggcactttaaggtacccgaaattgtaatgccttaactgtcttggctcagatgggtatctacttaaataaattgccatatagtaattttttaaaagcgtgcctcttagtttgcatcacattatttcatagggatttaagaaacaaacatgaacacaaagacatacatacacttcggctgctttaagcattatgaagaatcttttgctctcaaagagttgctattcaaatacaagtttgatctagggtgctgaggagtaagacagctctaccacctttctttgttgttccactctgtagaagtgacagtctatgtagagacgagagaagaaactattatagaagacagaatttggtttggtttaccccttcctgttgggctgctgcagtgggcttcacagaaagcgaatctggtcctggggatagagcataattatggtgacaacacccatccttctttcccatttctgtttctgtttctttctctgatactgtgtccagtgaaacagtttctacagaagctacctcctccttaagttctgccagcttgctactgggccaaaatttctcatatttgaattctataggctagattcagaggcaacatgattttcctgatagtggtcatttggactaaaaaaaggcagactgttactacttcagaagataatgaatactgttttgtttttgtttttttgttttgttttgttttgttttgtttttttgagacagagtcttgctctgtcgcccaggctggagtgcagtggcgcaatcttggctcattgcaagctctgcctcccgggttcacgccattctcctgcttcagcctcccgagtagctgatgagtactgttttatatgaaaataagttaaagaatatagtaaggactgtaagctttgagttcattgatgtgaggctggtttctaaaggaaaaaagtcaagtagggtacatgttgtgttatgtctccctccacccctcctctcttcctgcacccctgcccctcccgccccccccccgccccccccgctttcatcttccctcccaccttgcacataaataagattcagtatgcatgccctactggaatgaaatgtgccaacatttatatgtaattttcaaagctcaattaagttaggaccttcttcctctatttaaaaactcttcaagggagttcaagtgattcattcaaataaagtttggtttattgtgtgcatgtgtgtgcacacatgctcactcacatgtttcagaacggatgcagtctataaaccgaggtacactgatgtatctccaggtcttccttcagtgctgtgattgccctttttactttgtacttcagattcattcagctgaaactggagcgtgccacaccagctgagcgccagcttgtcttcaatgaaatcctccaggctgcctaccaactcatggtggatgtgtttggtaattacgtcattcagaagttctttgaagtaagcctttgttctttctatcctttgacttaagagaatctgcagagcattttgattttcattagcctttttaagcatagcagtcccattccagtcctcagaatgaagggtgtgtggtctttttgaagaggtttttagtgtttttccaattcattagcagcagtctatctattctgtatggtttaaatatccgagcagataatgccaatctattttggaaatgtgtttcgaaaactggtgtccccatttaggacccagcacattatttcagattgttataatagtttcacaaaacgtgtcacttaaggaggaaataatccttgtaaagtagttttagcaggatcacaataaaatattgccaaaaacaaatttttctaaggttcttagagaattgtctttggacaccgactccagtatgtttcattatcagctagggtcacaagaattgttaaatgctgcttcttggctgatcgtttggccttgatttcttgttttacttctgttaatttgaataatgttcacttgttgtatcattgtctttggaaagaatgagattgttaggttgatgtcttttccctctagtgaggtaaaatttcagagaggcagggacttttttgcttaccattgtagcccttattatctggtattggcaaccctaaggtgtagatgcagaatggcacaaaacttcgagatgaggaggagtctggtatggggaggaaaatgctggaattctgcacattacctaccacaaaacaaatttgtaaatgtcttaacatctcatcctgtttgatttgtatgaagatgaaaaactgacgtactcaagttttaccttcccaagttttttcatgaagacttatgttttttcaccctgaattcttcagctttggactaagaaaccaatctaaacatgacttttgtatttttgattttagaatgactttgcactgccgttttgtcacatatataaaaatactgagctttctagttctggaggctgatgcaccttggggtgacaaaatgtacaatggattatagccatatgatttggaccaagcttgagaacttctctggatcttagtttcccttgggagaatgaggaggttggatgggctgagaattcataaagtctcctccaatctcacgattatgtgattgaaatgaaaataataagccaaggatggaaaatcattctaagtagaattttaacattgtgtagcctcacttcttgattctactgatttttcccctcccaactctgttaccttgtgtaaataggagaaaaaaaaatcaattctcttaatgatgtagaatactatttcaaaacagtgtgtccatgtgtgctttggcagtaagagtgtaggattcttttttttgacacacagtcttgctccattgggcaggctggagtgtagtggtgctatctcagctcactgtaacctctgccgcctgggttcaagcgattctcctgcctcagcctccggagtagctggagttaacaggagcgtgccaccatgcccagccaatttttgtgtttttagtagaggcaggattttgccatgttggcgaggctggtctcaaactcctgacctcaggtgatccaccctccttggcctcccaaagtgctgggtttaccggtgtgagccactgcacctggccagattcatttaatagtatgaattaatgacagctttgaggaattatgtgtttgcttagcagatattaatagtgaaactacctattgttgggtatccgagaaacttcttaacattaaaaagggttactcataattaagagatcgagaactactggcttgaagaagcaatggctctttaaataaaaggtttagttaatcatgggtatcagggctaaaagaggttatgccagtggttgatgcagaataatgaatgctttgctttctctggtttatttccttctacttaagtaatggtgtttacccacacattatgtctagtttggcagtcttgaacagaagctggctttggcagaacggattcgaggccacgtcctgtcattggcactacagatgtatggctgccgtgttatccagaaagctcttgagtttattccttcagaccagcaggtaattgtaagtttcccctttaacttttctcttggtgtttgatgtttctccatggtacatgtagtgaaccctgtaattctgtcaattttcagttttcttttatggttttgcattgttgcttatggctgcctttttgtgcatggcaagcatgaactgtgcaaataatttaaacttgttgcagatcaagtatcttgtattaaaacctgtggtatccaatactcttccattggctagaacttagcctttaataggttcaattttataggtggtttttttttccatgaataaagcaggtaaaatactaataagccatcattttctccaacaagtcaaactttcatccaacccaccttccatatttttttactccttctctcctgttctttcatcccaccaacatctattgaacaaaggcctgcccagcatggtgcatagcctggtacattgacctgaagcccactctgtgccagacttcatcagcacagagatgactaacacctgatccctgcccacagagtgcattctggtggggaagagccatggtggtgagcagtggtgaggacatgagaaggacccctcacccttcccagagtccctgagggccggctttgcaggagaaggcaaggctaaagaagagttagacagggaagaaggaacagaaatgagaatgcttaggtgctgtgagtggggaactgaaagagaagtcacctgaacaggcccacagcttcttgacaagtcacggcgtgggtccagtgagcactgcagacaccacagggcccaggaggcaaaacagacccacaggcagggtgtgctacagttgtgtttgtgctgggcagtgcctccagcctccggtgcttctcatctgagcctgcagcttttgggctctgaactcactgagcccttctcaattgaggggttggttggccattgtctggcaatgatgacccacttgccctcactgagaacaaagttcggtaatgagaatctttgttaatggactcaagttctgagccagacaagacacccaccacccctgagtcaagctaaaccaatccaaaccactgcactggtgttggcagtggcagttgaaggctgaagaagtccaaagtttttaaagtgataagtttcaaaggtatgtgccacgatgctggtgaagggagaaaggaatgttggagatagagcaggtctggagttcatttattcagtgcttagtactagagatgtagcattaataagaaagtataagtaattagaagcaagtgtgaagctattttaaattttcttttaatgttcagatcattgccaattttaatttttcttggattttcatagatagttgaattgttcttctttaattttcttgtttttctttctttctttttggagacaaggtctcactctgtcacccaggctggagtgcagtggcacaattgtccttgttgcagcctcaacctcctgagctcaagtggtcctcccatcttagcctcctgagtagctggaactacaggcatacgccacttcccctggttaatgtgtgtatttttggtagagatggggtttcaccacgttgcccaggctggtcttgaacccctgggttcaattgatttggcctcccaaagtgctgggattacaggtgtgagataccatacccagctgtcgttgtttcctgtgttatatttttgcacatattttttctggtcatgtttctctgtggtgtcttgttctgggcctgacttatgcttcctaccctttattattttactcttctctagatgcaaatttgccattttgggtaaaattaactcatctttgttggaatttttatttcttctggatcacaaaaatatccagggaagccatctctccttcattttgtttataagtattctttgactttatttttgtataagcttcattgtcataattattcccacaattcccatcattcctataattgtattttcagagtaaattattctcttctgggcccagcacagtggcttatgcctgtaatcccagcactttgggaggccaaggtgggtagattgctagggcccaggagtttgagaccagcctgggcagcatagtgaaaccccatctctataaaaagttggctgggcatggtggtgcactcctatagtctcagctgcttggggtgctaaggcaggaggatcgcttgagcccgggaggttgaggctgcagtgagcagcctgggtgacagatcctaagagaccctgtttcaaaaaaaaaaaaaaaaaaaatttattcccttctgacacttggttaatcactgtgtctcttgccttttgcttctttagcccctgccagtgtaatctttaatttaattagatgatatcttagttgctttgaggtactcaacattttgggcatttaagacattgtattcattaacatcactattttgatgtgacttgcagtcttctaacataaatccactggcagcacagtttagccaatgtacagagattggagacagcagggaaactgggcaggaggcaccaggtatagccatggtgcaggcatttaatttcaagatacctaagacctggggcaatgagtttgggggaagggctccagtcaaaatcccagtgtctctctttctatatatcctgtcaccatcacccatttcctactcacagactcagtttctggccatttcatttacttcctttgtttgcacacttttcattaattgagaaccattcctgctgactctgcagtcactgtgacctagtagtaagatcataggtgttggagtcacagcttaggctagaattctaattctgtcactttctatccatagtttgaaatatgtgacttaagcccctctgtctcagtttcttttatataccagcagaggtggggtgttcaggataatgtattgttgacagtttggtttactgatatagtggtttaccatacagttcagccagattgcttgggtttgaatgttgggaatctaggtctatagttttgtaagtcttttaatttgcctcttccttggtgtctccatctatggtggtgtccactccgtaagactgttaggaaaatttaattaaaacatgttacacggttagaggtatgcctaaccaggggtaaactctagcttaattagtatcattactagtcatactttacagagttatcataataaaaacacgattaattgtatgtgaaattctttagtttggtttagttttatttttagagacagggtgttgctctgtcacccaggcttctggtggtgttaccgtagctcactgcagcctcaaactcctgggctcaggtgatcctcccacctcagcctccagagtagctgggattatggctgtgtgccatgtagaaattctttaatacagtgtgcaaatagcccctgacttatgatttttcaaaactgtactttgaatcttttttattgtttttattatatatatgtatataagtatatatataaaataattttttttttttttttgagacagagtctcgctctgtcgctcaggctggagtgcagtggcacaatcttgcctcactgcaacctccgcctccacggttcaagaaattctcctgcctcagcctcccgagtagctgagattacaggcgcgcaccaccatgcccagctaatttttgtatttttagtagagatggggtttcaccatcttggctaggctggtctcgaactcctgaccttgtgatctgcccacctaggcctcccaaattgctggggttacaggcatgagccactgcacctggcctatgatttttttttttttaattataggctctgtgataaataattttgtccaactctagggtactgtaaatgctctgagcacttctgagggcctaggattagctatgatgttctgtaaattagggatatttaaatgcattttttagttaatgatattttcaacttataattggaatgtaattcttttctaagttaaggagtatctgttcctgatgtaggcttctttgtatttgaagatgtctaccctttatttttttttaagctctaggagttggccgggtgtggtggctcatgcctgtaattccagcacttggggaggccaaagagggcagatctcctgaggtcaggagttcgagacagcctggccaacatggcaagaccccgtctctagtaaaaatacaaaaattagccaggtgtggtggtacacacctgtaatcccagctactcgggaggctgagacaggagaattgcttgaacctgggaggcggaggttgcagtgagctgagattgtaccactgtactctagcctgggtaacagagcaagactccgtctcaaaaaaaataaaataaaaacacaaaagcactcttaagaggcttttctttgttttttgtttttacaggtgtgagatctttttggttactggttattgttacagtaaatttattgttggaaattttactgtaaattggctaatgtctgaaaagactcaggtcctcatttgtttccctgttgtcattgttccacagctgctattccactttcatcatcacagattctctgttcagtagtgctttcatgtttggtgaaaagaatattatttgtccacatgtttgcttgctgtgattctggtggtgctttctttgtctccattagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtaagtgacccaggagagaaataatggaaacaaatttatttcctttgtgagcagaaaacagagtaggatttgtggcatgttctcaatatgcttaatgtactttattttttttgagactggatcccactctgttgcccaggctggagtgcagtggcaccatcacggctcactacagccttgaactgccaggttcaagcaatcctcccccctcagcctcccaagtagctggaattacaggcacataccaccacacctggctcatttttaaattttttgtagagacagtggcctcaccatgttgcccaggctggtcttgaattcctgcactcaagcaatccacctgcctcagcctcccgaagttgctgggattacaggcatgagccactgtgcctgatcttaatgtactttagactgcagtaaaaagcagtcctgtatagtactgtcaggtacctgtctgtgtgttgccaagtgtctgggtctcggtcttctttccgtcattaatgcagttgtctgctcacattgggatgaaacaccatcataagagtttttaagatgaaatctcatatttgaagaataaattatttcccttggttaagtactatttattctgatatttcagtgctttcgttttaaatttggtttaaaattcaggtaatttacggtactaatgttgtaggtcatgtgtgaatatatctttaaaataacaaggtgctttttgcttaaatttttttggaagggatgcagtccaggttggtttgaattgtattaaatggccaaataaccagagataacttctagtttctcctgttttcctgtatatcaaaaatctcttcttagcttcagcttccaagtaagattgttacttttatatgtaaatacctttttccagaattgcttctgaattggctatagttttgtgtttttttgtttgtttgtttgttttgtttttttccaaaacacaaagtccttacagtctcctaaggtgggtgggacaggacagtaaaactcagctcccctttgggtgtgtgaaattggtctttctttagggaagggggaaaaatgagaaaaagcacatagattttcaggtataatttatgtactgctgagtatagagtgatatgtgatgtgtagtaatctttaggttttgctgtttgctcaatgaccacaatggttgatcactgacagcaacccacgtggttattgggagtttctgagttaaagaaaaaagggtagatctgtttaccttaacattaagatgttacatttatggaattatacaacaaaaaagataaaacgataaatccaccaggagagaatattttcaagatgcgacggtcaaaggattgataactagaatgtataaagaacctctctaatgaaagaaaacaatacaacatgatgtaaaagtgagcccagaacacaagttgacatttcatagaagaaacacaaattgccagtagacatgaaaaaatactcagttccattaggaacaaggaaaatgcaaaattaagccacaaataatagactattatttacccatcagttgctatgtgctgacaggaatgaggtacactgctggtgggaatagacattggcacaaccattttggaaaataatttagtattgtctttcaaatttcaaccttcataatttctgtgatcctgttgaaatatctgtacatgtataccatgagaccttttagacatgtttaaacaccattattctcttaaaagacttaaggaacccagaagaccatgagcaggggattgcattttttaaaaatgtcatatacatggccgggcacggtggttcacacctgtaatcccagcactttgggaggctgagacgggtggatcacctgaggtcaggagttcgagaccagcctggccaacacggtgaaaccccgtctctactagaaatacaaaaaattagccgggtgcctgtaatcccagctacttgggaggctgaagcaggagaattgcttgagcccgggaggcggaggttgcagtgagccgagatggtgccattgcactccagcctaggcaacaagagtgaaactctgtctaataaaaaaaaaaaaaattctttgtatataccatgcagaataaactacagaaactcacagtattgtaaatgaacatgggaatcataatgttgagtgaaataaatcaagttgctccagactacaagtgtagcatttttataaagctaaattcaaggagaaccatacagtatactatttatctttacgattgtaaatataaagctacatgtataaagtcacacataaggctaggtgcagtggctcacacctgtaatccaggcactttgggaggccaaggtgggaggattgcttaaggctaggagtacaggaacagcctgggcaacatagcgaatctccgtctctacacacaatttttttttaaagtagccagatgtggtggcaagtgcctgtagtcccagcaacttgggaagctgaggcaggaggatgacctgagtgcaagagctcaaggctgcagtgagctgtgatcaccattgcgctccagccttgtctccaaaacaaaacaaaatcatacagaaagcactgggtgtgatgacttacacttggcaagcatccagtaagtgttagctgctattattgctcttattattgttcttgattacagttgtgagatgtatgccactaagctaggaagggcagaatctcaagggtagtgtgcttttctattgctccaaacccagcaaaagaatcttttcttattgctgaaaaacatcacagttaaatcagaacattgcattctggttgttctggcggtgtgaaagcattcaggatttggtcccagtccttcccttttctgttgttagcgctgtcttttggagaggttgtcagttgacacacttgactcttaactaagtgtgtttttcatgactttgactagctatctgtttcttggcggcttggaaaagtccttttcagctctgaattgtgcacatctatgaattcctaaaatagataagcgatgagtttattgatacacacacaccttattatatgtagagagaacttaaatgccattaagttcatttgtgaagattagtgggataatacatatatatatatatatatatatatatatatatatatatatatataaacaatactgaagcattgaaggtggtgactgtcatttttgcttctcatttgtgtttgtctacccttaggtatttgccttatccacacatccttatggctgccgagtgattcagagaatcctggagcactgtctccctgaccagacactccctattttagaggagcttcaccagcacacagagcagcttgtacaggtagtggagttgccagtagaggaactgcgaacacctgtgggcttgtgcagggccagagtttgtgtgttttgtcagtgtaggttccagaagaggttaatgtgttttaaatacccttgaatcttgtggttgtatttgtattcagagcagcttggtttgtgttttatgaatatgggtagtgaattgagccctagccctggagtcaggagatctgacttccagaactctgtcatgtacttgtggtgtcaccttaggtagacatttaatccctctgggtctctgtttcataatcgttaaatgaaataagttgatttgttgatttcttgtttttagctttgatacattctctgcttataccactgattaaataattaggtatgcccttgttttttgttggacataaatatttccagtttttctctgttatagataggtgcagtgaaccatttgtatatgtgtttgagaaaaatgaatatttactgccataacactccctccccttttaaaaatgaatatgtatattctattgtctagtaataatatgttcctgttttgtaataatagagaagaacgttactacctgtcttaaaaattgtgtgttcattagtattcatataaaccgttatggtggtaaaagaaagacaggttttaattagatataaggacttaagtaacctgcagaactggctttcacatacattttatttctcttactgtttctcaaacaggatcaatatggaaattatgtaatccaacatgtactggagcacggtcgtcctgaggataaaagcaaaattgtagcagaaatccgaggcaatgtacttgtattgagtcagcacaaatttgcaaggtacgtgctttgagttacaaggactatttcccagaagagaggattagtagtattgaactataattatcttattttttaatgttgttgttgttgttgttgttttcaaagtatatatagcttaaaagtcaaatagttttattacaaagtataaactctgagaggtcccttagtgggcttcttactctgatagagtcagccactttgaaatctggggaatatgttactaaagaatgtgagtgttacactttgatgaactgaatattttattaacttgtttgtttggaattgtgaaatgttgtttattcagtttccctttttagcacctgaaagaaaggcagtttaccatatgcatatctatatataggccttagtattcttaggatctcttttccagtcttcatattgtgcaagctcaagaatgaaatgcagtagttattcccaggttgtgaaaggtgtcttaggtcacttataagtagcagaggttggagaaggaatcaatggcccttccatgtggatagtggtatagtcttctgagaagatactgtatatgtcctactgcccacataacatactattttttatttttggaatatattcttccctggtttttagaataaattgcaaggcaggacaggactcatacaaccttgatgtttttaatttatgttattttttgagacagggtcacgctctgtcgcccaggcttgagtgcagtggcacagtgtcggctcactgcaagctccacctctcaggctcaagcgatcctcctacctcaggctttcaagtagctgggactgcaggcgcacgccaccacgcccagctacttttttttatttttgtagagacagggtttcaccatattggccaggggctggtcttgaactcctggacttaatcctcccacttaggcctcccaaagtgctgggattaccagcacgagccaccagtacctggcctcattcattttaaatttgtgaaattttataacatgtcacagcatggaaaaacagagaaaagaaatgaaagtacctgtagatccagtgtctccatagcctagccctatcagggttatctcttacgactttatattgttttgttttggggggttccttttgaccggttgccaggactgaggaatggggatcagaatctcttgggttctcttcttcgggtcagtctcctgtttacatttttgttcacagtatttaatttctcacccttggatatagcctaagcattaattaatattacaacaaattcaaaaacaatttaaaaaaaaagaagtttttatttttttaagggacagagtctgttgccctggctggagtgcagtggtgcactcctagctcactgcagcctaggattcctgggctcaagcagtcctcccacctcaacctcctaagtagctgggactgtaggtgcacaccaccatgtccagctacaacaattaataactgagtagctactgtgggcccagtcctcccattgataacatgtgtaaactgtggacaaaaatacaagaactacctgaagacactagagagtaaccaaagggcaggtggagaccagagaggtgggggctggcatttggaagaagagaattgcactggggaaatttcttatttctgatggctgttagcctgtggtcacttcccagtcttttccatgctgggcagctaaagctggaataggcaatcctcagggcagccacaacaaagagaaatcctagaaagggagagagccggaaggggttcgggggggcccagttttaaccttcccccaagtccggctgacccctgaaccacatttccagctaaggctgaaagaattgaactgggatttcagctgctgcttactgtatgggagaagtttgtagtttgactatagccaagttaactgcactaaaacaggagtggagggcacttctctttggtggaacatagcagaagtctgagtttctgtagcctgttattcgcagtgtctatctggataataggaaaatgtgacctatactcaagaaaaaagaaataaaaatcagtgggtagtctaaaatgacccagttattggaattagtaaagaaggattatacagcagctgtttaaatatactcaggttgtaaaggaaaatatgctgtagtgaatgaaaagataggagattttagtagaaaattatgtatgtatgtatgtatctgtctatctgtctatctgtctgtctgtctgtctgtctgtctgtctgtctgtctgtctatctatctatctatctatctatctatctctatctatgaatgagatggagtctcgctctgtcgcccaggctggagtacggtggcgcaatcttggcttactgcaagctctgcctcctgggttcacaccattctcctgcctcagcctcccgagtagctgggactacaggtgtccgccaccactcccggctaatttttttgtatttttagtagagacagggtttcaccatgttagccaggatggtctcgatctcctgacctcatgatccatctgccttggcctcccaaagtgctgggattacaggtgtcagccaccgtgcccggctgagaatcttattttaaaaagaaaaaataggggctggagacggtagctcatacctgtaatcccaacactttgggaggccaaggcaggcaaatcacttgaggccaggagttccagaccagcttggtcaacatgcggaaacccatctctactgaaaataacaaaaattagctgggcgtggtggcacacgcctatagtcccagctacttgggaggctgagtcaggagaatggcttgaacctaggaggtggaggttgcagtgagtcgagatcgtgccactgcacgccagcctaggtgacagagcgagactgtctcaaacaaaaattttttcaaatggtggaaaaatttactttgtactctgggtcaccatcaaaaatgtctgaaagcaggaacagtggctcatgcctgtaaccccagcatgttggaaggccgaggcagaaggattgcttgaggccaagagttcaagactagcctgggcaacacagcaagatcctgcctctacaaaaataaaaatagggccgggtgcggtggcttatgcctataatcccagcactttgggaggctgaggcgggcagattgcttgaggttgggagtttgagcccagcctgaccaacatggtgaaaccccgtctctactaaaaatacaaaaattagcccggtgtcatggcggacatctgtaatcccaggtgctcgggaggctgaggcaggagaagaattatttgaatccgggaggcagaagttgcagtgagccgagatcatgccattgcactccagcctgggtgacagagtgagaccctgtctcaaaaatgaaaataaaataaaaaataaatgtctgaaagccactgatgtatttttttgtttacttctattgatctattttcaagttcattgactcttctgtcatctctaatccactattaaagccatacagtaaattttatttctgatgttatattttccttttctaaaatttctatttttacttaaaaaaaaattacttatttgaggccaggcatggtggctcatgcctgtaatctcagcactttgggaggctgaggtgggcagataacgaggtcaggagttcgagatggagtcttgctctgtcgctcaggctggagtgcagtggcacaatctcggctcactgcaacctccgcctcccgattcaagcaattctcctgcctcaacctcccaagtagctgggattacaggcatgcaccaccatgccctgcttggcagcagggagataggcataagtaaggtttgttcctggccttggtgaactgacaaaggcgaggaaagaatggacagattttggtaagtgttaaaataataaccagctggtggtgaaccagtgtcctgaaccttgtgcttaagtctcctcacctacctgggctccttacccttacccgttagagggccgggtcccatgtccttgaagacctggtctctctgggtggtcagtatgcagtagtatggcagtgtataatttgatcaccctctatagtccccgtggattggagaaaaaatctgatttaatgccacgttccccctttcctacgattggatgccacagatggcacaggtggagagtcagagactgagagagtcagacagttggcgactcatcttcctcaaatgttaaatagctctctctccctgctggtccggaggtcagggcagaagctaggcaagcacagcctcactaacaggggcctctcttgtaagagttgtccctggttttatctcattacagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataaggtaggccgggctgggcagggtctcagagaaagtgtgcaaggccttggcttcctttctgaaacacaaaggagggtgggtgccctgctgtttttgaagagtttgtcactgacctctgtcccatgctgtgttctgtttttcttttatgtggagtcaccattgtccttacacatttgccaaccctcccttatcaatagccacactggtatgagaatcttaagctacattttttgaaatatttccatccctgatctctagagaatcagcttatgagtccaacaaatcaacttgcctcatttccttttctcactcctcccttctgttctttcatcccaccaacatctattgaacaaaggcctgcccagcatggtgcatagcctggtacattgacctgaagcccactctgtgccagacttcatcagcacagagatgactaacacctgatccctgcccacagagtacattctggtggggaagagccatggtggtgagcagtggtgaggacatgagaaggacccctcacccttcccagagtccctgagggccggctttgcaggagaaggcaaggctaaagaagagttagacagggaagaaggaacagaaatgagaatgcttaggtgctgtgagtggggaactgaaagagaagtcacctgaacaggcccacagcttcttgacaagtcacggcgtgggtccagtgagcactgcagacaccacagggcccaggaggcaaaacagacccacaggcagggtgtgctacagttgtgtttgtgctgggcagtgcctccagcctccggtgcttctcatctgagcctgcagcttttgggctctgaactcactgagcccttctcaattgaggggttggttggccattgtctggcaatgatgacccacttgccctcactgagaacaaagttcggtaatgagaatctttgttaatggactcaagttctgagccagacaagacacccaccacccctgagtcaagctaaaccaatccaaaccactgcactggtgttggcagtggcagttgaaggctgggggagtcccaggttcttaaagttgtaagttttcaggatgctggtgaaggcagagggaatgttggaggtaagtaggagcttaagacatgtctattcattcattcattcagtgctaaacacctgttgtacagcaggtcgtattctcagcagggttgtattggtaaacgtgatagtgctgtgcacagatagttactgggacactggagaaatacaggggaaagggttgtccaggaatgggcagggtgtcttctataacgtgtgggtacagaggaggctctctaacggagtgatacttaatagagtgatgaccctttccagaagagggaacgtggtgtgtgaagacttggacgccagagaccagaccgtgttgtatctgaagaagtaaaacaagttcagtggaggaggagtgtggtgacaaaatcacacgtatatttcaaataattgtcctggctgccatgtggcctttgtagtttagaggagggaggcagtgatgagaccacatgggaggccgtcaaggcaccagatggtggtggtttgggattgaagagaagtggacagaatagggtgctagaattggtagggcttagcagttggttggctgagggagttgacggggagagtcctgagaagccctcttagtttttcagctcttccattactaagtggtatccttttcagcaaaagggacataaggagagaagcaggtaattaacgtttcacttcttgttaaatccaataaaaaatggagttcaacatgtgtgtgtgtggcttgttaggggttttttgttttgttttgttctggggaagtacaaaggtgaagtgcctggacttgtcagcagccagttccagggacagaggaatggattggatttcagttattttctaaaaggaaagctaccaaaagcaaggggatcttgaacctcaagttctcatgacagaaacattagtaacatagtattacaactgaaaggaaagtatagcattattgcatacgccgttttacaggtgagtttaagggaggtgaaactggaaccaaggactgtttgccaccagccagtttcccctgtaggctccaaagtgggaatgtgacacccgatgcagctctgtgtcctgggaagcatgcgcaggtgatttctagaccggatcaacccttccttgctttgaggacacagctaaacagacaaaaattggtgccctcatggagctctcaacctggagagcctctgtctactgcggtacatttatccagtgcgtttatgtatgcaggtgcaggtttggatggggaatctgatgaataaactgtggtcctttactgtttatatggaaagattgataattaagcaaaagatagcagacacagctgaggtatgtagaatgctccctgagctcacagaaaagaaaaggggcttccagagaagaagcacctctcaagttttctggaatgtaggacttcttgaaatgatcagcccagggaaggaagaacagaaaggaatgcttggagaagtgactcagagcataggtcggagagcctgagggatgaggctggtgtggcgggcgtgccttgagagcacagtggggagaaacctgattcgtggaggagccacacagtttgggctcagctatctgtgctgtcctttgttagccattcaaccttggctgagtgacttaactactctgtgccttcatgttttctgtcagtaagatggggataatcacaccagctcatgatgttcatcatttctcttcttgtcattgattagctttctgtgatccactgtgacctggagagacagggtcaagtggtgagctcaggattctggtgacccgaaataacccccactgctcaggagagcctggatgccgtgcatggggccagaggggcctgtgctcatgcttgcagggaagcactgtgcagctggcgggtagtgggcagtgtattttcccagctaggatgcactttctccatgtgttgtcctgggagtggcccatggccacccagcctccagggtcctcaggccctgtggcaccactcagggtaggagctcctctcctcatctgatgggttgccaaagtgctagaagtcaggggactgggctgagccagtgaaaggtattgctgtaggggtgtgtgtgtgtgtgtgtgtgtgtgtgtgtgtgtgtgtgtgtgtgtatgtgtgtgtgatgcatgacatgcaaatgcatgtccgggaagcctgcccccaagtctcatctcaggccatgtaacacagactgtctttcctccccagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctg

SEQ ID NO: 35801 - DNA, 3641 bp, Homo sapiens
gggcggccgacgacgttcgtcatttagtgcgggagggatcctgaaccgcgcggccgaaccctccggtgagtggccgtggcggggcggaggcggcggggcggaggcggcgggtcggggcggggaccggcggcgccggcgggggcggggggcgctgaggtgggggcttccgcctttgttcgcgccccgccctgagcccgcggcagggtctcggcgggcgggggcgcggtgacagcgggccagggcggtgcgggctagggcggggccggggcgggaccgggcggcggcggccccggccccacgtgcgggtcccgggccggaggggcggcggggaccaggggagtgccggcccctcccgagcggtccggagcttctttcatggccgccgaggcgcgtggggcccgggccagacctgagggcccctccttggggacgcggggggcgccgggccggcagccgcggtccatcgcgttcgggggcgacgcggggattggggcgcggcctcccccagcgcccgggccacgcccggcacggattgcgggccctgcggaagtgcgggccgcgccctaggatcccggcgcctacggctatcctcgcgcggcgcggaggccccagcccctggaggaagcagggcggcctggaccccggcctgggtgtcccgggtgtgctgctccctgacccacctcccacgctgccgggaaggatctgagcctgacagatcccctgccgggtcagtgctgccccgggcactccgggcccaccatctacaagagggcccgagagtactgagtggctgtggtagctcccaagttgtaggtcacagaccctcacaattgtggagaaaccgcagatacttaggatccccgtgtccaggtggccccgtgcggtattctagctgcccctaacatccgagctccaggggcatcctgtttgaaagatgacgctgagccgaccacacacgtttacatgtgactaccacggccagaggagcaaccctactgagggataccgagccccgttaccccgtagggcgagggcctgggcagctcaagagcggcaagaccctaagagagggtttagtgtgggccccgccggttgattctggggcctgctagccccgccccacacatacagggggctgctgcctcctccatcgtggagggggaggtgtgtcctctctccccatgatcggctgcagttcccattttgtcttagatgttatacctggggtgggggcacctcacactgccccagaggatgcccctgagcaggaatcgcgggggtggagaggagcgaaggtggcccccttggagcccttttggagctccggctgcagcccacactcctgctcagaagtgcgcctccgttggggatccaggtccaaggcctgtcaccgtcccgcccacaggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcaggtgagtctgggctgcgggagccgggtggccgcccgttcactccagctgtcttgccgctccccagcccctacttccactggtgggggtggggccctcacctgctgtcactccccagaccccaacgtccccaacgtcgtggtgactggcctgaccctggtgtgcagctcggccccgggccccctggagctggacctgacgggtgagtgccctgcggccgcgggggtccgggcggcccctggtggggatctcgggaagtgcagccagggggccgcgcagggctggggcttcgcgcagggctgctgggcagtcattgagggggaggtccccccaacaggcgacctggagagcttcaagaagcagtcgtttgtgctgaaggagggtgtggagtaccggataaaaatctctttccgggtaagctacaggctgctgtggccagggaatggaggcggggctggggctggggtccggaccgaccttccctgatcctcgcttcgggtcctgcaggttaaccgagagatagtgtccggcatgaagtacatccagcatacgtacaggaaaggcgtcaagagtgagtggggccccgggcagggcagagggggccgcttgggtgcgtgctgccaggcggggaagcggggccgctgaccgccctcttccttgtgccgcagttgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacgcccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagg

SEQ ID NO: 35802 - DNA, 41530 bp, Homo sapiens
ccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctggtgagggccgggcgcgcgcgcgtgaatggcgggctgtggtgcgggggctgggattcgggggttccggggctccaggggctctgaggctcagggcccggagcccgggaccggagttgcggagcgggggcaggctgagaggctcgggttgtgccccccccgcgggaggagactgttctttgggcacggggcgggcctccgctcgctgggccggctccggacgccgaggaggccgcgggcccccgcctccccggcagcgccaatgtgtggcgcttcgtgggcgtgaagccgcctcttatcctcccttcaaaacaaattcccggctgttaggagatgcgggagaggattgagtccctcgcggatgttgtgactttaattttgaggtccctgtcgtaactccgaagtaacgacgcggggcggaggatggcaatgatagcgaccaacgcgtcccgagcgctggtcacgagcgggtttacacacggaacgcgcaccatcttcataccacccgaggagtgcaaacgctatttccaccctgctttatttttaacagatgaggaaagggagacgcaatggggttgagtaacttaccctgggtcacggagcgagtggcagggctcccgcaggctgcgtgactgtcattgctctcacagtagacggtacactcgcttgtttcattaaagacgttaggactgtgccttttgcattggtgtacgttgacaagccagtgctattttgaatcgttatttctactaatgcaaactttttagagattggagatgttactggcccttcggtgtgagtttaaagtgtcttaagggctagtggaaacatggaatgaacaaaaaagtacgggtggccgactgagtcattgtttctttcctttatgtattatatatttaagcaaaaattagataaaacttaaaacatgatacttttttaaccatgtgtaaaagtttcctttcacagttctcaggttaatagtaaatgaaattgtgtatggatgaaggcttgaattaagggaggcagcaaaaattcaataaacgtttgccatgtatcatttaagaaaaagaacagaacctgggcaacatagagaaaccccgtctctacaaaaaaagaaaattagcggggcgtggtggtgtgcgcctgtggtcccagctacccgggaggctgtgtcaggaggatcgcttgagcctgggaggtcgaggctgcagtgagctgtgtttgcaccactgcactccagcctgggcaacagagggagaccctgtctcaaaaaacaaagaaaaagaacagggcatagttaaatttaatattttgtacttgaaagagtaattcgattgaaagagaaatactttagtattttttgagacagggtctggccctgtcaccctggctagagtgcagtggcccgatctcggctcactgcaacctccgcctcccaggctccagtgatcctccacctcagcctcccgagtagctgtgactacaggcatgtgccacctaattttattttttctatttcttgtagccaccagggtctcactattttgcttaggctggtcttgaaggtctgggctcaagcgattctctcactttgtcctcccaaagtgttgggattacaggtatgagccaccactcccggtgtagagaaatatgttaatatattttcagttagtgtttacctcgacagcacatatagttttaatgaattcacatatttttatggcatccagggagtttcctgaaatattttccaggatgattaaacaaacaaaatataccattctttcaaagtatttttgagaagtttatctctgacattaaatctagattcttacatgcattaaattattctttatcagtttaacaattttggtatggcgattcgaaaaacgctttctccactaatgtagcagatatcaaaagttctggattacaggtgctgagagtagtgatacagctcaaacatacgtaaacgtttgtcatttatctggggtttatgcatttgtagattgatctggatactattgatgtaagcaacctcaacagacagtttttgtttcaaaagaaacatgttggaagatcaaaggcacaggtaactatatttctcataccatttctataacttgatggagcttctatttgtgataccagattaatcctgcctgtcatataggagggaaaaaatgggtgaagctctcatttcagctgagagattgtgaaggataaagatatatcaagtaaaggactaaagattaagccctccttttttgttctaaaaaggaaataatcccgtgatggtgtaactttcatggcctctttatatttaagtttctgatgctttgcttaggatgcaccttgtgttcctacaccccctagaggttgactactgctatgtttgggggctagaggagcgttatgctgctgtcctagttgaaacaagacagttcccccgatctttgtttagtttttttagtgttccttggtgattcagagtcttaaaacatcttttccctttgcctgtctcccaacctgtttggcaaacccccacttgtttctctttttctttcatattttggcttcctcctccaggagtactttcctaaaccttttagactaagtcaggttggtttttctctcataacaacctttactttacttttcctatcattttcttttcttttttttttttttttttttttttagagatagggtctcactctgtcgccccaggctggagtggagtgatgcggtcatggcttactgcagcctagaactcctggcctcaagggatcctcctacactggcctcccaagtgctgggattacaggcatgagccaccatgcctggccttttcctgtcattctcatggcatttatcagagtctgtagttgaacttaatctggattgttatttgattaatgtctctcttgcttgacatgtacgttgtatagttcctggtacatgcaagatgctcagtaaatacttgttaagtgaatgaatgaatgacacttggttacttcatgttgtatttttgctgaagcttgccattcatgtagaagtgtgtttggtggtacgtgggtcagggggggctctccggttattttataagtataaaagtataattttataagtgtagcttaaccctaatgcaattttctcacatttttggacttctttggtgtttaatataaataaggtactatgtaagtagataacagcattgtggcttccagaagcagatttcagataggaacagaaatattgtagtaattcagtgttgtttatttttccaggttgccaaggaaagtgtactgcagttttacccgaaagctaatatcgttgcctaccatgacagcatcatgaagtatgctatagtgattacattgcaaagttgtataagggttttgtaagccaaatatataagctcaaagtcattcagcttttttaaaaaaaatgatttttctagaattattaaacagtggtggtttctgcttacagagtggcattctttttaccagttcataaatacatggtttgaatgatttagaatggtgagatagtttaatacttttaataaataagttacttggaaatttataaagaccttatatgcttgccttaagtaagaagatattttaaactatgaaatatccttatttatgatgattcagacttttctaaagtgtttgcctttttttgtttaaaagtttccctcccaaaataatctgtagtatgactctgacttctgtaatataacacttggaattgtggtagggcagtagtattgacagtacataaatatatttatctcagtaaagatagagtaaatatataattttggaggagttggagcaaaggaactgtgggccgaaattgtcctttatctatggtggtttagcttgcaagtaaatagtgttaaaaatagtccttgtttgaggtactggaattgaggtacttaacactttctcagggcatttgtatctccggattgtgttttttttgtgtgtgagatagggttttgcgcttattgcccaggctggagtacagtggcatgatcttggctcactgcaacctccgcctcctgggttcaagcgattctcctgtctcagcctcctgagtagttgggattacaggcgcacgccaccacactcagctaatttttgtattttagtaggcggggtttcatcatgttggccaggctggtctcaaactcccgacctcaggtgatccacccgccttggcctcccaaagtgcagggattacaggcgtgagccactgcacccggcctgtatctccggcttgttttttagttttttactctgtgaacctgcctgtagccctataacctccttaccctgtgttgctttcccagtgctgctaaaaacagagaccctaggggcctgaaccctgcctgatcctgatcatgtgaggtgaagtcagaggccaggcagatcctgggaatgtgttctttatgcgttcccaggcacttgctgcccaaagaaggcctagtgggactagtgaagtcatgccatctttctgccagtttgagatctttctcttgtgccctagctggccaaaaaggataggaatttgaaggaaataatttctttaaaatctgcttatgtttggaaagagtcaaaccttactatctatatgacatataatcctgatatcagttttgtttacagttactatgtttttttcagaactgtttattatactgcaaagatcatgtggaaggctagttattttggtgacctttttttattttgttttgtagccctgactataatgtggaatttttccgacagtttatactggttatgaatgctttagataacagaggtgaggttattttaatacttttaatttctcagtatttcctctctcccatatcaaatttgtttacaaatttaatatttattagactattgtgatttagaacttaaaagacttaagagaaatgatcgagtttaaagcatgcccattgattgcagttttatatagaaatgacttattccaggcgggaatttagctatcatattctctgcatttctaccaaaaggtataaatagaagtgaagtgaaaagctctcaaaaagtgtgactgtggctcagcacagtggctcacgcctgtaatcccagcactttgagagaccaaggcaggaggatcacttgaggtcaggagttcgagaccaacctagtcaacatggtgaaaccgtctctaccaaaaaacacaaaaattagccggtgtggtggcatgtgcctgtagtcccagcttctccggaggctgaggtgggagaatcgcttgaagccaggaggcagaggttgcagtgagcctagatcacaccactacactccagccttggtgacagagtgcgaccctgtctcaaaaaaagaaaaagtgtgactggagggtggggtgggggatgcttgagtgatattctttgtctgtaattacttccacatgtaaaagtatatctactaagtgagtttacaacaagttgggccagaaatatctaaataaaaaacacaaggaaaagtcaaaattacgtttattttttaaggcttggggggtctcactgttgcccagactagagtgcactggtgtgatcataactcactgaagccttcaaatgggctcaggtgatactcttacctcaacctctgcagtagctactctgcagacaggtaccaccatacccggctaatttttttatgtttatttttgtagggatgaagtcttgctttgttgcccaggctggcctcgaactcctggcttcaagcagtcctcccacctcagcctcccagaatgctgagattatgggcatgagccagtgctcctggcgtgaaattactctcttaacctgactcatcttttttccctagccttaaactactttaatagttccaagttgatattccacattctgccttcatttctatcatgtattatctgctagttatattagaatagtggtgagtttaggaacaccttgaaacagtgttttgtgtaaggtacagcaatagaagagaaatatggcacgttggatttttaagattatgtgtttctgtgggtacttctcctggagtaaatttgtgatataaattctatttgatattttgctaagtgaatgtctcttaaatgtctgtaattaacagttgtattattctggccatagctataagaaaattgtacaaaaaatgaagccagtaagatagttttgagtctgtgtcatcctaattaaagataactaattttttttttcccaaaaactcatactgtttgttttacttccagctgcccgaaaccatgttaatagaatgtgcctggcagctgatgttcctcttattgaaagtggaacagctgggtatcttggacaagtaactactatcaaaaaggtaaagaaaagttttatttttttaacttcccaaatatttatttgagaccttggagcaggaggaaataaactttgtatttatataaaatgaacaggtgaacatccaaaatgtaaggacttttatgcttatataaaacttaaaatgcggggccaggtgcagtggctcatacctgtaatcccagcacttcgggaggccgaggtgggcggatcacctgaggtcaggagtttgagaccagcctggcaagcatggtgaaaccccatctctactaaaaatacaaaaattagctggacatggtggccggcgcctgtaatcccagctacttgggaggctgagccaggcgaatcacttgaacctgagaggcagaggttgcagtaagctgagattgcaccactgccctccagcctgggctacagatcaagcctctgtctcaaaaaacaaacttaaaatgctataaacgtgctcaaaagactatgggcaaggaaatctttcagctctgccattttgtttcatttgacttttgtattaaaatccttagagtggtaagcatgatataccaggcatcaaaaatttctttgtgtcggctgcgtgcagtggctcatgcctgtaatcccagcactttgggaggctgaggtaggcagatgacttgaggtcaggagttcgagaccagcctctccaatgtagtgaaaccacgtctctacaaaaaatacaaaaattagctgggtgtggaggcgtgtacctgtaatcccagctagttgggagactgaagcatgagaattgcttgaacctcggaggtggaggttacagtgagccaagatggcaccacactccagcctgggcaacagagtgagactccatctcaaaaaaaaaaagccaggcgtgatggctcatgcctgtaatcccagcactttttgggaacccgaagcgagcggatcacctgaggtcaggattttgagaccagcctgtccaacatggtgaaaccctgtctctactaaaaatacaaaaatcagcgggcgtggtggtgtgcacctgtaatcccagctacttgggaggctgaggcaggagaatcccttgaaccggggaagcggaggttgcggtgagctgagatcacgccattgcactccagcctgggcaacgagcgaaactctgtctcaaaaaaaaaaaaaccaaaaaattctgttgtctaagagtctgggcttataatgtggaagggaactttgaaaactttttaggggtgtatttgtgaagtacttcaaacatttaaatacaactagagaataatagaacaaaatacctgtgtgctcatacctcagttttgttttggtttatttatttatttgtttatttttttgagacagaatttcgctcttgttgcccaggctgcagtgcagtggcgcgatctcagctcgccgcaacctccgtctccctggttcaagcgattctcctgcctcagtctcccgagtagctgggattacaggcgtgcgccaccacgcctggctaattttgtatttttagtagagacggggtttctctatgttggtcaggctggtcttcaactcctgacctcaggtgatccacctgcctcggcctcccaaagtgctgggattataggtgtgagccgccatgcctggcacatatctcagtttttaaaacctcaacacggcttcatttgctattcagatattttttctttcagttcttttaagaagttaaatattgtagttacatttgaagagtcgttttccatgttttgaaactatagaaagagaattataatgtacttaacatttgctggttgcgtctaattttttttggcagcttattcatgttagaaattgtgtctttgtttcttttaactgttaaatgttattcttggaaccttattgaataccattctacaaaagactgttgtgtatgtcagtgcgtattaagttgttgaataagtggaggccttcagtatctgttgacagatcaagacggaagttctctgtctgcattgcagtatgagtctcatgactgcttgccatgtggctaccctcaagaaagcatattggaaggctgagggcatcagaaatggtgtttcagagaaaactctaaatctgctgcaatttatattaaaacagtatttgagagttttgattcttgaacaattagcctggctaatttttgcatttttggtagagatgaggttttgccatgttagccaggctggtctcaaactcctgacctcaggtgatccgcctgccttggcctcccaaagtgctgggattacaggtatgagccaccacgcccggccagacattgctttttatatccttgttactgtgattctgacacaccactgtgtattaagactgaaggtggctgggcatggtggcttacgcctgtaatcccagcactttgggaggccaaggcgggcggatcacctgaggtaaggagttcgagaccagcctggccaacatggtgaaaccccatctctactaaaaatacaaaatttagctgggtgtggtggcacgcacctgtaatcccagctacttgggaggctgaggcaaaagaatcacttgaacccgggaggcagaggttgtggtgagcctagatcacgccattgcactccaacctgggcaacgagcgaaattccgtctcagacaaaaagaaaaaaagaagagactgaggttaggaatatctgagataatgaaagatgattcatttgatagttttgaaaagttgtctcaggtgtcatgtacttcttccaaggcataaattccttaaattgtaattttaaacttgaatgtgtatcaataaaatgggctgggcgcagtggctcacgcctgtaatcccagcacttttgggaagccaaggcgggcgaatcacatgaagtcaggagttcaagaccaagctggccaacatggaaaaaccccgtctctactaaaaatatgaaaattagctgggagtggtgggagatgcctgtaatcccagctctttgggagcctgaggcaggagaattgcttgaacctgggaggcggagattgcagccaagattatgccactgtactccagccagggtgacagagcaagactccgtctccccaccgccaaaaagaaacgtatatcaataaaatgaagagtatttggtttagtaacacctaagatttttctgtgtagggagatatatcttgaaattaatcttgtagtttacttaatttcaggagattataaggatatggctgtattccccagacccacttagttttgctcaaaaaaaaaaaaaaaacacatataagaaaatggctgcgaataatatttagataacatttacaactttgagaaataatttcttggaaagctgctgtttgtctttccagtagtttttctgtttagtgtgatcaaggtaaactcatatttgacactcaggtgtagtaatttttatttgggcttgtaagtcatgttcactgaaccaggagtcggcgtcctggcacagccttagctatgactggtagattcagttagcttttgtgttagtttatcataaagtaagcattttggagtcactaatattttaaaatttccttgacaacgtaaaacgtagttggaatatagatgaatgaagtgtttatattaccttataatgttgagaaactgccatcatggagtaaatttttctcatatcctgacttcatagggtgtgaccgagtgttatgagtgtcatcctaagccgacccagagaacctttcctggctgtacaattcgtaacacaccttcagaacctatacattgcatcgtttgggcaaagtacttgttcaagtaagagtgtatatttcttggcatgcttttcggtactgatgatggaaaatggagtcatttttatttaattaccttgaagagattgaactcaggatgtttaaatatggtgaagggatgctttagtagctttcttgcagtatttcttaggttaaatgtagctggccgggtgcggtggctcacacctgtaatcccggcactttgggaaactgaggtggtcggatcacctgagcgcaggagtttgagaccagcgtggccagcatggtgaaacacatctctactaaaaatacaaaaattagttggccgtgatggcgagtgcctgtaatcccagctactcgggaggctgaggcaagagaattgcttgaacccaggaggtggaggttggagtgagccgagatcgcgccactgcactccagcttggcaacagagtgagaatttgtctcaaaaaaaaaaaaaaaaaatgtggccatgactgttcaggaaacttagtcttatattggagacagccatgtaactaagcgataaaaatctttatatttggaaatgtgaacatttacttacaaataacccattggttataaaagaaatcacaatggaagttaaaaatactctgtactgataatgatgaaaatgctataccagaatgtattgaatgtggtggttggcaaaaagttacagatttacatacatgaagaaaggctgaacattaattactaaatctttactaagaatccaatttaagttagaaaatgaaccacagaatacactttaagaaatgagaatggtgtgggcatggtggctcatgcctctaatcccagcactgtgggagggtgagatgggaggatcccttgagcccaggagtttgagaccagcctgggaaacatggcaaaaccgtgtctctacaaaaaatagaaaaatgagccaggtgtacctgtactcccagctacttgggaggccgaggtaggaggatcagttgagcctgggaggttgaggctgcagtgaaccgagatagtgccactgcactccagcctgggtgatagtgagatcctgtcttaaaatgaagaaagaaagaaaaaaagaatgagaaggaaggatattaattgaagtaagagcacatttgattacaaaatagaagaggagtaagtgagaactaaacggggaatacagatagcagagattaaataggctataagaaaaaaaagggatgataataagaccatggtagtacataaaaaatttaaatgatctgggtaaatacatttttaaaaacttactaagtgcccagtgcggtggctcaggcctgcaatcccagcactttgggaggctgaggtgggtgggtcacttgaggccaggagtttgagaacagcctggccaacatggcgaaaccccgtctctactataaatacaaaaattaaccaggcgtggtggtgggcatctgtagtcccagctacttgggagactgagccatgagaatcacttgaacccagtgggtggagattgggccactgcactccagcctgggggacagcatgagatgatgtttcaaaaaaaaaaaaaaaatgaaaggaaaatagaatgcctgaatttagcagtataccttagagcaatgtaagtagtttaaattattctaaataatgcaccgaacctatgttatttttacagattcatttcacaaaacttgcaaggagtatattgtaatattagctaaactctccctgagaaatttttaaaagggaatactacttagcttgtgttattaggctagcaatgtctttgatagcaaaacctgtcaaggccattatggcataagaaacaattgctagtcagtctcacacctaaataatagatgcaaaaatcctatgtaaaatattagcatatcctgggaatgggcgcagtgtatcatgcctgtaatctcagcacttggaagctgaagcgggtggatcacctgaggtcaggagttcaagaccaacttggccaatatggcgaaatcctgtctctattaaaaatacaaaattagccggacatggtggtgggcgcctataatcccagctacttgggaggctgaggcaggagaattgcttgaacccgggaggtggaggctgcagtgagccgagatcgctctgctgcgctccagcctgggcaacagagcaagactccatctcaaaaaaaaaaaaaaaaaaattaccatatggatctagaatcatataaaataaaaagtgtgtcttgaccacgtgtctattcaggaatacaagcatggtttaaactagaaaatctgtaaatgtcattcactcattaggaaattaaagataaactatatagttttcatagatacagagaaagcatttggtaaaatttagcaaatggcctttcatgatgaaagtttctactaaaacagaataaaaacttactaggccgggcgaggtggctcacgcctgtaatcccagcactttgggaggctgaggcgagcggatcacgaggtcaggagatcgagaccatcctggctaacacggtgaaaccccatctctactacaaataaaaaaaattagccggatgtggtggtgggtgcctgtagtcccagctgctcaggaggctgaggcaggagaatggcgtgaacccgggaggcggaggttgcagtgagctgagattgcaccactgcactccagcctgggcgacagagcgatactccgtctcaaaaaaataaaaaataaataaatagataaaattaaaaataaaaaaacttcttactaaaatgagaatgttctcaacccgataaagggtattttgtagaaaccttcagcaaacattgtctttaatttttgcactcagaaaagtatacataacagtgtcaacttgataaatgttcacaaaaactacacttggaagctttatttatttggcaaacattttttttctttgggaggctgaggtgggtgaatcacttgaggccaggagtttgagaactgcctgggcaacatggcgaaaccctgtctctactaaaaatacaaaaattagtggggtgtggtggcacacgcctgtagtcccacctactcgggaggctgagccatgagagccgcttgaacctgggaggcggaggttgaagtgaatggagatcatgctactgcactccaacctgggggacagagcgagactgtgtctcagaaaaagacaaaaaaaaaaaaaagataatgtggccaggtgcagtgacacacacctgtaatcccggctctttaggaggccaaggcaggaggattgcttgagcccagcagtttgagagcagtgtgggcaacatagtgaaaccccatcactacaaaaaatttaaaaattagcaaggcatggtggcacatgcctgtggtcccagctacttgggaggctgaggtgagaggatcacttgagcctaggaggtcgaggctgcagtgagctgtgatcacaccactgcacactagccttggggacagtaagaccctgtcacacacacaaaaaagataatctggcaaaattaatatgagcagcatttttcactcgaagggaaacctaaataagcaataagcaagttatgttttaatcataagacttacttggaaaattaagtataagaccatagtaagctacagatgcttctcagatacttcccgataaactcatcataaataaaaaataccattaagtaaaaaatgatgctttttttgttgttgtttttttgagatggagtttcgctcttgttgcccaggctggagtgcagtgcaactgcaatctctgcctcctgggttcaagcgattctcctgctcagcctctcgagtggctgggattacaggcgtctgccaccacgcccagctaatatttgtattttagtagatacagggtttcaccttgttggccaggctggtctcaaactcctgacttcggttgatccacccgcctcggcctcccaaagtgttgggattacacatgtgagccaccacgcccagccaaaaatgcattttaatataacctcaataaacctgttgtaaaggtgaaaaatcattggtggaccattttaaattagcggctgtctactattttgcactcactagttggcaaagcgttaattttaggaagtgttaacatgccattgttgggagtgactatcagagctttgaaattatagttgggtggggggttgtacaaaggatttctgtaagataactttcattaatcatatacttgaggaaatactggaaacttttatatccatgagttattaaacagtttttaggataactttattaataaaagagaatctcagcttaatactttcaaattgtttgttaacactctgttcagcagtaaagagccattctaccatgaaaaaaagttaatcttgttcattgctgaatttctatcccctagatggggactctgcacctgaggtatataataatgtttgttgaacaggtagctgcaggtgtaaacacaaacattattctggtgttagaatgttatccaggttgtaagtgaaaaccactcacctgtttcttgagcagaggttttaacattgaaatgtgcagagcctcgctgataggaatggatgtaggtctgctaaaatttaaccttgcttacattgctgttgaaattgggatgcaagctgtccaagcacattgtgttaaacttttaagtttatagtcatttatccgttattcacttttttttttttttttttgagacggagtcttgctctgttgcccaggccggagtgcagttgtgcagtctcggctcactgcaacctccatctcctgggttcaagcgattctcctgcctcagcttcccgagtagctgggattacaggcgtgcgctaccacgcctggctaatttttatatttttggtagagacgaggtttcaccatgttggtcaggctggtctcgaactcctgactttgtgatctgcctgcctcagcctcccaaaatgttgggattaaaggtgtgagccactgcgcccagccagttgttcagtctttatctctgctaaatatttggaatattctaaattacatgtttgtttagaatgctttgttatacagaagtatttactattcttaaattatagccagttgtttggggaagaagatgctgatcaagaagtatctcctgacagagctgaccctgaagctgcctgtgagtaaattatttggcatatgttttatcagatactattatctttattttgttgatttaattttggtagcttaagggaaaaaaattgctatatgtgctaggtaatgtgtgtttaacatgtgttttttttttgttttttttttttttttttttttttgtctcagaggtggagtttctctcttattgcccaggctggagtacaatggtataatctcggctcactgcaacctccgccttctgggttcaaatgattctcctgcctcaggctcctgagtagctgggattacaggcacctgccaccgcgcccagctaatttttgtatatttagtagagacagggtttcaccatgttagccaggctggtctcgaactcttgacctgaggtgatccacccgccttggcctcccaaagtgctgggacaggcgtaagcaaccgtgcctatccaaaacaatgttttacaaaaaaaatatgattccgttttactgatgaggaaatcaaggttaagagaaatttcacaagtctagtaaatagagctgcgagttgttcctagatctcatgactggtctgtgctttgaactgttatatgtgtagctttcagaaactaagttacaacaggccaggcaaggtggctcacgcccgtagtcccagcattttgggaggctgaagcagctggattgcatgaggtcaggagtttgagaccagcctggccaacatggcaaaaccctgtctctacaaaaaatataaaaattagccaggcatggtggtgcatacctgtagtcccaactacttgtgaggttgagacgggaagatggcttgagcccaagaggtagaagctacagtgagccgagatcttaacactgcactccagcctgggcaacagagtgagactttgtctccaaaaacaagaaagaaagaaactgggatacaaaaagatgctgatgaatgtgttattttcttattccttgaactcagaatgtgttgcatttggggatttccatgagtgactttctttttattcccaaaggtgagtgaaaagagttcagttctacatttattacggttgaaaataaaataatgatcgttttataggggaaccaacggaagccgaagccagagctagagcatctaatgaagatggtgacattaaacgtatttctactaaggaatgggctaaatcaactggatatgatccagttaaactttttaccaaggttagatttactttttttataatcatggatagatgtattgttgtgcatagatgtattgttctagttctgcttgttttaaaatagtccataaaattgaattaagcttctatgtatatgccttgtgatgtcctaataaaatgattgatgcagtcaggatatgcaagttttaaaatgttaccatctacactaaatctatcagtataacatctaaataggaggtaaaatgagaggtggcttgtataccttcttggttgtctttccttctctcactttttacagaacttcttcgttttcctgctgcttctcatcttcactttttttttttttttttttttgagatggagtctcactcttgtcgcccaggctggagtgcagtggcacgatctcggctcactgcagccccgcctcctgggttcaagtgattctcctgcctcagccttccgagtagctgggattacaggtgtgtaccatcaggcctggctaattttgtatttttagtagaagcggggtctcaccatgttggccaggtaggtcatgaactcctgactgcaagtgatctgcccaccttggcttcccaaagtgatgggattataggcgtgagccactgctcctggcttcatgttcacttttatttcttgctcatatctgctattagcagtttgactgacatgtgtcctaaattgcccttgaaccccataagcccctttttcttggtgaaatccctcttcatcagtagtatatactatttgcctgttaaatatttctagagaaatctgtgaaattgtttttattgggtctacctaattattgttcatctagacccgtaggtccgtgttttaaaagtttttttgttctgtcttgactccctagcaagttgtacgtgtgtggggtttttttgactctttttttcctttttgtggagaatggggtctcaccatgttgcccaggcagatctcaaactcctggtttcaagtctcaaactcctgggttcaagcgatcctccagcctctgcctccctaagtgctgggattacaggcatgaaccactgagcctagcccctagcaagtttatcacagagcttaaaactttctcagctcttatcaaactgcctcagtattcttgcaactctcactaagcagatgaccttaaggatataataacaggtttgaaaccattggacataatttacctgttgagagactgttccacataaccgaaaactctttttctttctgctggagagaatccactttcggtaaaggctaacttttgcatgtggtgttttgctttccttttgtaccattcttcagacaggattttcgtctctgtcctgtgtctcggatcttttttttcttggtttcttttgtctgctttccaacacgcacaggttctgctgtcttaatcaaatgacatactgctctccccagcttgtatttcgtcttatttcctcagtggtaacagatgtcacatgttgacttttttttttctttctttttttttttttttgagagagaatcctgctctgtcgcccaggctagagtgcagtggcatgatctcagcttgctgcaacctctgcctcctggttcaggctattctcctgcctcagcctcctgagtagctgggattacaggtccgccactatgcctggctaatttttgtatttttagtagatagggggtttcaccatattggccaggctggtctcgaactcctacctcaggtgatctgcctgcctcggcctcccaaagtgctgggattacaggcatgagccgtcgtgcccagcccacaggttgactttcttatccctattgcatttatttcctcactacagcccttttctaaaacatggttgtattagggttctctagagggacagagctaataggatagatatatacaaaggggagttgatagagtattaattcacacgatcacaaggcccaacaataggcccatctgcaagctgaggagcaaggagagccagtctgagtctcaaaactggagaatttggagtctgatgtttgagggcaggaagcatccaacatgggagaaagatgtaggctgggaggctaggccagtctagtcttttcatgtttttctggctgctgtatattctggcctcaatggcagctgattagatggtgcccacccagattaagagagggtttgcttttcccagtccactgactcaaatattaatgtcttttggcaacaccctcacacacacacccaagaccagtactttgcatctttcaatccaatcaagttgacactcagtattaagcatcataatggtttttattttgattatacttaagatgccgtaaacttcgatatggtcaacagcagtatcttccaaaccagtatccttatttccattccaatctgagcaagacttgaaagccagaaaaatctgaagtgcatctccaatctgttatttagcagataattttaaacatctgctgtgtgccagacacctctttaagtacaggggatttagttgtgaacaagacagaagacagagtccttgctctttagagggagttcacagtctagatgagaagtcaaactttgaacaataaatttcagcttcagagtcttaatgacattaagttcagatgctttgcagcccttgaataataagtttcatctaaaggactcatctcctggcctgcatacccatttcagatgttgttagggagaggcttcagaagaggctttctagagcaggtgacatttaagcccaaggcttgaaagaataagagtcagaatagggtacagtatgtacaaggaaactctgaatagggtacagtatgtacaaggaaactctcagttggaaaactgacataaatcccattaagggggagagtggaaaaagatgactggagagagaagttgaggtcagatcaggcagactttctaggccttcttaaggatgttatagcaagacagtgggaatccattgaaaggtggtcttacaggatcactataaggggatagaggggatgcacatactaccctaggatctgatattcatattataaccaatctgggacagtgcccctggagttgtgcagtgccagaataatctggagtacagccatctgtactcccactggaacatggaggagtagactaaacaggactttgcatgtatatggtgaagatcagtggaataaaaaatggtacctggctgggcactgtggcttacacttgtaatcctagcactttggaaggctgaggcgggaggatcacttgaggccaggagcacaagaccagcctgggcaatatagcaagaccccatctctaaaaacgaaaaaaaaatagccagccatggtggcctgagcctgcggtccccagctactcaggaggctgggacaggaatatcacttgagcccaagaggttgagacttcagtgagctatggtcacaccactgcacttcagcctgggcaggtcaaagaacagaggtgctgttctccgatataagtgagctgggaggcagatgtgtgtagaggggttgggggagggtaggagaaggtgataataatcaattttgaactcatttgagattcttttggaacattagagaagtggttttgtagataagtagagaggtttcaactagggatatggttgggattcctaggtttatagatgtggttaactactggaaatggacatgatacaccacagaggacagaatgaaaagatggttcagtacagaaatctgaggggctcctgatatttagtaatagttgaatagaagagatggagcttaggcttagaaaactgttggttcaagccttcaagatcctctacaaaatgtttccagccacatttgttacccaagtcatagtggattcatctccttgcctttgtacccatttcacatgttgctgtcataaggagactctttccttatttcttagataaaatataaatctttttttttttttttttttttttgagactgagtctcactctgttgccaggctggagtgcagtggtgcgatctcagctgactgcactctccgcctcccaggttcaagcgattctcctgcctcagcctcccgagtagctgggattacaggcacgcgccacgacgcccagctgatttttgtatttttagtagagatggggtttcaccatgttggccaggatggtctcgatctcttgacttcgtgatccacctaccttggtctcccaaagtgctggattacaggtgtgagccaccacgcctggccagaaatccttactcaaggctttgtgatattcacactaaattgtattctgattatttgtatgtttggcttattctctataaagattaaggatgctcagttagtattgatggattaagtatattttgatagaaatggctgtgatttttaaatatagccaaatttctgttcttacctggtaccagcaataaatgtgttgaataaattaatcaacaatagaaaatgcagataaggaaaaagaaaaaaatattaaaatcacttgaagttctaacacatcttttcatatgatagtttctcaatctacttgtaatgtttttgtttttgtaataattgtgtgggggtttttacattttatttttgttcatgtttctgtgggttatttttggaggggagggcacattttaaagatatcgcagttcagaagttctgttgtgaagcactttagtttaaaaatctgtatactttgtgtgcatgtccccatgagcttggaggcattgctgactggcatccctaggctcagtgattgtctgtagttgtacatttatttacaactacataatgtacatttatttgtatgattgtgcttcagactgatctttggagctaaatttagggaagcttttggagaggtgacttaggaaggcaggggcagtcggcagttcagggctcctttactctgcattcctcagagcacttctgcatttcgctgttttcaatgtagagattctgttagaacttccttttacaaatgtttttccttttgaaaattgttatgctgctggtatatgacatgtatctttaaatcagatttcatagtgtaatatagatcagcaatgacgttttcttgtatcttatcaattagggattatggggttcatgggatctgtctttcttttgtaagctttttaaagatgacatcaggtatctgttgacaatggacaaactatggcggaaaaggaaacctccagttccgttggactgggctgaagtacaaagtcaaggtaaagaatacattttagtcttggaacacctaagctggaaatatcctcgcgtaaagtctttgtatagccctgttgttgcttgaaaatgatatgtcttcatatattcaaacagtgcaaaaaaatatgaagaacaaaagtcactgaagtcccacacttcagaaatagccactaataacattttcaggagtgttctggtggtccgccctatgtacacagatgcaggcattcgttatacactgcgtaaatggaatcatactattgataaactctcacttgcttttgtcagtcagtatagttaactagtctcttattaacatgtagtgtttttgtattttccctgaaataaagttttgaaattgctatatatttatgtatatcttttttttttttttttttttttttgagaccgtgtctcgctctgttgccaaggctggagcgcagtggcacgatctcagctcaccgcaacctgggttcaagcgattctcccgcctcagcctcccgagtagctgggataacaggtgtgagccactgcgcctagcctatttatgtacacctttgtacccttgtgattatctctttaagatttaatctagaaacacatttttaatgtaaaatttttttaatgtttagaaatgaaaagttttttgaggcatagtcttgctatgttgcccagattagagtgcagtggctgttcacaggctgtcatagcacaaggcatccctggactcctgggctcaagccatcctcctccctcagtctcctgagtagctgggactgtatgcaactgtgcccagcatattttaaaattttaaatgtaggaaaactattgtagtggctgctttctcatcccactcccctttaacactccttgtctctcctttatctgaactgtattaggattaatttatgcacagcagtatagcacccattgaaacttaaaagatcccgggagacttgggatatcattttggagcagttctcaacaatcagggatagttatcaaacagatttaattatgactctagtagtgtccgcttactgagttctcattctcactaggtgctgggcctaatgcttatttatcatcttatctacattatatcttcaaatctcccagtaatcctatgaggtactgaggtggtcttgtacctttcctatctcaggtttaacagtttttttttttttttttttttttttttttgagacagagtcttgctctgtcgcccaggctggagtgcagtggcgcgatcttggctcactgcaagctccgcctcccgggttcgcgccattctcctgcctcagcctcctgagtagctgggactacaggcgcccgccaccatgcctgcatattttttgtatttttagtagagacggggtttcaccatgttagccaggatggtctcgatctcctgacctcatgatccgtctgcctcggcctcccaaagtgctgggattacaggcgtgagccaccgtgcctggccccatgataattattttaatggaatttatttcatatttgatttcttaatggtcggggattgaacttgttaaacagagcacagtagaggaatgatgttaattagtgaaatttctaatatatatatttttttctttaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggttcgttttgacaatgtgtggcaagtacttacatgtcaaaagtgtgttttagttcttgagatgtaatagaagctagtcattttttgaatatttactagattttgaggaaatatattgatttggcttggatattttcagctctaattgctgtatggagctgaattttctgtacatgaattcaagcaatatcataaaacttcatttgggattctagtgatgtgttcagggtttataattatgttgactagaaaaataacgtgaatatattaaagtgaaatgtttcttgtgtagagtagatgtattcatagaagtcataaaatcatttggagaaaacatctcattggcctgatttgcccttgaaaatagtaagattgtctttgaattgaaatagttattactatttcagaggtctgaaagacagagctcttgatacaaaaatgagatgtaattattcttagaagttaaaatcatatttaatagtactctgcagttatgtcatcttttgagatttgatattatgaactaattttacttaattttaattgtaatcagtattttctatggctaaaagtgttttatctcatgaagcttgtatgttcctgtggtgttgaagattagtcatgggtcttaaggcataaaggccaattttagaaacctaagaaaaatttgtgtgtacatattttgaaactttggttgaatcagacatctaaatacactaaaatgaagctagtatatttagattcttgggattcttataaacattagtctcttgggttttgtgatatttaaagggtaacttttcatattttcattgttattgttatgctagtgatttgggaagtttgattagtgcacagaggctaaataaagagcccttggaatgggaattgttatcctcttgagtaaagtccacatgtaatgggtgtgataagacagctgcttagggaagacactgtgttgagtattcagtattcttagtcctcaccacaccttatgagatggggatataatttcccctatttaatagattaagagattttgactcaaggaatttgacttgcctgaggattcacagccagccaataaatacataaagaactatgctctcagtattttttcttctgttctgtgatgcctctgaattttagaccagggtgatatcttctcagttcaaagcaggaagccttgctgaaatctagagactaggatatagtctcaggaaaaatacaaatcgtaacaggaaaaacttggattgtattgccttatttgaagaaacagcatatgtgagagagtggtgcatatgaagagagtttggcaaaggggagtgaaaaagagtcatccaggtttttctgaagtgttaatgaaacagcttttttttttttttttttttaattgagacagggtctcactctgtcaccaaggctggagtgcagtggcatgatcttggcttactgcagcctctgcgtcccgggttcaagtgatcccgccacctcaggctcccgagtacctgggacgactttaggtgtgcgccaccatgcctggctaattttttgtgtttttggtggagatggggttttgccacgttgcccgggctggtcacaaactcctgagctcaggcaatctgcttgcctcaacctactaaattgcttgagactacaggcatgagccaccatgcccagcctaaaacagttttcttaaattgctcgtcttttggcctggattctgtgtttgtccagcaaccttctctttactgatgaatggaaccaggaaagggttgccattgtcagtgagtggaattgagattccggtgtatacaactgagtctccggtgcctttgtttaggctggagtgagttcctagaagctggtgattcttggtgttcttgtcagactcattactggaccagaggagctgatgatgagaccccaccccctacttaacccacctccatgctactgtgaggtcctagctgactggtctttccctcagcaacctcttgttctagtcgaaagtctatagtattataaacacgtgaaagtattgttctgaaagtaatgcttcaaaatagtcaatttgtggagaaacttgttaaattgtttaaattattggcaggatgacccatctgcaatggattttgtcacctctgctgcaaacctcaggatgcatattttcagtatgaatatgaagagtagatttgatatcaaatgtaagttatttgtactaaagttgtatcactaaaaccttgaagttgttttttaaacagtgaaacatactcatccttttttttttttcccagcaatggcagggaacattattcctgctattgctactactaatgcagtaattgctgggttgatagtattggaaggattgaagattttatcaggaaaaatagaccagtgcagaacagtgagtatttctgtttgcatttttatgcaaccccccttaaaaaaatcattaattaaaagtacattaaacagataatttttaaaatgaaaacaataaaattggtttaaagcaatggaaaagtaatttttctggttaccaagtgagtgtgtgtttaagcttcctggaaattgcaacaaaaaggaaaaattaagaagttgcttttgcttttaacatttccaattttactgaattcttcgaagaattcattgtgcggtccttatactaagaagatgtttcaactgtttttcaattctgagagtgctatatgggttttaaaatttgcttggtcattttatagtcccctgttcagtcattctcctattgagtcattcttttcaattttattgtatagtttttgataatgttaatgtctgagatctttatgggtgagtctgctgtcatttctgctatttctcgtagtgatttgcttgtatggtttatgattttttaaaaactgaatgtgtattagaattgtgtctggtaattctttagggacccattgtagatgtatttcttcaaagagcatttgtggttattatatttgggtgcttggggcactgccaatacaggaccacttttaaattaggattttcaatacctatgtattcagaccacaaacctgcacgtgccctatgttattgtcatgaattatatgggaagatactcctccccctccactaagcaccaagtttaagatcatttttatggagaaagtatttttctcctctcttttcaggtccttgctttgtgtaagggtctcctgttttaagagttcctaccttagtggtgggtggggtaggtgtatctcttaaggctaacactacttggatgttctctttggattccttccttcgatgttgtgtctgcagacacttcgctttcttaccagctcaagaaggcttcctaggaaatactagccaatactttgactgttgtttaggttctcctttttatcattgaaataaaaagacctgtttaccttcagaaatttcaaaaaatatctagtttgcaatggtactgttattttgcagtgtcattgatgcacacttacttttttttatcttttgagacggagtctagctctgttgcccaggctggagtgcagtggcacaatcttggctcactgcaacctccacctcccaggatcaagcgattctcctgtctcagcctcctcagtagctaggattacaggtgcatgccaccatgccggctaatttttgtatttttagtagagacgggtttcactatgttggttaggctggtctcgaactcctgacctcatgatccgcccacctcggcctcccaaagtgctgggattacaggcatacaggcatgagccactgcgcccggccttttttttttaaactgatggggtcttgctatgttgtccgggttggtcctgaactcctgggctcaagcagtcctcccaccttggccccccaaagtgctgggattacaggtgtgagccactgcacttggcccgatgcgctctttttttccttttctttttcttttttttttttttttttgaggtggaatcttgctctcacccaggctggagtacagtggagtacagtgatgtgatctcggctcactgcaacctccacctgctgggttctagcgattctcctgcctcagcctctcaagtagctgggattactggcacatgccaccacacctggctaatttttgtattattagtagagacggtgtttcacctgttgcccagattggtctcaaactcctggcctgaagtgatccgcccttctcagcctcccagagtactgggatttcaggcgtgagctattgcgcccagcctcgatgcactcttaaaatattttattttcatgaaatttcagtttgaaggaacagaatcaaattgcccagtctgccatcttgatttagttttctatttaaacttttattgtatatgttatatttttaatttctaagaactttattttttggtatcttttttttgagatggagtcttgctctgtcacccaggctagagtgcagtggcgcgatctcagctcactgcaacctccacctcccaagtagaagtgattctcctgcctcagcctccccagtagctgggattacaggcgggtgccaccacgcctggctaatttttgtagttttaggagagacagggttttaccatgttagccaggctggtcatgaactcctgacctcaggtgatctgcccaccttggcctcccaaagtgctagaattacaggagtgagccaccgttcctggccgatacccagtttttaaattatttaaaaaaaattttttatagcagcctgaagctgtagtatccctttgagctcaccaacagtactaattactgaacttattaaaatgtctgttatttcccatcacatccttccggtttctttgcctgcttagctccatgccactcttggactattaatagtaatatatctggccgggcacgatggctcacacgtgtaatcccagctctttgggaggccgaggcaggcagatcacctgagattggaagttcgagactagcctgactaacgtggagaaacctggtctctactaaaaaaaaaaaaaatatatatatatatatatatatatatatatatataaaattagctgggcatggtggtgcatgtttgtaatcccagctactcaggaggctgaggcaggagaatcacttgaacctgggaggcggaagttgcattaagccgagatcgcgccattgcactccagcctggcaacaagagcgaaactctgcctcaagaaaaaatatagtaatatatctggatttcatttttttacatttgcaaatgaattccagcctggattaatgttagcccaggtattaatagtggtagcaattgcttttattattgtcagtttcccttagcacacttaccttcccggtgaagcccaaaatcaaacaaatctttctccctctgtagcctgcttggcctgggcagtttgcttctagcccttccacctaccagtattcattgtacggagaagctattttacagaggacggctttagtgtctcttgagggatttagttctgtattctcaggggaatccgtagagtactcctttagaattcattcctcttagcagactcaacactacattgtagtcacaagataaaggtttgtgtctcagcttcttgtcttctgacatttgttgtttctgttggatcttgctagtgttttctaaactttagtagaagcaggagcttggagcttttcttaatttcagtgtaatttgtatatttgccttggttcttaattatttttttgtttagtattagagaaatggtaaataggtacatatactgccagaaatacatttttttccctcattatataaatgttattctaatcagaaaatttgggaaggcagtgatgttgattctagacaactgtgaaaggcactatcgttaactggagaaattaatgtgttggtcttgtcaggagattgcttgcttgataagaatagcctcagggagggacaccagctgctgatacaatgatggcaccacagattaacatgcctgtgcccttactcttgccaaatcaggttgcagaagaacgcggagtcttatataatacaaggagatgtcttttcagcaagcctagctagcctagcctttagctgattagaaaagaaggttgaggccgggcgcggtggctcacgcctgtaatcccagcactttgggaggccgaggcgggcggatcacgaggtcaggagatcgagaccatcctggctaacacggtgaaaccccgtctctactaaaaaaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcaagactccgtctcaaaaaaaaaaaaaaaaaaaaaaaaaaaaaaaaaagaaggttgaaaaaccaggttcctaaaaaggtcatgattttcctgatccattttgccatctggacgggaatttttaagtcattttttattggatatctggtaaacgagattttagattgtatggcgtataaaattacagcacgtttccgatttctgcctgttatttctcctccaaagatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaaggtcagtgcaaggcctgggtctcttttccttttgcttttacagtattactgtgatgacaaacaaacactagctgctgattctgaaaaggtccaactgcagagatgtgtggctgtgatttcctgggttattttgccttctggattcctgcaggcttttctgtctgtggttccagaataagtgcctcacattcccagaatggagtaggagtatttgactggaatctgcagcacagtggtggcacagtatcacagcaagcagaggacttctttgctctttgcttcccaggcagtgggtaaattctgtattttttgacaaataacaggtatccttgaatggtcctcactgtggcagtgagcagataagtatttgcatgcagtgcaaagtttgcatttccagtagagcaaagccccagttaccagctttgtattaaagggtataagtaacttgcagagttttggtttctctgcgtgttggacagtgcccactcccagcaaattagggggcttttgttatttctgaggtctgagttgaggctaagtggtggtacacacttatctaatatgacctgattctgatatggtaagttagtccctgaggacatagggcatttgcacacctggattcacctctggagctgaagcgagggaagaaatgggggtttaggacatggtctggtccttaagttcctgttaaattggctagatttgtgtattaggggagattttctttttttatgacccaaaagtgtcactttccactttgggatcacttcctattgttctctggttgtgaccatcataatgctacatatttacatgcctcttgagagaggaggaagtggcccttctcaaatagcagtgctgcctgatagggaatggcctttcttccagaaactggttaggcaggacggattgatttgagcttatgttttggtcaaggaagtggcaggtacagcagcgggtggttgccccagtttcttttctaggaaataattatctttggtatctcctgattcttgagcttcaaggttattcctctatttgtaggattcttagacctatagagagttcctccttttttccttctttcttttttaggagctggtaggatttaacagaatattatcacttctctaaatgcatggaacggggagacttatctgagagtcaggttaatgagaactgattccatctatgaaacccctgccattacagggttggcacagagactgaaatgaaatatgtcaagtgtgtagctcactacctaacctgcagggaaagacaaagtagcaagagccagccagggagttcctagtcccctgttgagatgaagttggatctgatctgcatcagtggtcagatgtggggatggaactcaggtgaatccccacggctttcctgcttgctctaagggatcttgaagagtgacttcgccggtttccaataaatagaaggggaaagtaagagcctttatagaagtctaggatttcttatgatctttaattacctacgttaatattttgaatccttttttttttttttgtagatagtgaaagaaaaatttgctatggtagcaccagatgtccaaattgaagatgggaaaggaacaatcctaatatcttccgaagagggagagacggaaggtatcatacattgtatttattcattcctctcattgaggagactgcttgaagagtgcacattagttgattcatttactgtatgtgatactcagtattgcagagagtggcagtgtttggtcatgaaggtgctctttcaaggtgacattgctgggggtcatcacacttccatgtttgggaactccatgtcagacattttcagggactgcagtgctcttgtccacttccaaggaacctccttgccgatatcatggatcctgggagctaaccttgtgatgagaagactattctgtctgtcagatcacagtgggtagggttctaaggcatttggagatttttctccaagagtggggaagccttggtagcctgttcctactatatagcagaaagattattgaaattcagtgcccggttttggctttctgatctttcctttcaaaagttcaagcagttcatcccttttgctaacacatttgctatacaaggtacaatacatttgattctgttgaagctttcatagtaaggattgcatcgtagttattcctccttcagactgtactcgttgatcctatacctccttggtcacttttgcagctcatttcttgagttgctgttctcgttttttccatgtcccagtttttgccagtgtactgttattttcgaaggtttctaggccctgtgtttccctgtatattgacttaattcatacctatttgtccattggtcatttattcatactttgtgaggtcctgatggcgattcagatgttaagccttctttaaattcaggtttagtgtcaaggttcttcttggttgtagttgcttgttgagaaattttttgggctattaggtcatgtgtaattggaggccatgttttggctgtgtggtgctctattttaggagtctacttgagtattcaagcctcattctagccagctgacttttaaaaaaatgtttgtttgtgattatatgctgtcccttagttgtagccagctctttcaaatgctagcttaaaaatggaaactggtcaggaatttcagtggcttcagcgtgacccttctgtacggaatacatgtggtatggagggtgagacagcacttaccagaatatgtgtggagtcctgtatgacaggcatagttttgggtattcataagtcaaggatgaataagacaacagaccttggcttgaagtgccttgcagcctggaagaagggagattgtcaacagctggattgagcatcgtccaaggaaaactagaaagagtgtgtacacagtatgaatctaaggaaagtatattcagctttgtgaaacggagggggagtaataggagagggagtactcttgggtcagtttttgaagtagtagtgaggactccctggacaaagaagagagcatttagacagaatgaacatctgtctacaaaggtgtgaacttgtgaaacaacctaaactgccttgggagtggcccattatttggtttcgctggaagttggggtgctgaggggttggcagcagtggtgaggttgaagtctttcttgtcacatgtgcagtgtgtgtcttcctcctctcccttgacccctaccctccagaggaaggggcagtatttcactgccacctgccaccagggtttaaacaggggagtagcagggagctattagggaggaggggattgagggatttttactaaggcagaggcaggtgatagatttgagatttgcaaagtcagaacttggagcccagttgaggaatagcattacaatgttagcagcgttgttaggcgagcacaagacttcacaggtgatgctagttcaccaaaatgtgaacccacattaactggttttccttttgaatgtgatggttccaagaggtttgcagtcagtggagatgtgtgaaagggcttggaggtggaaatctgggtaagaatgccaagggcattcctggtagattaaaatggtaaagcaagcaacagatctggaaaagaactaggagaaactgttagtattttctgggtgtcaacgtagggaaaggcgttctaagcgttttccttataaataatgaaaaaatgttaaaaagccaaaaaaaaagtggggggagactgaaaattgagattatatagaaaattgggcttggtgcactggctcacacctctaatcctagcactttgaggggccgaggcgggcagatcacttgaggccaggagtttgagaccagcctggccaacatggcaaaacctcatctcttgtaaaaatacaaaaattaggccgggcgttgtagctgtaatgccagcactttgggaggccgaggtgggtggatcacctgaggtcaggagttggagaccagcttggccaatatggcaaaaccctgtctctactaaaaatacaaaaattagccaggcatggtggagggggtgcatttaatcccagctattcgggaggctaaggcaggagaatcgcctgaacctgggaggtggaggttgcagtgagccaagatggtgccactgcactccagcctggacaacagagtgagactctgtctcaaaaaaaaaaaaaagaaagaaaattagttaggcatggtggtgcacacctgtagtcccagctattctggaggctgaggtaggaagactgctcaagtctgggatgcactctggcctgtgtgacacggtgagaccctgtctttaaaaaaaattgatttgaatggggaaaagttttcagaatttctcagtttggtccccctgaagtagtttcggtagttaagtgttttaagactgaattcccagcgttttaatgttttagggtactagggcctccataacaaataccacaacccaggtggcttaaacaacagaaatttatattctcacagttctggaggctggaacaccaagatgaaggtgctggcaggtttgttttattttaaaacctctctcctttgcttgcagatagctgcctttctgttgtgtcacatagcctttcctctaggggtgcacatccctgatgtctctgtccagattttgggattgattgattgattgattgattgactggagacagagtcctaaaaattttttttgctgctctgttgcctagcaggctggagtgcagtggtacagtcacacgcctcactgtgtaactcctgggcttcaggaatcaatccttccctggcctcccaaagtgctgagattatagatgtgagctactgtgcctgccttcctcctcctataaggacatcagtcagatcagattagagcccaccctacttgccccatttaaatttaatcattcctttaaaaagtcttatctccaaatacaatcagattctgagatactggggattagggtttcaacctttggattttggtgaacgggacacaaatcagcccataacagaggtttagctttttaaaaaatcaacctgactgctctatgaagatgtaactgaagtatctaaattattcacgtttcctagctaataatcacaagaagttgtcagaatttggaattagaaatggcagccggcttcaagcagatgacttcctccaggactatactttattgatcaacatccttcataggtaagagctattagtattttaattgtaagaaattatttgaatatataaactttagacaaaatgaaggaaaagtgttttcttatccttaaaccctgctgttcatttgaaactgtatagtatatttggttgagttggtcactgagttccgtgatgtttgacctacagaaaaatttgaggattcagaaattggcggggtgtggcggatcacctgaggtcaggagttcgagaccaacctggccaacacggtgaaaccccgtctctgctaaaaatgcaaaaattagccgggcatagtggcaggcgcctgtagtcccagctacttgggaggctaaggtaggagaatcccttgaacccgagaggtggaggttgcagtcagccgggatcgcgccattgcactccaacctgggagacagagtgagactccaacttaaaaaaaaaaaaaagaaaaccagaaataaaagaaataagcaaaaaatgttttaagagtaactgtcatcagtggtggcttatcagaaagacctagagtccaggtgtttgaacagtttaaacagaggcaaattcattgtagtaattaaactggaataaaattattaattatttttcaaggttctctagaaaaaaatatttcttccataaaacaaatcatttcgtttgtgattttgtggcaataacaaaagaatattgggaattgtctgtactggctgggcatggtggctcacacctgtaatcccagcattttgggaggtcgaggcgggtggatcacctgagatcaggagtttgagaccagcctggccaaaggctggtggtggcgcatgcctgtaatcccagaaacttaggaggcagaggttgcagtgagccaagattgcgtcattgcactccaggctgggtgacaagagcaaaactccatctcaaaaaaaaaggaattgtctgtacagattcctgagtctatagcacagttaagatagacatggccccctattctgatatattcatgtgttgaccagggtgcatttttgttcatgctcattgacatggtggaactgtgcctgacttgagatttatgggtagcatctaacaaacataaagggtttagtggtgctgccacctgcgtccagttattttgtcaatattttcatgagtatacaaacatgcatagtgttggtgtggttatttggagagaactacatttcatactttgtttataaaaagcataaaatgacaggaaggaggccaggtgcgatggctcatgtctgtgatcccagcactttgggaggctgaggcgggtggatcacgaggtcaggagttcaagaccagcctgaccaacatggtgaaaccccgtctctactaaaaatacaaaaattagctgggtgtggtggcatgtgcctgcagtcccagctactcaggaggctgaggcgggagaattgtttgaaccggggagccgagtttgcagtgagccgagattgcgccattgcactccagcctgggcgacagagggggactccatgtcagaaaaaaaaaaaaaaatgacaggaaggactgaatgtgagttattagtaagtagtgtatttcacagttagataatggagtcaaagtggtcctgcttcagttggacactagatataagtggcatgcttgttttcacttgtgaaagaaaagacagtggaaggacatgtacaataaagtggaaataccacaaggtatctaaaagaggaggcataattagggtttttaatcatattttttagctctctgggaacagaaccccaccccttaaaacgtgtgtcttttgtttgacttaaatgtttctgatgtttttgggagttcatgtacagaagcatggtgtagcttgtaaagatggggggacccagaaatcatgtagttctgcccataagacaccacattactatagttaagatcacattgtaggccaggcgtgacggctcacacctgtaatcccagcactttgggaggctgaggcgggcggatcacaggctcaggggttcaaaaccagcctagccaatatggtgaaaccctgtctctactaaaaatacaaaaaaattagccaggtgtggtggcgcgcctatagtcccagctgcttgggaggctgaggcagaagaatagcttgaaaacctgggaggtagaggttgcagtgaaccgagatcacgctactgcactctagcctgggtgacagagtgagactccgtctcgaaaaaaagaaaaagatcacattgtaagtagaggatgtagaaatctttttttggcattgtagctaaagaaataatgtccaagagttgctttaggccaccaagctttggacccagttttatgcttcagcaataaaagttatttactgttttaaagaaacaaaaaaccaaaaccttgccctgatttgaaagtgcatgtagagtttttgattatcacagaaatttgttgtgtaccgtcttttttattataagttcagtgctttgaaaattagaatccaaggtgggtatggttggctcacgcctgtaatcccagcactttaggagaccaaggtgggaggatggcttgagcccaagatttcaagaccagcctgggcaacattatgagaccctatctctcatttttttttaaataaaaattaaaaaaaaaattagaatccacatatttggtgtatacatagtgtatgctttgaggaacaacaggatttctctggtgctcctttgctttctaaatagtcatagcagtgacctgtgtgattctcctacagtgaagacctaggaaaggacgttgaatttgaagttgttggtgatgccccggaaaaagtggggcccaaacaagctgaagatgctgccaaaagcataaccaatggcagtgatgatggagctcagccctccacctccacaggtgagtatggccccagccagcaggttgttaaatacccacaaagcagaagtaaaaacaaactgattattaggaacattgaccataaatccataaaactactagaggtgtgtattggtttggtattgattgttgtaatggagctttgaatttatgaaccatgaagacatttaaggctgggtgtggtggcttacacctgtaatcccagcactttgagaggccaagatgggagtattacttgaggccaggagttggagaacagcctgggcaacacaatgagagacccccatctctacaaagaaaaaaaaaaattaaccacgcatggtagcgtgtacctgtagtctccgctactcaggaggctgaagtggttcacttgaacccaggagttcgacactgcagtgagccatgattgcaccactgcactgcagcctgggcaacagcaagaccatgtctcaaaaaaaaaaaaaaaaaagtcatttaaggcctggcatggtggctcacacctgtaaccccaacgctttgggaggccgaggcgggcagatcgcctgagctcaggagtttgacactaacctgggcaacacagggaaatcccatctgtactaaaaatacaaaaaattagctgggcgtggcagcatgcgtctgtagtcccagctactcgggaggctgaggcaggaggcggaggttgcagtgagctgggatcgcgccactgcactccatccagcctgggtgacagagcgaggcttccggctccaaacaaacaagtcatttaagactgggggaaattcttatggaaatttcttacagaaaataagaacactttgttattttttgttaattggtttttaacagtttgaaatgatagtttactagtgtgcaaagtcagcctatgtagtagcaggttggggttttgtatgcttgttttaaggagcaataaatccatgcatctgactattttgagtgaacaggtgcttgttaagtatggaatttaggcatgttagagtttccttgtcaccagtatgacttgggtatagtcctttcccctggattttcagtgctggtgcttggtatttttccaaataactgattgtttactgtattctgatttgaatatttactcctctccctttcttcctttagttaggaaactaaaggttaccagattttgacttctttgttttcatttctttgaccctatgtctgtggcattctttggaatatgtttactcttggctctaatgttctcttgagaattttggagacgaacattcagattatggcctgggtcattggttcataacctgttttttcccccctcactgaaattagaaaggtccgtcatcttcctttgaggaagagactatctggtagattttccaaaatcataatttgaaatgtacatttattgattctctactgtgggtaggtttccaaggttacagccatgagtaagataggtattctgcctttgattttgttggacgaggagataaaaccacctttagtatcagttctgcattggggatggttcctggcttcatcctctgctactatgtaagcttgggaagtcattcactgagtttcctttcctggaaagcagatactcatgtgatcttctttatagggttgtgatgattaaatgagttgtcatatgcacagtgctcagaacagttcctggcacattgtaagtgctgtattgttgttgctattgttaccactactaccattattagaatatgtaccctctgcttttctattggagaatgtggaggtagaatcaaggatgtgtaatgagtactttgagttacataatgcttgtcacaattttttgttttgattagaaaataaataggttcttatataaaacatttaaaacagtatggaaatacgtaatgtgtaaagtgaaaatgcagccattcttaagtctggtgtgtattagaagagtcagctttcaattatagaaaatacaggtgagcacaggtaactcccacgcttttacccattttctttttcccttttttctgaaataagctcaagagcaagatgacgttctcatagttgattcagatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccgtaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgttac

SEQ ID NO: 35803 - DNA, 45675 bp, Homo sapiens
tgtgagtgagtccgggcccgtgtcccctctcccgccgccgccatgggctgcacgttgagcgccgaagacaaggcggcagtggagcgaagcaagatgatcgaccgcaacttacgggaggacggggaaaaagcggccaaagaagtgaagctgctgctactcggtgaggggctggaggcggggactgagtggtggtcgggagagcctaggcgcttggaaggcctgaacggggtctggtcgggccgacggaaaggaccctaaagggatctggagggcgtgccgggcgtggggcggggtgttggggttcctagctgaggccccagagggcgtgatgaggggggtggggttttggggttgcgggaattaggctgtagagggtgtgactccgggctagaattgcgtttagcagagagacttgggagtatgggccggtagatgttgagggagtaggaatatgggaaaagctcataaaggaagagttgatactaggaaggttttacgttgggttggagcgtgttggtaacgagaacggcatagagtatatgttgggcttgtataatggtttgtgagtttggagcgtcgtggttctttggcaggataaagctagcaggcttgaatggatggtacagagactggaacagaatggtcacataaggacgttgacatttgttagtaagagagccatttgaactgttggaagaaccctggattatccaggaacatgaagataggtaggtgagataaatgacaagttatcaggtataaaggaaaagagcttgggtgcagaggccatctctacttttccaccgtttcctatcatttttattttcaaagttttataacgtcttcttctgtttttacaaaaggatgggaaatggtgtgagctgaagaaatttaaagaatgatttctttgaggtttgtagcagaagatctagtgaacaagagattacacattggaggatgctgaatagttgctatagatgatgtgtagttggaatagttaccttaggataagttacagagttggacatattcactgtaaagactatggtagacttctggtggctgttttatcctttttggcctcttcaaagcaaaaccattgacttcaggaattactgtttatgttatttgatagtcgttttaattggctttttttaaacacagtcggatgtattttactcaacatgagtttcaaaatttttgagaggctcagtaaatcatacaaagaatactggcattagcttactaataaatcaagccacatttcttcattattagtgaagattttctagggtagtatttccattattttccaatattttctagggtagtatttccattagagaagaataagtaggagtaggggtttctacagaaacccttacaagcaatagaaatttactttttaaaacaattgatttttgaggaaaaggagtcactttaggggaaatgctaaattttcatggtataaagctccagagaacagaatgtacactgtaacccaagacttattttgtacattctaagtgcccctgttagtctcttcgtgtgaacatatttggttggttgtagattgcagaagctctggtaatagcttttttgaatatactataaagggaaagttatgtattggagcttaaggttccggtttgtatacctgaactttcagaagatgcgagttcaaattgtagttctagactgcgactgtctgtataacaggtggatatgcatggtccctggtacctagtaggtgctccttaaatatttactgttaaccagcctgagccagcaaatgttgaacactggtccttggggcctttgagaaatttgatataaactataacattcagggcgttaacttttttttttttttgagacggagtctccctctgttgcctaggctggagtgcagtggcgcgatctcgtctcactgcaacctccacctctcgggttcacgccattctcctgcctcagcctcccaagtagctgggactacaggcgcccgccaccacgcctggctaattttttgtatttttagtagagacggggtttcaccgtgttagccaggatggtctcaatctcctgaccttgtgatccacccgccttggcctcccaaagtgctgggattataggcgtgaggccaccgtgcctggccagcattttctttattgatcgattggttatgaaagtaaagatgtattctcatcttctgtgagtgatttgatttacactgaccaacagagatacccttaggacatcagtttattgtaatgtagttggaaactttgagactttcttccaaaatgcaggattaggcaggcagaatttggataggcggaacttgtccagatgtctagaagaatttttgttcaggattttatctgtagtgcatttaattaaaaacaaaattagacacttgacttagggaacttgaaaagcagtaagtaaaaatcaaagtactaaacatatttgcttttaatttttaccaacttcattcttttttaagtaagatttttaaaatattcttgagcaagttaaatccacaaattcaaataggttgcagaaacatatgttcttgcttgagccatatcataacacacataggaaattaaaattatcttctatgctatttctataagcaaaatgtacccaaaacagtatacagttttctttttcctggataatgtctcctttgctgtagatgcaagtcatttttactttatcactatggaacttagtttaagttgagatctatctacttaccctgtgtctcctgacacatgatatattttctttcttatgggggtgtagtttaacatggtgattaatagcatgggtcctgaagtcagactgctttaaatcctaattcccatttactagttatagccttgggaaagttaatttctcttggcctcagttttcttatctttaaaatggagaaaatagagctactcctaggattgctgtgaggattaaatatggtaataatgtaaagcagaacacagcttggcacatagtactagctccatgaagattagctattcttattaagtcaaaatgaatgttacagattgtaggtattatggaaattataccaaattaagcagctagtgtgggccagattatttacagacacttcagtattgtaattcttcctttgataacctttggtttgaatttcatttagatgttcttggaaagggctgggcgtggtggctcctggctgtaatcccatcactttgggaggccgaggctggtggatcacctgaggtcaggagttcgagaccagcctggccaacatggcgaaaccccatctctactaaaagtacaaaaattagccgggcgtggtggtgtgcacctgtagtcccagctacttgggaggctgaggcaggagaatcgcttgaacccgggaggtggaggttgcagtgagcagagatgacgccactgcactctagcctgggtgacaaagtgagactctttgtctcaaaaaaaaaaaaaataaagtgttcttgggaagatcttggtatatcaaattagtgtttaattatgacattctattgaaaaaataccatgcaaagcttcccaaccaatgttccagtgcttaggatggcatataggtgtgctgtttacaaattttttatagcattgaaattttaaatcatttttataagttcaaacttttacaacagttgaaattacatttgaacatctttggtatgatttcctcttgtataattcatgaatttggtaatttggttatttactatttaaacaattagagatgggggtctcattatgttgcccaggctggtctcaaatgcttggcctcatgtgattctcccatctcagcctcccaaagtgctgggattaccagtgtgagccactgtgcctaccctaccatgaatttggtaatttgaaaaaattttatttggtataaatactaaatttataccaatttaatatttaatatcatttgtaatactttgtatttttttcatgccataatttcataataagaaattttgtgtgtgcgggttttgtttttgtttttttttgaccccagggcaagcaagaaaattttttttcaccaagctctttcagctcaccccaatgagccttacaaatatttttaatgtgtgccatcatgtgacaaaggttgggaagcactggtataatggataagagcactgcttttggattcacacaaaactgaatttaagttctacctccacttattagctctgagacccagagcaagtaacttaaccataagaataataatttttacatatgtaaagcagagatgatgtttcataatatgaaatgagataatgcatgtaaaatgcttcacattagtgcctagcaaataaaaaatagtaagtggtcacttctattgatgatgatgatcgtgagaattaccattttagctacttttttcagaggtttttcagacagctgttttattatttttcatattaatatactattttcaaagatcttcaaagaattttaatatccttttgtggtgaaaggaattaaatgttagtcctttttttttactcatcactgtactaatgaagatacttagttttgtaaattattgaattatctgctctctgtatttctgtttcttgatagtttcctttagcaggttctgagaaaacataaaaaaaaactttgttctttgggatttgctggtggtagtatggcaaaaagccagttgcatgcagagaactggaatcatctaatttacttaaactctatattatacagttaattatatttaaattgctgcatattattggctgaatatgcttattattgagaataagactgccctttggtaaacatgccattacattatatcctcctatgggattataccctttattatgtttgccatttgcttgggataaggttcatggccagttacatttcatgtgaggatgcatctgtgtttcggggaaaaaaagctttgtgttttataagcatgtatcattctttgtgtcttttatttaaatgcattagtcacttttttaacatttcaataggtttttggggaacaggttatgtttggttacgtgaataagtttagtggcaatttctgagattttggtgcacccatcacctgagcagtctacactgtacccaatgtatagtcctttatccctcaccaccttcccaccctttcccccgagtccccaaagtccgttgtatcattcttaggcctttgcatcctcatagcttagcatccacttacaagtgagaacgtacgatgtttggttttccattcctgagttacttcacttagagtaatcgtctccagttccatccaggttgctgcagatgccattatttcattcctttttatggctgagtagtgttccatgggtgtagaggggtgtgtgtgtgtgtgtgtgtgtatatcacattttctttatccactcgttgattgatgggcatttgggctggttccatatttttgccattgtgaattgtgctgctataaacatgcgtatgcaagtatcttttttgtataatggcttctttcctcagggtagatactcaggagtgagattggtgcatcaaatggtagatatacttttagttctttaaggaacctacacactgtttcccatagtggttgtactagtttacattcccaccaacagcgtgaaggtgttcccttttcatcacatccacaccaacatctattttttttttattatggccattattgcaggagtaaggtggtatcacattgtagttttgatttgtagttcctgataattagtgatgttgagcatgttttcgtaagtttgctggccatttgtatatcttgtgagaattgtctattcaagtccttagcccactttttgatgggattgtttttttcgtgctgatttgatttccttgtagattctggatattagtcctttgtcagatgtatagattgtgaagattttctcccactctgggttgtctgtactctgctgatttcttttgttgctcagaagctttttagtttagttgagtcccatttatttatttttatttttgtctttgcatttgcttttgggttcttggttgtgaagtctttgcctaagccaatggctagaagggtttttccaatgttatcttctagaatttttatggttttgggtcttagatttaagtcagtagccctatacaccaacagcaaccaagctgagaatcaaatcaagaactcaaccttttacagtagctgcaaacaaaaaacaaacaaacaaacaatacttaggaatatacttgaccaagaaggtgaaacacctctacaaggaaaactacaaaacacggctgacagaaatcatagatgatacaaacaaatggaaacacgtcccatgctcatggatgggtagaatcaatattgtgaaaatgaccatactgccaaaagcatatctacaaattcaatgcaattcccattaaagtaccaccatcattcttcacagaactagaaaaaacaatcctaaaattcatgtggacccaaaaaagagcccgtatagccaaagcaagactaagcaaaaagaacaaacctagaggcattagattacctgacttcgaactatactgtaaggccataatcaccaaaacatcatggtactggtgtaaaaacaggcatatagactaatggaacagaatagagagcccagaaataaagccaaataacttccagtcaactaatcttcgacaaagaaacaaaaatgtgaagtggcgaaaggacaccctgttccacaaatggtgctgggataattgacaagccacatgtagaagcattaatcacttttgcagtctgaaaatacggcccttttcaggaattaaaataatgtaattttccctgactacgctattcctgtagtacactgatggccatagagtagggtgcttaatactagatttcacagggcatgtaaggttctaataagcgctgctactacgtttctttaaaaaataatttttagcatactaaacttatatgcattattacaaaaaagtcttttagtttttaggcagttgtctctaataaaattgattcgtagtctagagatcttttagagatggttagtaaaacctgaagcactatgctgttcctcccccgtggtgctgagcttctgcatcctctagcttgggaaggaaaagggagttgttaggcctctgcagatacttccttttttcctatcctgtctctcttccttccctggtttcttctacagcatactttctcctggggaaaggagtgcgtgcgtgcgtgtgtgtgtgtgtgtgtgtgtgtgtgtgtgtgtgtttgtgtgtgtttcatcaggtccttccattaacttccattctttttcttttttttttttgttgagtcttactctgtcgcccaggctggagtgcagtggtgcaatctcaatgcaacctctgcaacatcactgcaacctctgcctcccaggctcaaacgatcctcccatctcggcctcctgagtagcttggactacaggctaatgccaccaccgttggctaattttttgtagagatggggttttgccatattgcccaggctggccttgaacttctgggttcaatgatttgcccacctcagcctcccaaaatgttgagattatagactgagattatagcctctaacttccattcttaaaagtcgctcatctgtaaccaggaaaaaacaatatagagagacagatggcaggaaaatcagtagctgtgcaaaaatggaatgttcaaaacgcggaagaaaaaactgaaacattgtgaagagtcttttggttccttttttagaggacaattttttacttggaatttttgaaaaatctgttttctctacttgagatggcttctctttctgcttttcccccagtgtattaatgaactatatcctgctacttacctcaagtcagtttatccagtatagaacttgccttcactcctcacccccaaatccacctgttgggaacttttctgtttcagtaccagcattctcaacttcatctaggctgaaaactgcagttgtttttaactcctctgttactctcatctcttacaaccagtcagttgcgaagtcctatgactcagtcattactagattccagatttttggactttaaggaccagaaaaatttttaaaaacttgtttttggtagactgacctaggattttaatattttatttttcttagtaaatacattttaaaaatctcagactactgtctgttatgattactatttagttctctttcctcccgagacagtctcactctgttgcccagactggagtgtagtggcatgatcttggatcactgcaacctctgcctcccaggttcgagcaattctcatgcctcagccttctgcgtagctgagagtacaggtgtgcaccaccgtgcccagctattttttgtatttttagtagagacggggtttcaccatgttggccaggctggtctcaaacttctggcctaaagtgatctacccgcctcgacctcccaaaggctgggattacaggtgtgagtcaccatgcctcgccattggtgaaactgttttgatgttctgaattggatatgatatgatcctctatttttgaaacctcatagtactttttatgccacttatagtctgccttatatatggttatttatatacttacctggtcctaaccatatggtcttttagggcaggaggactaagtatttctcatctttttgtctgttgcaggacttaatagaatgctaaagtgtttttgcccataaggaataggaacaccactcatacaagtcacaagtaaaagagaggtatattgaaaggacaaagtaggcaacttcataggtgttagacattcaagaataggtaagaaatgaaatacaggtaggttgtatgtacatggactgtgatacccaacccccaccctctcccctatttctcctagagcagaatggcctcccccgagtcttcaacttttgtttactctgacatcttctgtggctcacgcaccgcctgacccggtagttcaagtgcttcatgttatctgatgcaggctcccaggatcccattcccggttcctggtaaagagtatcagattggcccagccttgtcatctgccaaccacaatccagtcatgtatggttgggtatagcagagttgatggggtatcatgagttttataaggtgaccctttcaaggactggagtaggtcaaattctctattaaatgcatggccagagagttaatgtttaataaagagatgacagtgcctgacacctagtaggcactcactaaatataagttgaacataatggaatgacatgggagtattgaggaactaaacatatcactgctttactttctcattagttcatgagaacgtgcctgctcattctcaatattaccatcttgtatagttgggagagagaacttaaattcagatttaaaattaggccaggcatggtggctcatgcttgtaatcccagcactttgggaggctgaggtgggcagatcacctgaggtcaggagttccagaccagcctggccaacatggtgaagccccgtcttttctgaaaatacaaaaattagccaggcgtggtggtgcacacctgtaatcccagctacttgggaggctgaggcatgagaatcgcttgaacctgggaggcggacgttgcagtcagctgaggtggaatgactgcactctagcctgggcgacagagtgagactctgtctcaaaaaacaaaaacaaaaacaaaatttaaaaataaattgaagtagggtacaggattttaaagtcccattatcaacacattcaactcagaatagttaatgtaacctgaatttaattacctttgattttaatttaggaatgaattttttaaaatgcatataaccagctcagggtctgtgcttcatcatcaccctggctttttttttgtgctaatttttcctcttactacttttatgagtaccagaaaattatccaaagctaagagaagaaataaaacactgtttttgctccttattaataatttgcttctaagtttttgttagagagtaggtaaaaacgtttggcaaagtagattgctcatagagtttagctatccatgctttgtttttacctttagtttagttttatggcaggggaataggacttgttgaagggagtgggaaagaagggatgcaggtcttcataataaggaatgtcggccaggcgcagtatctcacacctgtaatcccagcactttgggaggccaaggcaggcagatcactaggtcaggagttcgagaccagcctggccagcatggtgaaactccatctctactaaaaatacaaaaaattagctgggcatggtggtgcgcacctgtaatcccagccacttaggaggctgaggcgggagaattgcttgaacccaggaggcagaggttgcagcgcgctgagattgtggcactgcactccatccagcctgggtgacagagcgagactctgtctcaaaagaaaaaaaaaagaaaagaaaaagaaaaaatgtctagagcagtctgcactaaatttgttcacgttactgaagttcatttttaaaatttgttttctagccaataaaatatagtagactagcaataataaaacacatctctttgaactggtaactcacatcagaaataggagataccatgcaattaatacagggcaaagagaatgaaaactgagagattagtccttatcactgagcttcattttcctttctttttaccactgagggatttaaattgaacctcaggggtcctttgtctgtgaacttaatattattagccagatggaatattttagcaagttataaaggtaactatttttgtgttatgtctcttattcttgagtttgattgaagttagcttaacatcataaagctggttagaaagatagttaaaaactgaagttaaaaacctgaaaaacataaattcatgaagtacccctaatgtacatgttcaaaagaaaatacaaagaaatcactcagtatttgacttcccctccaattttaattgtcttttggtataattcttttttggtgtttagcaagttaaagttatctttaagcatttatcttgtccaggtgatcctgttaccggcttagtaatcagctgtatcatttctgtaattcaagctgtttgaactgaataacatagtgttaggatcactgtttaattgttctagttttgatagatacaatgctttatgtaagtgaaatatccgatttttcatgactttctgttaagttgtgacaaattcatgtatctgatgtgaactaagcaaagaagaaagatacctaaaagactaaatttgtttgacttatacctgaatagtggtctagtgatgttagaaacaagtttcaggaagagctagtcttcagatctgaacttcctttgatttccaagttagacttagatacctaaaagtttaagaaagattgttaaggattagctgagatgttactgtgtttgttgatccattactaattgctgttagggcttctttttgttgccaagtcatgttttcagatggataaatgtttttaatgttaatacaaaacatctgtttcttgaataatgttagtattttatatctcaaagaattcttattgcttaccttggaagtagatagtattctaagtcataataatgataattattattttgctgctcagtataataatctgaattttttctagctgtagtagctgttgagtcaggcttgccttgccgtgatcaaaacatgcactctatatattttaattgtactggctgggcaaagtcctgtaatcccaggactttgggaagttgaggccggaggactagcctgggcaagatggcaagaccttgtctctacaaaaaatttgacagagtgagatcctgtctcttaaaaaaaatcatttgagaaacagcaaaagtactctgtattcagtgctcttgtgatcctcctgtgtcagcctcctgagtggctgggactacaggcatgcaccactatgctaggctaatttaaatttttggtagacatgaggtctctctacagtgcccagggtagtctttaactcctgggctcaagtgatcctctcaactcagcctcccaaagtgttgggattacaggtgtgagccactgcatctgacctgattcactgctcttaaagagctgatgtgaaagtgagttttgcctaggatcttgtaagttattgaagggttgtttcaaagtgacatatctttaacagaacattttctcctgtatttcttgaagttagaacttgggaatcattaacttcaaaacagggcttcgtttgatataatgataaaactatgaccatgacttatgtaggtaatgtagtcctgaggtatgtgttaggatagtgcagtcttaattttggttcattccagggtattgaaaataatttgcttcttttcttcttctgcttctaagaagaaaagcatatttcttactctatttttgttattatgtttgtaattaaaatccacattcatgtccccagcaaaagttgaagtagttctttcaactttttctagactactcaatgtttaaaaactaaggttttaattttgggaaaattttagatttacagaaaagttgcagatagtacagagtccctatatactttacacctgtttttccttaatgttgatatcttacatagctatggtacctttgtaaaacactcagggattaatattggtgccttaatgttaactaaacttcacattttatttagatttcagcagttttcccactaattttctgctccaggatccaatccaggatacaccattgcatttagtcaaggctactttttattaagctttttggttttcattgttgcactgttcagtgggaggctcatttattaacttagtttctagcctggagatagaaatgagaaatatacagaattcttaagcagttcaagtagggaagatatgcaagtaaactatggtaataaaatgtgattacagaaggaatagccaattttgtaaggaggaagagagagagagacatatacgttagggaagccctcccagaggaggtgacatttgaaatgggctttgaaaattaaatagcaacttttttttttaagtttcttccttttagaatattttactaagcgagaagctgggatgaaagttagataggaactcttaaggcagaggctggagagaagcatatccagacaaagggaatagtaagcacaaagactcagaacatgagtgagcaaatagatttgattgaaatgaagggttggtacaggaagagtgtagaaggtgagcctgaaaaggtatgcagaggatttggagagtgtttatgtgaagttttttggtagctgtattttaagctgtattatgtatgtatgtgtatatatgaatatatgtgtgtatatatacatacacaagatatgtatgcacacgtatggagtaggttctgcatctggatttaaccaatggcagatcaaaaatactgggaaaaattaaatgacaaaaataatacaaaaaaagtataactatttacatagcatttacattttattaggtattataagtaatctagagaggatttaaactgtacagcagaatgtgtgtaggttatatgaaaatactacaccattttatgtaagggacttgagcattggtggattttggtatcctagggggggtcctggaaccagtcccctgcggataccaaggtatgtgtgtgtgtataaaatttaggggaactcatccagagactgcattgttctccttcttattacctgcctttttgttttttttgccattccaccactaattcatgctgtaacaaaaggttaagtagaagtaaatacatatgtgaaatccatactgttttgggttttggctgaacagctttggtgagcatttattatagtaaaggaaattgaaattgtaggcatccttatctggcaactcagtttgtagtgtttgctgttggtgaattttaaaagtgtagtttgatttacattggattaaatacacctgtagaaacgtgccctatgctgctatcgatgttagagggccctaggtagggaggaatatgatttcaacattttaaatcccaaaattttacaattttgggatataggtgctttgataaatgatttagcattgcaattaactttggaggacatctgcagtataatgaatcattatttttatgggttaaaatgaaatatttggattatttgtgggttacagttgcttgtgtcagttctgttcccttttactctaaataaatatagttttcagtcatgtcatatataaatactacgtaatttaatgttagcatcaaaatggctttttgctgccctgctttcaaataaggagaaggaaacttaccaaagtccaaaattagaacactgagactgggcacagtggctcatgcctgtaatctcagcaccttgggatcacttgagctcaggagttcgagactagcctgggcaacgtggtgaaactccgtctctactaaaaatataaaaattagccggtgtggtgatgtgcacctgtggtcccagttactccagaggctgagggggaaggatcgcttgagccctggggcggggcagaggttgcagtgagctgagatcatgccactgcactccagcctgggtgacagagcaagacactgtctcagaagacaaacaaacaaacaaaaaacgttgaggcagccagaggatgatccctgtccttgctcacaaatgactgctcccttaagcaatcaaaggcaaggaaggaactctacgtacttctccccctttaaatgataacattttgaggagagctgcttagctgagtgagctgccttttttttaaaaaaaactcaagccaacccttccttagatgatttatgaatgtaaaatgcttgttaactttctgctttatggtttatgatgcttgtaaaatgataggattattgtccatgtatgtaattggtgaaggatatgaaactcagaacaaaccatatagtgccatgtaagttatggacatattttagttgttagggcttttaaaaaacatctccccctctgtcattacatgttttaccctctggaaatgtttaatgaaacagtaactgatattgggagggacacacaggttgcttcaaagataaatggtaatgtttaatttttatgctggacaataggtacacagattttttgttacacatatgctataagtattcccttttatgtatccaatatttatttaataaaaaacaacctaaagttttaaaggcaaaaaaggtaattctcatgtccttaaagcctattccattcagtttttgtgtgtttttttttttttttggtggcaaggaaaagaaaactcattcaaactaggaccaaaagttggtgggttgataggttattgttagaatatagaaaggtgtttgtgggaatacaggaagagctggagaatcaggccgcaagaactgatgcagctctgagactggccagactgttttctcttttttgtctgtttctgcctcttgctggcttcactatttctgcctttattttatttatttattttttttgctttcttacctttgcttgttcccgtctctttctctgtttccttggtcccatccgtttgtttttttttgttttttaaactgggtcaacaacctttgttgtaaaacaaaggtgcccttcccccattcattctgttttctcacttacttgatgtctctttttttgtgagctctctcctttaagtcactgcatatttttctgttctcttctctccagaccaaccttcctctgaatcttttcctttgtgaccttgttgtgcatgaagctctataatggtagcctaggtttttttccacatgtatctcctagtgcagattcctcagataatccagttggtcctgctcatcttttagagctaggtcacataggccaccaacagcctgtgactaggtgactcctgtgttaggtatttaccctcgattcggtcacaggaaaggttgtggcctagatcgtgtgggccatttcccactgaggtagcgaagtagggatttttatagaagagattatgggcaggcagatgttctgaaattctaatatgtcaattaagttttatcagaattttcttatgtgccctttaagcctttttggtaatcggtatgtgattgcttcctagaagaatctttttcaaagaaaaaccattagctctcttccagttacaactcactgccttcttttatccttaagatattcattcatagccaggcgcggtggctcacgcttgtaatcctagcactttgggaggccgaggctggtggatcatgaggtcaagagttcaagaccagcctggccaagatggtgaaaccccgtctctactaaaactacaaaaaaaatcgacctggcgtggtggcaggcacctgtaatcccagctacttgggaggctgagacagagaatcacttgaacccgggcagcagaagttgcagtgagctgagattgtgccactgggtgacagagtgagactccgtctcaaaaaaaaaaaaaaaagataattcattcataatctcactgaacaaataataaatgagtgctcactatgttttatatacccttctaggtgttagggatagaatgagatgatgagtgcaggggagataggacaagggtttgagagtaaggttagaagggagtgaggctagtgagtgagtccaaatttattgtcagtatagtcatgggatgagagttgaagggccaagagtgggtgtgaggctgaataaagatagcataggaatggaaatcttccgtttctgttaactacctacgttgaagattccatccattgcatctggcattgtgattaatgttattaagcaaccactgaatattatagaaactcaagccattcatttcacagatagtcattaagtgcctaatctgtcctagattttgctctagattggcggggggtgcacaaaaagaaatagcaattttgtgctttcaaggattgggctttgagcttagggctagtggagtcctaaacaggcacaaacccgaataattacaataatttgaccaagtactaatgtaacagtgtatgacattaccctgtaaagccaggttgagcctggtcagggtgcccctgagggagaattacatagatatggaagggttttcaggttgtggcagaaagggtttcattactattttaatcaaaatcaagaaaaccagttagcagcttatgagaagcaaggagattaggagctaggaatatagtcaaataatttttttacagtagccagagctggctagagataaaatgaagtgaggtggctgggaaggacagtttgggggctagttttggaaattaacctcttgaactgatggtcaaagggaataatctgtgccagccaccagggtggaagtgataactgttcagaaagaatgaggagggcttcagcaaggagttgaagtctgagttgaataggggttttacggatgcttatagcatatgtagaggcttgtcatgtttagagggatagtgggctggctgaaaaactattttgagattgtaggctaaggaaacttagtaatttcacaagaaaaatagatctgtaacttctcccaccagaccgtaaagtccataaacttatttgtatttgaagtcaccatattcagcattttcaggcatgtaggagacatgtttgttgaaaaaaaatttttttatttgctcagtgatgtttttcctatctgttattcttctagccttttcttttattgaactaagaagcaactggttttttaattaagtatagtaccttgaaaagccgtttgaatgaaatgtcattcttttttgtttgttcgagatggagtttgctcttgttgcccaggccggagtgcaatggcgcggtctttgctcactgcaacctccacctcctggattcaagcgattctcctgcctcagcctcctgaatagctgggattacaggtgcccgccaccatacctggctaattttttgtatttttagtagagatgaggtttcactatgttggccaggctggtctcgaactcctgacctcaggtgatccacccgcctcggcctcccaaggtgctgggattacaggcatgagccaccgcacctggcctgaaatgtcatttataaccttactctgaatttttagagttacatacttatacctgttactaaaaggaatcaaccgggagcagtaggtactcctattggaaatagaatggacttactcctatgatctttagttgtagatactcacaattcttttttctttcctgttgtaaatgaaaggtgagaataagttagcaaaaaaatcaattttatttgctgatcaagctttcagcctgccatgagggaggggctgtctgtgcctattctagtcatatgttcctatatgtctgataatgggggcccgtagaagagagagtcttggtctagcactgactaaaaggttatctaaaaatagtgccatactgggacttggctgtccagacctctggaagagggactatactctaattataatcctgttattaaaaattttaagatttctatatagaaaccagtatttaaaaggaagaggagatgtttcaggtacccctggaataactgctatctcaggtggtagtggtgcagagagacctgtgaggaaggttcaaggaaaagctatagaggtataaatggttgaaaaggagaggcgatagtagacaggaatatctggggctgaaaatacatttaaggaagagaatatttttgttcttcaggatagggtgaagaaaacgactaatgctctgatatattatagtttgctgtaacttttaggttataagttgcagtttaagtgtgtgaattcagattctatctaggattttattattatgaaaccactgctaaatagttacaccatttttactggaattttgaaccaacatcagtatccaagttgttattactaaataaaactttgcgaggccttaacgttacttggtgatattctcaacattggaaatggcattcataaataatagctagctaacatttatggaacatttactatgtgccaggcactgttttaagcattttttattgacccccattcagatgaggaaattcattgtgcttgaaggcacagaaatagaaattcacatagtatactcatgtactttctttggactggctttagtcaaatgaaagagaaaaaagagaaggactcaggggatagtgtttttttttttttttgagaattagccatctgtcagggttaatttttaaaatcagtctgtatgtgagctgaatgagtttgctcatatgtgataatggtttatttgttttagcagttccaaattccaatcacttggggccttgtttaaaaattatcttgcaaagaaattatcaccatctctcactttgcatacccataatgtaatatatgttattgaggggtggagagcatatgctctggtacctgctcagagatctttttaaaaatacaattaagaacatgtgtctgggtgcagtggctcgcccctgtaataccagcactttgggaggtgaggcgggaggattgcttgatctcaggagtttgagcccagcctgggcaacatagtgagacttcatctctactaaaaataaaaaaaaattagccaggcatggtggtgtgcccctgtagtcccagctactcccagctactcaggaggctgagggaggaggattgcttgagcctgggagattgagactacagtgagctgtgattacgccactacgctccagcctgggtgacagagcaagactctgtctcaaaacaaaaaacaaacaaacaaaaccccatgtttaggtaaatacagtgattctacattagagtacatattgttgaattttttttttggtctaacagtgttgatgattatgtatccaaactgtagataaacacagatgattttctttttctttttgccagaacaaggtcttgctctgtgcccaggtttgagtgcagtagcacagttgtaactcactgcaaccttgaactcctgggctcaagagattttcccaagtagctgggattacaggtgtgtgctaccaggcccagctaattttttgtgttattcttgttgtttgtttttttttggtagagatgaggtttgcctatgttgcctaggctggtcttgaactcatggcctcaagtgatcctcctgccttggcctcccagagtgatgggattataggtgtgaaccaaccattccctgtccccagatagttttctaaattaatcctctccctttattctctgcagattgccttgcctcttttattgagaatgaaactaacatggcttccttcctccttttattctcaaaaatctccgtgacttcacctctcatccttttctcctacttatataggatatcctttaaaggataaagcttctgtgttgaacggatcctattgcctcctgtttctgggacctttccaactttttctcccctgtgtatcctaaccccctgcatagttccatcccttctgcatacagagtcctcttcagttcctcccttttgaagccatagctgctgtctttgcagtatcctttgcatcttcccattctttgtatttcaactattacttccctggtgtattgaagatgggcaactgaatctctccttaaacttgtgatacatttttgaaaaaagatagataaaagatgcagataaaattaggaagttctgaacaccacatgtgttgtggagtagggagatggaacataggaagcagcttggggaaaacgcaacaatgagatgttatgaaaagggagcttactgctagaacaatggagcacagagagttgaggtaaaagtgaagagcccagacctaataagaaagggttatagaaagtgtttcaataatttggagaattattagataaactgatggttttaaaaatagtgcccctgagatggaactggaagctcaggagaagatattagtgtgataataaagggaaaggcaaactgacattttctcagggagccttggaaaaatgtgagagaggtagggcaacagagggttttttgtttttttttttaatcagcgcatccatagggtaggattaatgagataggtagaaattgattctgagattaatggatttattatttcattcaagataatctcacatgaatgatggaaatgtggttttcaatatataaaagaatggtacacattaattcattaatctcaacttttcttaatttagtagctcttgttactatggataatctgggaattctgtcttttaagcaatttaaaatataactggtatgcatttgtattttcttcccagagtagaatcattggattttttagatatgaatgagaggattcacctttttataacagcatcctaagaaagtcactatgtgctatttgagtattaactatttagtactacccctgattatcgattatgtaataagacaagatcatatataaatgtaccttttgattctgtaagaatgtagttgtctagaatttttatatttggattttaattaacttttggttagtaaagttgagaaatatttagtaaagaatcatggttactaaatattattcattgtttagtaatatttatttgagtagataatttatgtcatgaccagtttaaggccctgggaatgcagggatgaataagccttcatggagcttatattttagtggggaagataagaaatgagctaatctgtcatgtgaagaagtggtaagtgctatgaaaaaatataacacagaataaggggagagactgtgacggggtgggagctatttagatagattagtcagaaaaggctgttcctgtgaggaagaaaatcttgcaaaacttatttcaggtaacagtaaacgcaaagacaggaaagacagagtcaggacctaactcagtaagaaccggtttggtatgttggaggaaaagcaagaatgctggtctgacaagagctgtgaggacaaagtggagagtaacaagagatgagggtgaagaggtaggcaggggccagagcatattgcaccataatgcccatggattttgagtataattgaagatcgtgtgacaagatctaatttacattttacaaagtttattccacctactgactggcaaactggctttagaaaaggcaaggtctgaagcactgaactatttaggaagcttttgcagtgatctaggcctatggtttccaatgttcaggaacaaactgttaaaactattatattaactatttatattgctttatttaaaaaaattaagctttactaatatttaatatacagattggcactggcatccttgtcttatctgcacgttagtcacatgtcatttaacatttttggcttgagcaactggtgaatgttggtgccatttactggaatgagaagactgagggaggagcagggtttgttttgaggtgagagtgagttggggaatcagtatctcagttttgagcattttaggtttgtgaaatctaaatacctactagaaatctaatatcaggtagatggtttagatatatgaatctggagccaaggttagaagccaagattagagatctaaatttggaaatcattagtatagagacagtatacaccagctttggagccaaactgtgaatgcaaatttcagttctgccacttactaactgtgtaattataggcaagttacttgacatctgtctgcatcatttatctcatctgtaaaatgggggtaataatgtctacctcatagggttattgtgaggattaaattagttattacaaacaaagtgattagaacagtgtggccgagggtactcactagatgttaactgttaggatcagtttttgaatagtgtttaagccatgagattagggccgggtgcgattgctcacttctgtaatcccagcattttgggaggccgaggcaggtggatcgcttgagcccaggagttcgagagcagcctggcaaacatggtgaaaccccgtctctactaaaaatacaaaaattagccaggtgtggtggcgtgtgcctgtagtcccagctactcaggaggctgaggcaggagaatcacttgaacctgggaggcagatgttgcagtgagccaagattgcgccactgcactccagcctgggtgacagagcaagagtctgtctccaaaaaataaagaccatgagattagataacttagagaatgagtttagatagggaaaagggccaaggagggacccctgaagcaatataacctttagaattcagaaactgggttgggtgcggtggctttcgcctgtaatactagcactttaggaggctgaggcgggcagatcacctgaggtcaggagtttgtgaccagcctggctaatatggtgaaaaaccctgtctctactaaaaatacaaaaatcagctgggtgttgtggcaggcgcctgtaatctcagctactcaggaggctgaggcaggagaattgcttgaacctgggaggcggaggttgcggtgagccgagattgtaccattgcactccagcctgggctacagagcgggactccatctcaaataataataataataataattcagaaactggagagaggagattgaggagtgaagtaggaatcaaacctgaagggtatgttggctagaagcctgcctagtgaagaaaatatttcaacttagacaaattctgcttgagaggctaagatgagcaccaagaattgaccaactgggtttgtcaagatggaagtttttggagaccttgagaagtagttttattagagtggtggggatgaaagcctgattagcatagctgaaggacagaattggatgtacgaaattggaggcactgagtatagatggcacattagaggagttttgctgcaaagagggatagagaaaatggtgtggtagctagaagaaaatgtgtggggtcaaggaaagttaggggtgtgtatgtgtgttgatttaaagatggaaaatagtatagtaagtttgcatgctgatgagaatgacccagtggaaagaaaaaactgatcatatttgagatgtggaaaatatcatgggaaattgcagcagccatgaccttgagtaggtaaaatgaaggtgcataaggggagaagttgattttaaaacattggcagagacttttcatccattgatgaaggtagagaatattaatggaggtacagatagactggtagatgtcgttgtgggaaaatgtagttttttctgattgctttaatttttatggaaaagtagggtaggatcatcagttgagagtcagaattgggagggggtttataaaatttgagagagaggaggtggtgtgatataggcatcttggaagataggaaaatgagttgactagggaagatctagcaggtggatttgtcaaggaggtcagaaggctagcttgacatttgtggtcatttgtttaaagtgattccagctggctaaggagggcagggtggtcttgagatgacatatggtgagaaattgataggaacaatgccttttctgcttctatttgaaacatctttagtcctgtgactggtagtattgctctcagaacatttctgtggtataggcaggcagcaacagaggaattaataaaaatgaatagaccaaaaaataatgatttcatttttgcccatgttcagtgtttatatcatgttttatgtagtgaatgagttcctccaaaagtttatgttgccatctgtccttggatatgcctattttacacaaatgataccaagcaagccctaggacactttcaataaattatacttggttgctgagttatgtaaagaaagcaaaatgctgtagtggagaagctccatacattttcttgatagacatgaaagcctcaccaaaattttccctaggacccgtggttttcatcaatctagagttatcattcatgttgatattatacttttatgttgattaccgagaaattcaaagtctggttttcttttcttacaggtgctggagaatctggtaaaagcaccattgtgaaacagatgaagtaagttggaatgtagcgttttgttagactaggatttctcctaatgcatataaagtccatagtatcttttcattttaggtccatggtattgacttgtggttttctttgttttaaagaatcattcatgaggatggctattcagaggatgaatgtaaacaatataaagtagttgtctacagcaatactatacagtccatcattgcaatcataagagccatgggacggctaaagattgactttggggaagctgccagggcagtaagtgtttctcatttcctcttcacttgctcttattcagcagatacagttaagttaagcaaaatttttgcttcatgttttagggaaatgaatttaagcaacaagataaaatgtagcaaagtactttgtgctcacttgagaaatgttagcaatctactttagcaggtgttagatataaccaccccaagaggagcctaggaaatgggattctgtgggtgcacggtaggtttctgggataactgttctattcaattgctttttttttttttttaacagcactgttgacttttatagtagtagataatagtacattaaaataatctaagagaaaggttgccatgatatgtagctctgctttctgaggtgtacagattaaaggccaaaatcagtctcccagaataaattctgtaaggacatgagcactaagtccaaattcttgaatatctaagtcagatattcaagaatactgtatactacatggaacctaaggctatagaattggagtataacatgccctagtataattctttaatgccttgcacatgtcagctatttaaaaagttgtattattataataatacttagtggaccctgaagatctagtttataaaattagagcatgtgtaattaggatgttttatgccattggggagggtgccaatatgaaggcaggagatctttgatattattatcagctaaaatccagagaaggctgggaaattatagaattatttcctacatctaagggactcactggctgtgttcagagtgtcatacttatgtgccatggcgaaataaaaggaaatgatttgggaggtctgcctggaaaggcaaaacctatatgtctatgaagttgcttaggaactctcataagccactcccaacttatcaaatgcgaatttatatttgataaaaagataggaaattgttgaggggaaatactgaaagggtagtcacagttggatagtgttagactagaaagtgtcttagaaatggcataaaggaagaggagctggattagggattgtgaaatgagagacttgtatcaaaaaataagaaaatatgtgaatgtgacttttatatttttgtgaaatatatcacagagactatttttctatgcatctgagcagggaagtttggcagtcaagcaaaaataaagcctttatccttgtcttaccctttcctattccttctctcaccccctgcttttgtttccttcttttcctctttttcttctttataccagctctatctgtggtcttattttttcttcctcccttttctcatttctccctatcacctaactctacttctctgttgtatttgttgtatctggtaactggtcagtagtactgtatttattctcttccttctctctgttggttttttctctgtctcagttatttattcttttagtttgtcccttttctctttccctctttaattttattccccgccgtctgtcttcctttatttatctccctaccctttcatttctttttttttttttttttttttttttggagacggactctcgccctgtcgcccaggctggaatgcaatggctggctgcagcctctgcctcccaggttcaagcgattctcctgtctcagcctcctgagtatctgagattacaggcgctcacctccacgcccagctaatttttgtatttttagtagagatggagtttcaccatgttggccaggctggtctcgaactcctgaccttgtgatccgcccgcctcggcctcccaaagtgctgggattataggcgtgagccaccgctcccggccccatttctttccattatcaaatcaattgtcattaatctttgtatcctaatactcttgtgtcaccagatgcagttgacatcattagtccctctcaggcctcctaaatcatccagctttctggtgtccacacaacctagtctgtaatcctatattataatttttaaacattgctttttatttttccttctgtgtgtaaggttttatgtttatagctcctctcttattgtcttctagtatttttgtttgtttgttttttgaggcggagttttgctcttgtcacccaggctggagtgtaacggtacgattttggctcactgcaacctctgcctcctggattcaagtgattctcctacctcagcctcccaaggagctgggattacaggcgcctgccaccacggctgactaatttttgtatttttagtagagatggggtttcgtcatgttggccaggttggtcttgaattcctgacctcaggtgatccacttgccttggcctccccaagtgctgggattacaggtgtgagccactgtgcccggcttctactctagttttttatagttggttagagagtgtgaatggaaaaaaaatagagctgagtgtggaataggttcctttttcacatctgcttaagtgtggaggtgtgaagtttattgtaaagaggggcctcttctgtttttttttttgttgttgttttttgttttttttgagacagagtttcactcttgttgcccaggctggagtgcaatggtgtgaccttggctcaccgcaacctctgcctcctgggttcaagcgattctcctgcctcagcctcccgagtagctgggattataggcatgcaccaccatgcccgcctaatttttttgtatttttagtagagacgggggtttctccatgttggtcaggttggtctggaactcctgacttcaggtgatccatctgccttggctgcccaaagtattgggattacaggcgtgagccaccatgcccagccaagaggcacctctttatagacctttagagagggtttattgtggggaagcaagagcaggtcagtggaagaaattaagtgataagaaaaaagtgtttgctcctaaaagaatatttaaagagtcaggacagcaaaaaaagtagtaataattccctctcttttgaagtttctaaaattagagtcatggtttttttctgtttttttttttttttaaagtagtgcttaataaggttatttgaatacgtgcatgggtataggtcaaatttcagaaccaggggattatgaagacttcacatgttagataaagcaccataccttgcatatgtacaaggacatgctcactgctgagtatgtttgccaatttgtctaatatttcaacttttctcattcatttgtttaaaattttatctttgaaaagaaagggaggggcatatagatcttagctaaggtgttttttttgttttttttttttttttgagatggagttttgctctgtcgcccaggctagagtgcaatggcaccatctcagctcactgcaacctccgcctcctgggttcaagcaattctcctgcctcaaactcccgagtagctgggactacaggcacacgccaccatgcccagctaatttttgtatttttagtggagatggggtttcaccatgttggccaggatggtctcaatctcttgaccttgtgatccacccgcctcggcctcccaaaatgctgggattacaagtgtgagccaccatgcccgaccagctaaggtgtcttagagttgagcctagtctaccgccatgccaccctgaatgcgcctgatctcagaagctaaatgagagtgggttgagcctaaatattactagaaagaatacaggaaaggatcataaaggaggaaatattactaggtaaaaaccattagagctggagacccagagtttggcaaaaataatttgagtgcaccatggatggttttgttttgctaaggtggatgcacaagttctggtaattcacaagtctttggagttttaggttgtgagttcacctgtggtctgaaatgacttttgcttgttagtttatttgtcttgatgactacttaagatacaaatgattgctcccctttctcctttactttttctttacacgttatatactttttaaattttttatttttatagttatttggaatctctcaaggtagataaatattagatgtggatgggaaaatcatcccgtgagacctgtgtttaattttaaaccaacaagtagggatggatagaataaaggaaaacaataaaaatctcataatccatttctgtcctctccctcacatattttatgtttaaaaactataaccacctagaaaactatggctatgtctgggcccagtggctcacgcctgtaatcccagcactttgggaggctgaggcgagtggatcacctgaggtcaggtgttcgagaccagcctggccaacatggcgaaacccctctctactaaaaatagaaaaattagctgggcatggtggcagatgcctgtaatcccagctacttgggaggctgaggcaggagaatcgctagaacccaggaggcggaggttacaaggagccgagatcacatcattgcactccagcctgagtgacaagagcgaaactccgtctcaaaaaaaaaaaaaaaaaaaaagaaaagaaataaagaaaaccatggctatgactcatgaagttatggttactttcttttcctcctgctcccttcctttccctctctcagaacattattattattccttattcctttagggaaatctagggactgtttgaatctttccctgagggatttatttcccccattaggcttctagaccttaagtgcctccatctcctcttcttgttctactgtctgggctgaaggcaaagaagagaatacttttttcttaaacttgattaatgttttactccctttgaggtgtttagactttacctcttatgtgctagtctttttatttctatttttagtgtaggcttcctttaatagaacgggaatgttttacataatcctgtctcataaaccagtttttttctctcaaaaattattagcaatctggatggagatttgtgggctggccagaaatgatcttttctggggatggtggtgtgtggaggagtggtggggaagtaaaatcattcctcagctcagttctggacttaaaactgtagtgaaatgagaataaggaaagacttaattataaattctgtcatgctggcctgtcagaaaaggtctctgtaacaacacctcttttaacataacatgtaatgtgtctatattttaaagagactgtcatcaagtcttaaagaaatggagagtcatctgtctctttcttaactgctttcttcaggatgatgcccggcaattatttgttttagctggcagtgctgaagaaggagtcatgactccagaactagcaggagtgattaaacggttatggcgagatggtggggtacaagcttgcttcagcagatccagggaatatcagctcaatgattctgcttcatagtaagtaatttttctctgtgaaactataacagagaataacttggtgacactacagaaattttagtccccacttaaggaaatgtttaagtaatagacactcttagacgtttataggatactttataaaaattgtctaagtttaggattatagagcccttggtcatttgtatgatttggagaaaaaagttccctcttggaatgtaaatgggagacttggcaccacaaaattagttccatggcattttattataagcaagtgaaggaggagagacatctgttgtggctgggttctgaatctgttccaactcataagttccctctgtgtaagggcttggcactgatagccagctagagagggaaattagaatagtggtattcctttttatgcagccagctctctgtgtctgggccgcactatggacttcactagtaacccttttgccagatcacagtagtagactttgtatagaaagagaaggttgagtcatggaatgaagttgaagtatctttttgtcaaggatattatcttgagtgttaatatagttttagagaatttgtaatgaatacttatattaagctattacatgttatcctattttacctcttttacatatacttatttatgaaacctagattcagaatgtattttttttgttttgagacggagtctcgctctgtcgcccagactggagtgcagtggctccatctccgctcactgcaagctccacctcccaggttcacaccattctcctgcctcagcctcccaagtaactgggactacaggcgcccgccaccatgcccggctaatttgtatttttagtagagacggggtttcaacgtgttagccaggatggtctcgatctcctgacctcgtgatccacccacctctgcctcccaaagtgctgggattacaggcgtgagccaccgtgcctggtccggaatgtatttttttttaatgtacttttgcggggcctggtgagcacttgttatctgtatttctctctgtactggatgagggcacgtttaagcattaaagttttttctccaatattactgttttcctacttttcacgtcatgattctagcttaaattgttacaagaagaaattaaatgatatagtcaggctgtgcataaggacagggatactttctgaaaaatgcatcattaggtgatttgtcattgtgtgaacattgtagagtatgcgtacacagaattagatggtatagcctactacacacctaagctatatggtatagcctgttgctcctaggctatgaacctgtacagcatgttattgtactaaatactgtaggcaattgtaacataatggtaagtatttgtgtatctcagcatctctaaacatataaaagggtaatgcaatggctatgatgtcactggggctaggagtgtttcagctccattataatcttacaggatcactagcatacatttatacagtctgttgttgaccaaaacattgttatgcagcacatgactgtatttgaaaacttgcttattctttcaatgagaacttggctttagaaacgtttcaggattcttgcctaccttttaataacatcttagttgcaagtattgatagcttaaataattctaccagtggtcatcaaaggtagattataattgctttttttcatctttcattcagaaagctctgaatcctctaactacatgtgcttatagagattttcataactgttgatctaagcttgcctctttacattagtgatagtatttggttttatagatcattaatgattcacttacattggtgccatctgctcatcagttttctagcctggaatcagcaaagaatacagttttgaagcagtcttttaattatttccctgaacaaattaatttttttggaggtatttacaatttgtttttgatttagattaaaaaaaaaaaccccagacctccccagctcttctgtttactgaaagaaaacggaaaatattcttactcactatagttctctcaattttagttaatcaaacaccattctctaatgtcctgtcaaatggttaaacacgcatgacctattgagtttaattgtctgaggacttttggtatagtttggttttgatattatacagtacacagttgatttagtattacatttcaggaatttttctttaataagaacatttcctgttcctattgttttaattttttaaattggccttcacaatttaattctgtagaattaaacctacttttgtgtccgggcgcggttgctcacgcctgtaatcccagcactttgggaggccgagacagacgaatcacctgaggtcaggagtttgagaccagcctggccaacatggtgaaaccccatctctactaaaaatacaaaaaattagctgggcgtagtggcgggcacctgtaatcccagctgttcaggaggctgaggcaggagaatcatttgaacccaggaggcggaagttgcagtgagccgagttcgcaccactgcactgcagcctgggtgacagagtaagactctgtctcaaaaaaacaaaacaaaacaaaacaaaacaaaaaaacctacttttgttaatatatatagactctatactttaattgtcctatgttggattcatattttttcttattatttctttctttttttaagagacgggggtctcactctgtcactcaggctggtgtacagtggcactctgcagccttgacctcttgggttcaagtgatcctcctgcttcactcaagggtaggaggattagctaggactacaggcatgcaccaccatgcttagctaatttttaaaatattttgtaaagacgggtttctttatgttgcccaggctggtcttgaactcctggcctcaagcgaccttcctgccttggcctcccagagtgttgggattacaggtgtgagccaccatgcctggcttatcatttctatgatactgaagatctgattctgttttgccacttaataactagtaacaggtttaaaataggaactaatttagtctgttcatttgctatgcacatggttggcttcaccaagtaaaagtaaacgtgtcttttatttagttatctaaatgatctggatagaatatcccagtctaactacattccaactcagcaagatgttcttcggacgagagtgaagaccacaggcattgtagaaacacatttcaccttcaaagacctatacttcaagtaagtcattagcctttttgctaggtgtgccaaatacaagtatctttcattttagtttaccatctcttaatcagggtaaaatttctctgggcagtattccttggtttaaacttaacatatttatcagcattgtttgaatattttaactgaatgggggcccaaacatctcttgtttctccaaatagcgtcaaatgtttgtgtccttttagaggaatttaaattcaaaaataaatttaacttgcctcccagtaaaatttttcctgtgataactggtttgttttaattttattattttcagctgcttttttgttagactcaccaattcagatattgaatgtttaataggataacaatattaaacttatgaaaaccagttttttttcggttagttacatggttttgttttgccattttgatttaaaatagaaatgcttttctcaccagtgtcacttcttattggtttgaatttcccttcaagttgaatggaatggagcaagtattgtcatggctcttaaagtaatttgtgcatagtgtcatgtacaattaacttcttaatacagtgcagaatggaaaatagacttggggatagaggtattttgggttggtaagatgacatataaacagtgatttttttggtttgtttttaaatttttatttttttagagacagggtcgtactctgtcgtccaagctagagtggagtagtgtgatcacagcccactgcaaccttgacctcctgggctcaagtgatccttctgcctcagccttccaagtagctgggactataggctcatgccactgtgcctggctaatgttttaaaaaaattttatgtagagacaggatctctctttattgcccaggctggtctcaaactcctgggctcaggctattctcccacctcagcctctcaaagtgctgggattgcaggtgtgagccaccgtgcccagcccaactgtgattgttttagagagagaaaattctagtattctaatacaaataactttctcattagcattagtaattcttttttttttgagatggagtcttgctctgttgccaggctggagtgcagtggtgcgatctcggctcgttgcaacctctgccttccgggttcaagtgattctcctgcctcagcctcctgagtagctgggagtacaggtgcgttgcaccacgcccggctaatttttttttttttttttgtacttttagtagagatgggcttttaccgtgttagccaggatggtctctatctcctgacctggtgatccgcccaccttggcctcccaaagtgctgggattacaggtgtgagccaccacacccagcaacattagtaattctaaaacaagcctcagcttgtctctgtgttaatggtcttttataaatattagaaatgtttattttggttcccattttcttcttttgtgacctttgagattaggagtaaacttttccccttcaatataccatgtgttctttagttatggcattatgcttatatgtagaatgtgatgtttgttattattgcatacagatgtaactactacctcaaatcctctcagttctttctctgaaaacaactgttccacaggatttgtgaaatccacatagggtttacgtattactagataccagttggggtcttgaaatcctaatacaccaaactagattttttcctggtgcaggaaaatagcagttcagctatgaatgcttttagaatagacttgctgcttatctttagtactgatgaatttatttagcaagagcagcaaagaccacatggattatcactcgtgagaccataagaatgagatttctttgtataaggtttgtaatctacttataattaaaagttgtgatcattatttagtgttggaaactttcttattggtgttgttatataaatcagtctttagttaggcaaatcctaactgtcctgtctttttatgccatgatcaatagccagatctaattaaggtgccacacctacttgattgttggcatgtagatatcttgttatgaagtactatcatttcttccttttcctcttctctctaggcaaaactactatccatttattcaaacatttattgagcatctaccatatgcaaggcattgtgtaattgcttacttgcctctcagttaatgaggtaatgtttataaaatgttgatctcttagtgaatgatattgtaaatgttaatatgtgctaaaagcccaccttggaacttcacagtgttatacagactttgtagaagaaaatgggggagtaaattgaagttactggtgtgtctccccttgagacctccatggtgaaatatatgatgttagccttcctaaaacctgtattgtgaccctatattaaagccaacttgtgattacatcatttcaggtgtcatgaccaaaggtcaaaaagaatcgtgcaagatcaacccaaaggaagagttgggtcataaagagataattcctttcaagcatacattgagaaatcaccaactgtgtcttatttctttcaatttctgggggaaaacatctctggaaatgtaggcctctagtcactatagatcttatacattaaaccagtttggcagagtttagcctttaaaaattgtgtcattttcttcaaacaccgatcacaagtaacaatttgcatgtgtacatcattagacctaagtatcagctaaaacacaaagcagtgcagatctttttactataggaggtagttgaggatgctgttgatagaagttcagcagttgactcagaataccaagtaagtcacccagaagacagtattggactaaaactaatatggagtgtaacataaagtttgtgaacagttgagactttattaattaggtttaagtaagactcggagtttggaaatattggtcaaggctgttttttagttattgggttcatagaatcctaccataaaaatataatttatttgtttttacaattaatctctaattttttttttaaggtaaggaaaacaaacttaatagggagaagttatggaagcagagtgcaaatagggcatttagaggcaaaccattttgagagtcagaacatgggtgctggagttagagtgcctaggttcagatccccagtccctgtttgttagtagtgtacctttgagcaaatcatttaacattgaatgtgcctcaatttctttatctgtataattgggataataataatagtacttctaggagtgttacaagggcaaaatgagttaagatgtttagtagtagtgtctggcaccatggtaagcactcaataaatataccattattattattatctcaaactgttttatttagctctttgcttttcctgtcttttcccctccttcctttaatccatttcagtgcttattctgctgacttttcacacatctggtacaagctttgatagagaagaggctcagctatctaaaatgagaatctagattattcacaagttttattttctcatgttgttgtcttgtacttttagccaggataattattttgactgcatttaatctattctttttcttctattataaatgaagttttgaatatgtaatagtgggaagtttcctaatcatttcagtttaggggaaggtgtatgtgtgaccttgctgaatttgctttctttccccttgcgcaggatgtttgatgtaggtggccaaagatcagaacgaaaaaagtggattcactgttttgagggagtgacagcaattatcttctgtgtggccctcagtgattatgaccttgttctggctgaggacgaggagatggtatgttggagcttctggtaaaaagcctgtctaatgtagccaggaaatggaaaataacttattaggaagattatctgcatccatttcctcattcaaccaaaacttagtatctttaatttttttgatctgtgccctattactctaaaaaagatgttatagccaccttgagtatgtggaaaggatgttagccagcccttcctcctacctcctctcccccaaaaattacaaaaatgaggactgacactcaactttatcttattggtgtttgacttatttccgtgaatgccatttagtgctgcaaaacttgttggtttgtctttttcattaacttaatccacttttactatttgctactgacctatcatcctttatttctttttcagaaccgaatgcatgaaagcatgaaactgtttgacagcatttgtaataacaaatggtttacagaaacttcaatcattctcttccttaacaagaaagacctttttgaggaaaaaataaagaggagtccgttaactatctgttatccagaatacacaggtaaggggttatgaaagattttattggaggtacacatcttacttagatcaacactttggtggcattcataaaactgcctttttttttttaatgattgattgggagagtattcagtggtagtggcattggcattaagcctgtgattaaaagcccctaagtcaagagtgccatatcagacacaattgagttttctgtgtttattttaaatttctatcttcattttttgaggaaaatacaaaaggagaaaaagtaaatttgggagctgggcatggtggctataattctagctacttggaagcttgaggcaggaggatcatttgagcccaagagtttgagatcagtctaggcaacatagtgacacccccctgcctcacaaaaaataaagtaaaatttggtatatgttgaagaaaatacaagggtaaattttaatcattgtgcccaagagactgacatgtagttgcagagagacataaataattttattatagtgtttaattgcacataaataattttattatagtgtaaaatatgcattaatagaagtggaatagaagtggttacttctgatggggtcactgtagtctttttctagagctactaagaggatgaaatagaaatcatcaggcagacgggaataaaagcattttagaaaagaggaattgcatatatgagaatatggaggtaggaaaatggtatgaccagttgtggaacccagaaggaatttggtattactagagtttacagtggcagggaagaagtggttggagagatggtcagagatcaactcatggagggccttatatctcatgctgagacgatgatcagttaaaggtttaatatcctaccatgatccatatcatggggtgcatgatatagaagaaactgtgcttgagaaagattatgcaataaataataaagatagatagtaggggatttgaattagtaagaactcaggatggaaataaaaacttttgatggggattaagggatatatcatagaacccaagggcaagaatggacaggtcttagaatggaattagaactaggaaataattgtcaggaaccctggaagcactctttatccccatcttttttctctcctctctgtgtatcttttttattattctttctttcctaaccagctttctctgctattcagtttatgtgataacagcctagtcacagtttctgtatctctggtaaaaagatcagactaggctgggcgcggtggctcacgcctgtaatcccagcactttgggaggccgaggcgggtgaatcatgaggttaggagatcgagaccatcctggctaacacagtgaaaccccgtctccactaaaaatacaaaaaaaattagttgggcttggtggcaggcacctgtagtcccagctactcgggaggctgaggcaggagaatggcatgaacccgggaggcagagcttgcagtgagccgagatcgcgccactgcactccagcctgggcgactgagcaaaaaaaaaaaaaagatcagactagactgggattgcttggccttggtttcaaattccaaggagagagattctggccgtggttaagtcaggcagaaatctgtaggccaatcagttgaggtcaggggcacaaatgtaactgccagggatggatcactatgaaacttatagatcagaatcaggtatttccagagaaggggaactcttattagcagagacactgtaaatgctttctataataaagtgaggctgggtgcagtggctcatgcctgtaatcccagcactttgggaggccgtggcaggtggatcatgaggtcaagagatcgagaccatcctgaccaatgtggtgaaaccctgtctctactaaaaatagaaaaattagctgggcatggtggtgtgcgcctgtaatcccagctactcgggaggctgaggcaggagaatcgcttgaacccgggaggcggaggttgcggtgagccgagatcgcaccactgcactccagcctggtgacagagtgagactccatcaatcaatcaatcaatcaatcaatcaataaagtgaaggggtaaagcaggggtaaggaagtgggaagagtcagaggtactcccaggtttctgtcttggatgctggtgctgtgacctgaattcatgtataggaatgttgatttttaattattcatagaacgttgaaataatatctcatggacagttatattcgaggttgaggagaggttggggtttgagatcatcagtagtgaaaacatggaaatgggtgaaatgacctatggagataatattatagaatgaggagaaaaaggaccacaggtagaacgagagagaatagcagcctctattggcaggagaggaagaaagatatcataaccaaaaggagaggttaaaaagtgagttgattaaatatttcagtcaacagtgttatctgcagataagtaagatacatactgaaaaagagcctttggagttaacagttaggaggtcgttgacctgctgttgagagcagtgtcagtggaaagttgagtacagtgagttacagaatggaaagtgaagaaagaagacaagtgtagactactcttgagcaacgtgggtttaaagggaagggagagatttaagaatgtttataggctgagggctaagatcctataagcaaaagagatacattaaaaaacagatgtaattgaaggagcaagatttgcaagcaggtgggaaaaaaggaattaagagtctaggtaggataaatggataaacaaattgtgttatatacatacaatgaatattacttacccaagaaaaggaataataatagatggtacaacttgtatgaaactcaaaacactgtgctaagtaaaagaggccaatacttctattatatgatatatccaaaatagggcaatttctgtccatagagacagaaagaatattagtggttatgagaagtgggagaatgggaagaaaagggagtgattacttaatgggaatagggtgttgaaaaagttttgtcactagagagaggtggtgattgcataacattgtgaatacactaagtgccacagaattgtacactttaaaatggttaaatatctgttatgttaattttcctcaataatttttttaaaagagtataggtagagcaattgatttttgagcaagaagtaagacacctctaagaccagaagtacaaataagtgcagatatgtaacattttgagtgaggtggtaggccaaaaagttgagatgtagtttaatcctcatggcctctgttttatcaaggaagttggaaatgtggttacctgttcagagtaaagaacagagggaggtgagaataaggtgagtttatagaaagcaaccaagttttaggattgggggagagagatgtaagacaagtaaaataattggcattaatgttgaaggcccagcttagagtcttcacacaaagcaaagagcctttaatatcatttccattttctttgttgttgttaacttccaagcctatcctccattgtcttcattctgtgtacagattcttacggtccttatttgccaggtattattatctgttcctagcagacaaaattcacttttcactcatctgcctcctttaatttacagaggttgttttccagattttaagaacctgcttcaagcacctacaaagctgttttccttcagttctttaaatattttaattaatattcttttcctttccttttttttttttgagacagtgtcttgctctgtctcccagacagaaatgcagtggcatgatctcggctcactgcaacctccacctcccagattcaagtgcttcttgtgcctcagctctactacaggtgcccaccaccaggcctagctaatgattttttgatttttagtagagatgtggtttcactaagttagccaggctggtgttgaactcctgacctcaagcgatccacctgctgcggcccccaaagtgcagggattacagatgtgagccaccgcacccagctccttttttcttaagctccgttttgttacctggtcttctttatatctttgttattgatatttttgttatgcttcacgttactgaaaatagcctgtagtttattggaataatgaattgtctttgttgcgtttccctggctttatagccagtttctaaggctactctaaaggttctataagtagacaagatggtgtaaaaagcaggtgatttaagggtattaattacaaatattgttgagacaggctttgcttttggttcctgtcacctttctttttgtaaaaaataatagcttcattgagatataattgggaaaccctaaaattcactcttttaaagtgtattgcttttccttatttaaattattaccttaaggctttgaagctaaacctctttaaaactgtggaatgattttgaaaagaacaatttaccttgttgaattccttttttttttgttttaatacaaacaatcccatagcgtttattgccatcttttagtaacataagggtaatcaaaacactatgaatgaatgttcatattggaaaaaggacatctaaaagcaaactgtatccttctcaacaatttctcacttcattgatcctttctagttggagacactttgtagcagagtaatattatctccttttagcatgatccgacccagttgttttaaaaaatatggaacgcttcacgaatttgcgtgtcatccttgcgcggggactgtgctaatcttctctgtattgttccaattttagtacatgtgctaccaaagcaagcactaccctgttgaatttttattccaagatcactccaaggaacacagcctctctcagaccttttaagcagttgtgttccctagaaatgcaccttcctactttcctagtttccttttatactttctagatttttttagctgaaaagtctaaatgaaaaggtaaagagaaatttaacgttatgttttcctcaatctttgtgtttgatgattttattttgttaccatgagagtccactctcacgaagaacctaattatagaaacacctaatgattatagaaatagagaattctactcatatttaattgggttatgttccctctccataagtaaatggtaatggtctgacttagttgagttcaggcagctgttacaatttgaactgagagtactgggtgtccgttttaggttccaatacatatgaagaggcagctgcctatattcaatgccagtttgaagatctgaacagaagaaaagataccaaggagatctatactcacttcacctgtgccacagacacgaagaatgtgcagtttgtttttgatgctgttacagatgtcatcattaaaaacaacttaaaggaatgtggactttattgagaagcatggatgttagtgaaaggtaaagtttcatacaaggtagttatagtgctacagtgatgtctcttggtttttaaactttttctaattaagaatattcttctcttctagttactacagtgtggagtgttgagaccagacaccttttgctgtctcatggggcagctacaagcatgaacgggaccagggaatggcagcagcatgcagaatcttagcactctttagcacaatattttgtattagggaacttttaattgacatgagatgctaaagtcagacattggaattggaagaactataaagtgtgattcgatcgtcaagacatcacttggatttcttaatcttaaatgcttatggaagatgtgaagttgaggtgctgcattctagaacttcaatatgtagcttactctttttttccccccttcttaaaccaccagtggttcatttttaaggttttttcatcaagagaagaataactttactaaattttatttctttatttgcaaaagaatctttattaaaacaaacaatcttaactatgcacatgatgtgaccagatcatcttgaaaatattcctctttagtaggaactctttgtttttaactcttggtatggtcagaatataatacttccataattacttataattctttccggttactggggctataaatacaactttttaaatgaaatttatgttattatcctgctcaaagtaccattatggtttccatatggtaattacattggaaagttctgcaataagattctagttctctcttttctttaagcttatggttgaaggttaaccttgtttgtgcagattaccaaattactgctgatgtagtatgataaagtcagcttcttggatacagacacacccagggcagctgccaatcagaaatgcaaattgctaaattccaaacagaaccagtgactttgctgctacatatttactaaattgaccactttgattcttgcttgtttgtctcagttatagggagttttgtacatggtgcctcttgttttccatcttcatggccttttctgttgagaaacatctaaagtgtattaacagtgcatgcttttactttgtaaatgtggtgccaaatccctgtttgccatcgtttttactgtaccgatgttaactgtagtaatccttagccagtatgttcttttgctgaaactgttgcattttgggacttttttccactttgtcatgtgtacatttttaatctgttatagttggcggcagtattaaaatggtgagtaaagagcccaggtttgctcctgtttgtaactagtcttttctggaaatactgtcttctgtttccttttgcctttgcagaatgtgctttagcctttgtctgagaatgggtttaggtagaagggtttcctgaaagtctagtcttttggtgtaatagtattgttgaaccttaggttttatgttatatctgcatatgagtgatatgtgatcatgattcattttgcagatttacattttgcttgtgtggaaagttacgttcacttcaacctacagacccttttgtataatgtacagcaaatgtcattaaatattgaatgctctattgggggaagacaaatgaagagaatgcattttgagcatttcaaatcagtagtttgggcagtgccttttggggtccaatctttttggattggattctatttcatcttttgatgtgacttttcactagtttacaaaaaaaaggttggtggtcaacaaaaaaagcaagtcatagcagttcagtgcctttgttggtagtttttaactttttttgtgattctttttggaaaatcatagcttacagatggtataactgtattatataatggaattttctttaggtgtgggaaaacttgatctgaaagaaaattatcagcttcaattggcgattgattcagtgcccacaatgtaaacagggttggtagttgttactcattttgaatataccttttccttattgtattctgtaatataggatcctggaaatgagacctggtggaatattattttcaactgtagtctttctatactgtggactaatgaaatggtgttgttgataatctaaaataaccaataatccaaaaaagttcatttt

SEQ ID NO: 35804 - DNA, 53303 bp, Homo sapiens
ccggccctcgccctgtccgccgccaccgccgccgccgccagagtcgccatgcagatcccgcgcgccgctcttctcccgctgctgctgctgctgctggcggcgcccgcctcggcgcagctgtcccgggccggccgctcggcgcctttggccgccgggtgcccagaccgctgcgagccggcgcgctgcccgccgcagccggagcactgcgagggcggccgggcccgggacgcgtgcggctgctgcgaggtgtgcggcgcgcccgagggcgccgcgtgcggcctgcaggagggcccgtgcggcgaggggctgcagtgcgtggtgcccttcggggtgccagcctcggccacggtgcggcggcgcgcgcaggccggcctctgtgtgtgcgccagcagcgagccggtgtgcggcagcgacgccaacacctacgccaacctgtgccagctgcgcgccgccagccgccgctccgagaggctgcaccggccgccggtcatcgtcctgcagcgcggagcctgcggccaaggtactccgccgcgctcctgggcagctccccactctctccatcccagctcggacctgcttctgcgggactggtgggcaggttgaggggcagcgaagcgttgtggggtggccagggcaactctcggggacaggcaggtgggccccggggtggcggatttccgcgggctgcctcggaaccgagcttcgcgcccagcccggggccggttctgcgcccagacgatgccagtacgcccggcctgcactctggggctcgagacgccgggcgaccggccatggagtgccctgagggcaaccacacagcgcggggaccccaggacaaataagaggaatgggggcataaaggaaggagagaagttcaggactgggaattggcgcctcgcagagcggcttcaggaccacaagaagtcatttcggttgctttttcttctatttacgtcctccgtcccctttaaaattcactgctttgatcacgggaccgctcagtgaaaactgtatgtaactcttttggaaaggaacagtgtttgccggcccgccccggagtttctccaaaaagtctaccccgagcagggaacggtttggcaccgctctcgtttcggcggcgttgctgcctgtcttgctttcctcgttttgagccagccctacaaaaatgaaagtggctccttttgaataagctgaatcgggctttggatcacgaaatctgcagaggcggagaagggaccgggttagtgatgaggaagaagtctacccctctgttcctacagccgcacacaggacctgttctggcaggggagacggtggtgatgggggaaggagtggaatggagcaatgtctaactctctcgcgggaccttccggagagatgctcctcatcttcaggcagaggccatgtggaaaaataatatcgagttcagcagcggccagccccgcgttgtaggaaccagacagcggggcttggcagtgcgcttgggcgcagccgtgccgctgctgccggaccccagtgctgcctcctcaacacgggcagtgccaggagaggggcataggggagcacagtgcagagggactggtctagagtttactttataggaatatggttcggtgtgaccaactagggcttagcatagtttggcttacgtggacgggaagatgccagagccgaactgggtgaaattcgagattgcgtatttcaccaacacaggagcacagccctcgggaaactcagcctagtcaggcagtagagagttgtcccggagagaagtgatcctgcagactcgagaaggggcatgatgatagcacacgtctgttgagcacccagtctgtgtgccgggtgtgttacctctgtgacctcatttggtcaaacgaggaggcagttgctcctctctctctctttttttttcttaagagacagggtctccctctgtcgcccatgctggagtgtagtggtgtgatcatggctcactgcagcctccgacccctgggctcaatgattctcctgcttcagcctcccaagtggctgggactacaggcggatgccaccacacccagcttctcattcccgttttacagatagcggagctaaggttgaaaaacttgcccaaggtcattcagctggaatttaaacccagacagcctcattcagaggagtcagcccagcacttaactccaagggtgtgggagaggggtcaggtgctgtaaatttcctggtgggctggacgtgcatccccctcagagctgggaacagcatacacaaagcctaagacttgtttggaggtgaatagatcagtgtggctggggaacgttttgggagggcagcaggagtgagccaggctggtggcccagagtcccagggctgaagaggctggctgtgccccgtgccctgtgcgcagatgttcttgaactggagcaactcaaagcctagtgtagtgtagggctgacctagcagtggagtgcggaatgcatccagggtggagagtttagactactgcaataatctgggtgtgaggcgacaacattgaaaaagcatgtttttgtccaaaacaagccagctgttactggtctcgctgtttgtggtctcatcgcacggggtcctgagttgctggcaccatgcgagccgcctaatttattgctagtgaggcaagttgcttaacaagttttggagttggctgagtccctgtgtggaggaaaacaggtcccccattggccatcgggctcacagcgggcccccggtgtaccagtgaggggacagccacagagggataagcatggtggctttgaaaggagggagagacagagtgggtacaatgcttttcttatccctccctccttcttttgcaaatatttattgagctctgtagggtgtctgacaccgtttgcatgtttgtctgtctggcacatcggaggtacttggtacgagtggattagtgaatgaataaatgaatgaatgaagacaaacgggaggtgcttgcgatacacagccattctgtttttccttagtggaaggcactgctttgctgcgccccctctctggatctcacactccacccttgacttttcggaggtgtttccgaggacaggcgcctgggagccagcagacttcattcagtccaagccaggctccaggactcaacagctggtgcccacgggcaggtcacttgacgtcactgttaaatgaggtgaattggctgcctgctctggctggaagattggcgggagagtcactttagctgccatggacatgagccttttctaggggtgccacttgactagaggcctggagttggagcaagtcatacacggatctggagacagagctctcgaggcaggagcgggtgctgcgatttcaaatattataaggtggctttgtctggggcagagcatgccaggggatgagaggtagaaatgtcatcagatcaggggtccccagggaggtgactagcactttgggtcacagtagatctttggatagaggaacatgtcaccattcaaaggaaagcactttcatctgtaagctgtttattgaatagacctcagagaacatctctgctcaccgctctggaaatgaaggcaaatcatctatttcagaagtcaatgcactggcagggtttggatgggaaagtatacaattcagctagagaacaaagatctgtcatctccagctgtactggtcagatgattacaaaaaagaaaggaattgaaatactaatagggtactaataatgagggctaacatatatgttgtgcttattctatgccgggtgcatactaattcatttgatcctccggacagtcctatgagtgagtgctgtagtcttccctgggttacagctgggcagctaagtcacagagaagtaccttgctcaggactggtggtcccacacaactggatggagagcctcgttcataaccaccatgctgtgctgttgacagagcaacagagattttaaaccaaccccagctaagccccagctaatagctgaaataaacagggctccagatggctgtggcttagagatggaacaggacagatcacagccttcactctgcaggctcaggagcctgaagacaaggttgcctccagttgccgtcagtgcagccctcactaaagaaaagcaaaaagagccgagggactgtaggaaggctgtttccaagccagagatccagacaaactgctcttgaagagagaaagcccttccagattcccccatgtcccaaaagaccagccgggattccggacctctgctaaaacatggacaagaagccaggaacgagacctgaaacagacttcccaaacagcagaagcctcatccatttctcctgctagtacatcctccaggaaagcccaccctactccatgcagcagcccagacaagcttggaggtctgcaagctgcaggggtgcccagaaactccacccctggaggtttttaggatcgcctgctcctggtctcaccccagagcctctaaaggcagaggctgtatgtacatacctggtgaagaaccaagggcttagatggttgctttacttcttggagccctggaatgtttgtaaaatttacttttttttttgagacagtgtctcgttctgtcgcctacgctggagtgcagtggcgcgatctcggctcactgcaagctccacctcccgggttcatgccattctcctgccttagcctccagagtagctgggactacaggcacccgccaccacgcccagctaatttttttgtattttttggtagagacggggtttcaccgtgttagccaggatggtctccatctcctgaccttgtgatccgcccgctttggcctcccaaagtgctgggattacaggagtgagccactgcacccgtgccaaaatgtactttatttaggtgactctttcgtgggaacctcaaacaagcaatcattgctagctgagtgctgaccctgtactgagctctggggagacagggttgaataaaacaaagtcactgcccacaggtaacttatattcaatacaatgggggaaaatacaatcactgcttccctggggttgtatttttccattgttaaagtgggcagtttgctcgagagtcattttcactattggcaattcaaatacaccttttgtcagttaaaaaacaagtgtgccagggacctgagcttcatcttagggcagggtgggtggaaacatttgtgagtctccagcttttagtcacctgaaacttggaaacttggaggtcttttgagcagtttatgagtctctgcctgctctggtcggctgccttcttttattgctctgttggttttgctaaagagttaaaatattaaggcttcataaaattaggaagttaacaagctcaaaaaccaagtgtttgagttacttcattccactgagagagctgtaaatgggttgcattggaacttaaaataactgcattgagtaagtgatggtggcgggcaccatgagctaactgtggtcagaagcctgatggcctccgctttggggctggattctccgtttggagctgtgtgatcctggatgagtttcatgccttggattcagaaatcagactttccatgagcttatatttcaagtgaataaatagctctggtcaggcttaatttgaagaagaagtaagcttggcagtgggtgagggttccttggaaggccaactggggcggaggggctgagggcaagcggctctggcccttcctggggtgttacctgaccaggtaacagctccctcgacctctcggagcctcggcagtgaggggattgggccagttgatctctgaggctccttttaactagaatggtctgggatttttctaagaaaacaagtctttgaggaggttgtggtcacctcattcctaatttaaagcctggggaggcttccttatgagctacttctttttcctaaattattgatggttaaagccaaggctggcatcgaatagatgtgatccatcttgagcctggttgctttgtgtttcagctttgtactggctgctgaagtccccgggagaccacaggggtgacatgttcatctccaagagatgagcttccacgagactcataccccttgctccttccctggggctccaaggcctttgggtcatctgaagtgagatacccttgtgtcatttcatcttttccttctccaccttctctgccgttaaaaaaaaaagaagaaagagaaaaatcctattaatagagaaaccgagaagtgtagccattctgaatgtgtttccaaaaggctcctggaagtggcatggaagttacagtgattcagcactacttggtgacgtgtgcctagaaccacagggggacattagccaggacaacacgcctcaggacagaagtaagtggctgcgaagaggcatgtccatcactgccggaaagatgcagagttcagtttttggagtcagtgctgagagttccatttctaaattcattcagagcatttatttaacacctactgtgtgctcagaagtgtatcaggtatggggactcagaggtaagggctggtggcccctgatctcaaggtactcgtggtagatagtatgatgctcagcttaagggctgggcttctgaagtcggattgccattttctggatgtgtggtgtttcttgggtgacttcatctctaagtctcagtttccccatcagtaagataagagaagtaatagcagatacatacgtagctcttagggcattgcagaatggaaggacctccttatatgaaacgcaaagcactgtgcctgatgcattgctagaactcaggcaatattagcgtgttgtcattgtcatcatcatcatcatcatcatcatcatcatcatcatcatcttcaaggcactgacaaaggagtcagctgtgtgggaggagtgctgggacactcttgtctccctggggatgaggtgggtgggtgggttaggaaatcttcacagagaaggagggtgatgtgagacttctgtccgggagctgactcggaatttgccatctaatatgttggaaaaggttctctgggcagaggtatccaaagtcactttgcctgtcaccctttgaggtcccagttgttgcctatatcatgtgaccagtgtgtggcttctcttgaattaagagctgcatgtctggactgcctgggattttacagatgtcatctcgttaactctccctggagcttgtgacacccaggagatggcagtttatagaagccctggcaccttcttgaatgatgcttggtttggtttctatgcactgggaattcctcacaaggaaagatttgtcacatcttaaggaaggaaaaaaaggcaaatttgggagtccatggataccctattattttagattccaggacaaattgtcgaataagcacgtttcataaaaacaatcctccgcagcatcccgtgacagcagctggtccctcgccacaggataattatgtctccttgtgcacacaaaagtctccgagggcatattgttgtggctggagtttctgataatttccaaattgaacaacctcagtcctaatgagtcagaggcttgtgcaatattttcaaacctcaggaacatctttttcattagttgtgcaataaagatggtaggcctatctctgtgatgagctgtttttttttctcaaagtttgatgagattcgccgtagaattccttctcacatagtcttgggcaagattttacccgatcttccaacacatgagtcatctcatatcctgtgactaagaagagctgtctctttggtgccagttttctaagtgcagtcaccacttgatggagacggatggacacagttgggattgcccaggcagatgggcaatcttgccagctagacataggggagggaagcctcaatgttcagcggtcacatctgcttttctgtggcacagagtgagctatacaggaatattgtattctccaggacagttagggcagtgggaaatgtcatcaaacagaacagtgacccaaagagccactgccactgggtgctctgtgggagctgggcactgtgctcattgtgttatgggccttgctttgttcttaccttgtagccacccagagaggcagggcattatccttgcttcctagctgaggccacagaagaggctcctagaggttagctgtaacttgtccaaggccagccagtgcaaggaggcagagccaggatttgagcccatgtctgtttcactcccaaactattcttcagatttctttaagtcaagtgttatttagaaatgttttgtttattcatcaaatatttggtgggtgtttccagctatctttctgttattaatttctagtttaattctattgtgggctgagaatatattttgtatgatttctattctattacgtttgttagggtgtattttctggtctagaatgtggtctgtcttggtgagtgttccctgtgtgcttgagaggaatgtgtgttctgtcattgttgaatggagtgttctataaatgtcacttaggtctagtggattgatagtgcggttcaggtcaactgtatccttcctgattttctgcctactgatctatcaattcctgaaagagaagtgttgacgtctcctgagtctattctgaaacactgaattgcggtctccatgatgaaccactagagttagaaaacctgggtcctagccccatttgggcctttgggatgactcccttctgcctcagtttcctcatctacaacagggggacaatgatgctgcctaggagacatcagcaggatactgtgaaagtccagtggcataaggggtatggaggagcttcgtcaactcctaaagcttcagtgctaggaatcctaaagcattgaaatccaaagatataaggaatatgaaggagttttgtcaattcctaatgcttcagtgctaggaatcctaaagcattaaagtccaatgatataaggaatatgaaggagctttgtcaactcctaaagcttcaatgctaggaatcctaaagcattgaagtccagtgatataaggaatatgaaggagttttatcaactcccaatgcttcagtgctaggaatcctaaagcactgaagtccaatgatacaaggaatatgaaggagctttgtcaactcctaaagcttcagtgctttaggagtcctaaagcattgaagctgtaagagattaggacctctagttggcaattccagactcttccaggactcctgatagagccaacaccaagaatagtgaagccagaaggatggaaatagtaaaatgcctcctgggtgtcaaagcatgggtctcctctgggcatgttctcttgtcctactgagacatgatagctcttggccaaagtgactgaacttgaccctctgtttcaggaaggccaaatgcagggttcactaccatcatgtccaagggcagatgcgttggtccagaacatcagcatcccaatcattataccaagcaaacagccgtctctgcctgcaccgtggagagcacacgctcctcctggggtggcctgcatcctgtgttcttctcaggccgactttctgtttaatgtttgctggtcaggaaatggcctgagctgaggttcttcagatcccagtctgacctttctccaccagcatttgtggctctgaaaaatatagcccagtgtggtttagccccactggatgaaacccagtaggaaaagtctgataatagcagaagacgcacaggaggaagagtgaggatttgagagcatctgggaaggaccatgtgcctggatatcgttctgtctgtgggattctgtgacacttgtcatttacagtctgttcccatggaattctcatcattggccaaacatatagtccttctgtcctctgaaaaatatcattctgctccgacctttcacacccatctctgaccacatcaactccctgtttgcatgcatcttgtggatgaaggacaccactttacctgtaaagacactggtggcttcccaaagccaccaactgacttgtagagaagacagaatcccagagtatgaaacctgagggtgaagggtcctggcaggtcctagagctcaacccttcacttcacaggtggggaaactgagggagccaatgggaacatgactctcacaagctgcacagctcatctgtaggggccagtgtggagtctgtttgtcctgagacccagggctgagcctttgagccctccgcatctcagccgcatcctcctgttggagcagttaggtgtttgggagaggccacggtccatgctcatggttttcctgtaaggctggagaaacaggccttgttcccttagtctctctaatcaaaatgaggttgcagaaaacccttctccctacttctccctaaaataatttccttgggttagaagatgactaaaagactattcatccgatgactgatgtctcccttcaagagttataagcacatataaatgcctttgaatggtaattataataattttgctgaagggaaaatatcagtataaatatcatggtggacacatggaatgaggactgagatgctttcatgtcttttcagctgtggttagattttctttaagcagaatatacaagtttttcctctcctagcataaggactctttttttttgtatcttttctctctactttttagacatgatggaaaatgcatttatacatttgatgacatattgtactatctcagttgtttaaaattataaatgtaatttaatcatatgaaaaattaagaaaagaagattcatatttcaccatcatctccccagaaatatcatttctttattactattattattattattattattattattattattattattattttgagacagggtcttgctccatcacccaggctggagtaaggggcacgatcttgactccctgcaacctccacctcccaggttcaagcagttctcatgcctcagcctcctcagtagctgggattacaggcctgcaccaccacacccagctaccttttatatttttaagtagagacagtttcgccatgttggccagactggtctcgaactcctggcctcaagtgattggcctgcttcagcctcccaaagtgtggggattacaggcatgagctaccatgcctggcctaattccatcatttctgtcccaagtgttgccaccgtttggttaactgttcccctgttcacatccatttgggccaaggttgcaatgttaaacaatcctgagatggacattttcatgtttatggctatttctgtatctagggtcattctcttaggagaggtactaaggagtacaaaaactgggaagaaggatatggaatttttatggatctggtataaattgccaaattattttccagaagggttgtagccatatttgttgccatcagctctagaatttcaacctcgtaagtcactgaaagaaattctcccaaaatcaatccttcaggaataatggaagaagatggtgccaaaccccagccattctgctcactgttagattccttttttggtcttacaggttacttttattctcaggttgatggctcttagagttgagcaatgtttggggtagaataacgagcacttttaaaacttggttctacctggggagggggtgagttgtgatcacagacagtctcacctgggaggggcttgggtgtttgtcggcttgtccttctaacactcgtgtctcaggcgagcagcctgggaccagtgaggtgacctgaaggctggaggtcacaagctaagaggcgacagagaacccaggtctcaggaagcccagcccagagctcgctgcactgagcctctcggatgccagctctgtccaggatgcgggaggaggccagactgatttggtctgttttgaaaagtgatgaaaatatttattcaaatgttttgtactcataggcagaagtataacaggagctgcatatacaaaattattttctagtagtcacattaaaaaagtaaaaagaaagaacacgattatttttctttttaaaacagctttattgagagataatttacatactataaaatttacccctttaaagtgtacaatttgctgttcttatatattcacaatcatgcacgtatcactaccagctccaggacactttcatcaccgtaaaaagaaaccccgtatccattagtagccaccccatacttctcctctgcccagccctaggaaaccaccggttcattttctatttctatgaatttgcttattctggacatttcatataaatggaatcaaagaatacgtaacgggcttctgtctcttagcataatgttttcaaggttgtccacattgtagcatggatcattatttcattccattttatgattaaaaatatgccttttaagggatacagggagaccagacgtctattttatctcccctccctgatggggaatcctaatttcagcctggaaagtcactgcgaaagtctaaactgcagaggtgatactgtttccactggaagaaactgtagcacctgactcaggaagccagcattaaaaccaagaatattctatatggatggggattacgcactgaaaggaaaacatgaggaaatgcacttttcagatttattagatcatagaacttttttggagctggaaaggatgtcggaaaccgtctagcctaccccctcatcttaccactgaggtaactgaggcccaggaaggggaagtggcttgttttgggtccgggaccactcttcatttcttatttgagccaaagcttccttctggcgtctgtctctgtttcacaagttcccctcgcatgggggctgggtactgcttggaagaactggcttcttccttgatacaggggctcgttcaccatcacctccctccctcacgtctcttctgcctctctgcagcctcaggccctcctcctgcaccaggggggcagactcaacccgggtgggcactgcctcccagtccgtggccagaggctggagggctagggagactgaacagccccggcagctccagacataacaacctatgttgaggagtcagggcaggaagcgaacccagctgagaaatctgcgaaggtcaggaccagagccagacgcttatcaagagcaaagttaatggtttttgtgaaccgagcagtcagctgtttccccgaagataataatagacacatcatgttgggcattcaggaggcatctgaaaaaaaaaatgtgcagtggaattgattggaagcttttccctaatgcataaaataggccagaaaagactatcaaatgtaacagcaccgatcaaacccaatagatcaagcaaggactgaaaaacacaattttttttttctttgccagtgagtctgaaaagtgattttcaatgacaggcgcctttaaacatagacaacataaacaacaacatagttgttctggaagaggcatcttttcccagtaaagccaaagatgcagatctaggctgtgcttgtgactgacagcacagtgaggggttcacagccagctggccaggtgccccccgaaagcacatttcgaatctactctatttgagagagactgccttagccttgtttgggtaagtcttcctccttcacttcacctgccacagacttttccaggcaccatctgctgcagtcttggcccagcccctgcaacagttactgctcaaggcacccgggacatgcaggacgggggagcagcctgaggtctggcgtccggcgagcttttcccacttggagccgtctgggagactgtcccggaaagagaggggctgccaacacttggaagtgccaatgtgtgctgcaagtcgaggccaggctcccggctcccccgcctcttcctccttgattcattaaaaggaaagaaagaggccacacgaaactctcctgaatttcatttctttgtttctatgcaaaagacagagcgtggtcattcatcattcaaattttagcctttttaaacaaataataattcctgcttgtgaattcagtgtattttaacaagagtaggtctgagggccgttggccgtgtctttccttagatttgcagacagcggccctgatggtgcatagggtttcaggtttcctttagacctcagctggctgcctgggccaccacttagcaatgccattgtccttcctgtgcattttctttgcagaattcgaggaaatccagtcgcacaggcccctctgtgcccatgtccccggcgccctggaatgtgcagtaccagcagcagcgattagaatgggggtctggtttcccggaatgtgcaaggtctggcttctgtttctgctgcctccatgccccagaccagtgctgggccgggctctgggctggagccgtggctgacaagtttccttggaatttaatggagcgggccagacagcatgcagccactcaaactgaaaacctgggaaagaaatgagtgttgtggggcagctttgctgcattcactgggtcatatatgcttctttttcttttcctcaggcaacccctcttgcagacaggaggccccctcccctttcgcttcatgcctcactggccattaggaaccttttaaaactgatttctctcctgaccctcagagagaacatagtccaagttccctggaggaggaggaagcgctctgtgtttctctgcagttcacggctcagttaaatgcagcctacgtgctgtctttccccactcctctgcctgctcccgttgtgcttctcatgatcattctcaaattcagcgagaaacctcacaaagggagcttttcttagggaagagtcatccttggcctcccgaatgtggaccagcccctctccccagctgcacagcatcaggttagttaaccacctgcctccatctgggtcctgtctggacaggcctactcacacctgctgcaggcatccaacttgccctcaggtgcctgtggctcgtccagaggggtggagcccacattccagtcctgacaggtaaagttcagtggcggggaccctgcatttagtgtaaagatcaatattccaggtcctctcttcctgccacccagcgactggccgtttgcaggcactcggtcccagttgtcctgggcctgcagcccttgcattctctctgctttgtctctgctattgcacccctgccccatcagaaatgcaggtgggggggccttccgctgggacagtgagagactgggtagtaaggggagcgctagagggatggttgcgcttgcatccagccctgactgcattcgctctcccccgcctctctgtgaaggtgctgagctgtgagtggaaccaagtggatgagagtggccttgggcacctgccgataaatttcccggtgtgtcttctcctcctgggagtcccatctggatttgggtctggatttatttattcagcaagtagcctctttatagttactttttttttttttttttttttgagatggagtttcactttgtcacccaggctggagtgcactggcgcaatcttggctcactgcaagctccgccttccaggttcacgccattctcctgcctcagcctcccgagtagctgggaccacaggtgcctgccaccatgcctggctaattttttgtatttttagtagagactgggtttcactgtgttagccaggacggtctcgatctcctgacctcatgatctgcccaccttggcctcccaaagcgctgggattacaggtgtgagccaccatgcccggcctgtagttacttttaatttagccatgctcggggctgaaggggatgccaaagaaatataagatgagcccctcagacggctaaagatgaagatgaggcctccagtatgtacctcccacatacaccccaggaaattctgggtgtcactggattctggacctcccaaaagctgctggcacctggaggatggggccccgaggctggacctcactcctgctgggttgctggactgggaaagtactgatggcagctgaggagtgtgtcccagacttcactgagccattcccaaagattattccaagttctcctgacactgcactggaggcctgctgtgctggccttctttatttacagtttctgactggtgtctagcagccctgccagagagagcggcagtgtgtctgcaggcgaccaggagaaatgtctcaggctttagagcaggactttgagcacatagctgtgggggcccagcaggctgtctcctgcacggttacttctccttgtcctttcatggtcgagaggttgctgcctggcccttcaagtgaggatgggacatgctatccattggccttaatttccaacctctgcatgatgcattttatgctcctgcctttgaaagaacttttattttcttgtcatttatgcccagaccccacatggcagaaggaagggaggctgggacaggggaggcggataagctgccgctgacagacctgcccagtttcttagctcatcccggcctccatcctggtgagcagacactggcccaatccagccatatttttggctgagtttctgtcttcacatctcatccttaaccctgaatcctggccatagttggtactgggttgtattcttatttgtaatctttaaagtaggaatacctttgctggtatttaaagtggaagaaatcaggtgaagaatcacaagtgatttgcaaactggaagagacattagaatgtaaatgtgaggaagcgtcagcatgaggggcttgcctgggctgcacagcttgccttggctggagtatgcactgttctggcattgcagagaggatgggtaccttgcctccctgcaggtgggggactgtatcagcccccgcagactgctcctgggctcctgagtttgacagattttttttttttttttttgagacggactctcactctgttgcccaggctggagtgcagtggtgcgatctcggctcactgcaagctccacctcctgggttcacgccattctcctgcctcagcctcccgagtagctgggactacaggcgcctgccaccacgcctggctaattttttgtatttttagtagagacagggtttcaccgtgttagccaggatggtctcgatttcctgacctcatgatctgcctgccttggcctcccaaagtgctgggattacaggcttgagccactcgcccggctgagtttgaccagattaaggcagcatctccagtggcacctgagcagctcctgagatgcttttctgtgctaaatctggatttggggtattaaatcaaatgaatttgaaatgcaggcacagctggccccatgggcatggacctgtgcagtcacaccttgccccgtgttcagaagggtgctgtgcctgttttaatgctctgctgttgctctcttgagattcttaataatttttgaacaaagggccccacatactcattttgtactgggtactgcatattatgtagctagtcttgaatctaggacagtgcattaaaatgccattgattggatcaatctgctcttgcaactgatttgaattttgggaacatgctgtttcctgtgaataaaggaggattcatttcttttccctcgaatacactgcgttctgttttccaaattagctctacgtatcaactcagctgagaaattggaagcggggattgttctggctggaagggaaggttagattgttaatcctgcatcctggccctgatctcaccgagtgtgaagcatgttcccacaatggtgtgggctgcggggggctggaggctggctgagaaggtggggaccaaggagggaggctagcctgggagccagacagatggggttaggctcttgcttttgccactcgccagctctgaggcttagggcaacatgatttaattctctgatccttgtttttttcatctttctgtagactggtgatgagatgcaccctgcaggcttgcaggcttgcaggagtaattaaaggtaatatttgtgcctattattgggcttgacatatagtagatgctctacaataaatagatcctattattcttattgataatattattttattgctaacattgaaggttgggtgggatttgactagctggaggcgaggagaatgagatcatccaggccggaaggaaaagagacatgaatgcagggggatggggtggagcactttggaggtgtggggagaggtctgcagggtgggagttgtgcattaaggagtcgtggggagagtggaggaatcagtgccacatggtgaatgagaggggatcgtgggcccgaggagatggcgatggctgcggggatcctgcaggaagtttatgtgccccaaagtggcattatcagttagggggagacactgaagacagaggtgaggcctgcctgaattagcgtagagtgggattcttggaagcttcagaagcttgagaagagccacttggaggtgttgaaatgcacctgggagggacgtggggacccagctctgggctgagagctgggagacggaaacgcaggtgaccttggccttgaagatggggcatgatatttagtgctttatgtgcaatctcacctaggactcccaagccctttggagtaggtgatattagctccgtgttacagaaagggagactgaggctgaagcagggacattcatgatctgaagtcacacagctgtacggggcagaagtgggcatggaggcattaacttagagccgaaaggtgtgacctttcttagtgtggctggccccacggggaacgtgtgtgggttggagtacaacttggtgttcctacccatcccagatgctctgcgtttgtgaaccccagttgccacatcagggcgggcgagggcaggaagctctgcagggagaagggacaagggacagagccaagaacaggggcagtgccccagggtcctgcaggggcaatgaagggggttggcacacctgggttagttgctggccagtgtggggagagagctggcctgggagtctaatgggaatgccagggaaagctgccttggtcccctaaagtgaagcccccatgctggccatggagtgttggtgattgagggtccctgctagttgtctggccgaggcagcatgtcctataggcatagctctggtgtcctgctggcgtggcgtgagtgcccctcatgctgggagccagccctgtgctctggagggaggtggtgggaggacaagggacagtgggacctgccacctgagcaggaattggcaccttctcccactggcaggtccaggttttatggaatctgaaacttgtacaattcagtataccctcttcaagaaaaacacccctcaaaattatgaatataacattaggtatgaaactattattgatatagattgaaaaaagaaaatgcccaaaatgacaaacttcagaaaatagacaaatactgcaaacatcacaaaatcagaaaaataagattaaaaaaagctaactgctgaacactccgtcatcttgaaaatgcccctctctcctcctctattttttggctgtgaactctttgctcaccttttcatgtgacaatgcttttgtaatatttcctacagagaaaatagaataatttattattacttttattgtttttggattattattatgatcaattcaatatttttctgctacccacacactcactgtcttctgtccaacctctggcctgcaccaggggaaccagcagtttcccctgccatagggtgtccctggagaccacacatatagcaggatagatatagcaatttaactagacacagaagggacttcaaagccacaaatatatctcatttaacctgaacaaaatgattatccagttttacttttcccttagcctcttcccccaaatgctggcagccaccctgatgggatagatgtgtgacagagggcaagagaccgtggccccaaccagctgcagcttcactctttcatttctgtatactctctacaagctgtgatgatagcactttgctagggcccctcacagggcagatggagggctccacgctgaagctttgtggatgtttgctgtctatccacctctgctccttgtgcctatgcagggattcaggcccaaccactgcagagagcccaagagcatcaggcagaggttcccaaactgtcatgattggtggcacctttagtagttgatacggtttggttgtgtcctcacccaaatctcatcttgaattcccacatgttgtgggagggacccggttggtggtaattgaatcatgggggcagatctttcccgcactgttctcatgatagtgaataagtctcccaagatctgttggctttataaaggggagtttccctgcacaagctctctctctgactgctgccatccatgtaagacatgacatgctcctccttgcctcccaccatgattgtgaggcttccccagccacgtggaactggaagtccaataaaacctccttcttttgtaaatcacccagtctcaggtatgtctttatcagcagtgtgaaaatggactaatacagtagtgcagtcattttttcatggtccccagtaaggccaaaaaatacccaacagttccatttatcaattagtggaggccaaacaatttgataagtatttgtgtccctataacacagtggtcattaaaaaaagacattttaatttcattattcaataagcatgattacttatgaatgggatatgtgcacctgttgggtgtcacatgacctttcaaatcttggagtcagattggacaccaccatgcccatttccagttcaactctgatttttgtgtggtacatgctttttatcacagtgactgccagaaatccaacttcatatggaatcatgaaaagggatgtagtgtgatctgatttcaaaactatgatcaatctagagctagtttacaaggtgtctaacagtgatcaagtatcactgtatttccctagaaaacctgaaatatcgatgaattttctgtggcactctggggtcccttggggcacactatgggaaccatgggattaggaccataaggatatgattttggcttcttcctgcctcagatctaatctttacctggcatttttgccttaaagatgaaagaagcatacattttgatgtatttaaagcacatattcggccaggtgcggtggctcacacctgtagtcccagcactttgggtggctgaggcaggcagatcacaaggttggaagtttgagaccagcctgaccaacatggtgaaaccccatctctactaaaaatacaaaaaatagctgggtgtggtggcatgtgcctgtaatcccagctactcaggaggctgaggcaggagaatcacttgaacccaggaggcagaggttgcagtgaaccaagattgcaccactgcactccagcctgggctacagagcaagactctgtctcaaaaaaaaaaaaaaaaaaaaaaaagcacatattcattttgtgcttattcttttgagagaaacacagataaaagcctatcctttaattcatactccccatactgtgattttcatttttactgcaacaaattttgttcagtgtgataatgaatgtcaaacacttaatgccttgctcttttcagtaacatgacatattggagaataatgactgaagcttatctacactgcctacgtctgttttcttccaccttgaaagaagttgttgaaagtaattaagaagtattatgtgtaaaactccagggatgatgtgcttcaaggaagcaacatttatgaagttgtgtgcttgactagtagtttataaagaggaaagacgaatcatttattgtcttgggattgaatcttggcaatttttaaactataaagttacaggaaatgttggctgctcttaatgggccatttgttgtgttaaaaatcagtaatgagaaatatttactaggtaagtggaaagatccatctctataaattgttgtaacttaccattttacaaatcttagttactcagtttttctgcttaaaaatgaaatcatgtagcactgtataagtcattcagttttttattttggagaattactctggattgtctaggctctgtgctctccacatatatttttgaaatagtttgtgaatttctacaaaaactcctgctcagaattttcactgagagtatgcttaatctatgggttaatttgtgagaaattgatagcttaacaatagtgaatcttctgatctacaagtgtggtatttctctccatttatttaggtcttctttattttgatagcgttttgtagctttcaatgtacagatcttgcaaatatcttgttaaatatttccctaattacttgatatttatttttgatgctgttatagttatattttaaaaattttgattccaattgttgctaatacatagaaatgaaattatttattgacctcttatcctgtgacattgataaacgcagtcatatattcgtagatttctagaatttttctatatagactatcatatatatcatctgcaaataaagacggttttacattttcctttccaatctctatgccttttgtttctttctcatgcctcattgtgtggtccattactgaacggcagccagttccagctttctgttcaattaaggagcaggtaaaatggccaggccttgacctttcagggggcttcccgtcctcattgccttctgctgcctcagttctggcttaacagaacagtgtggggaggaggcatggtccttacctactagggcgttacttggccttcttcaggttggttgcttcgtcaggtttaagagctcacctgggctgcagttcaggctaggttatctgctgacctggccctgtctcccttctgtagtgtctgtggggtacccttgtaagctagggagaagagacacacgtgaaggccagaaaaaacagcctgccacacagcttccctggatcataccttcgcagtgacatgacgacgtcgttaggaggcgccgaggtggctgagtgggtctccagacacctccctttacctctctgctgtgccactgatgtgtgacttgcttacacctatgcagagctgccactgagcagcactgtggccagtcctttggattttcttctttctaaattgtatgccgtggcttgatcaagcatttcatatacagtagatcatgaaatcagcatagaaaacacattgaggtaggtggtgttaccacattttatggatgagaggctaacacttggaggagtcaggtaacatgtccaaggccacacagctagtgagtaccctgctgagggtcacactctggtccatctgaggccagagcctgtgccagccttctcctcatgctgatagacgaggaaacagaaagaaggagcagtggacgcccccaccctctgtcccctgaaccccttggagagtaggcagtggcagagccagcctgggcccatctatgggaattctccatcgggattgactcctctggaaggaagacagttgacccacagttgagatcacagcagatgggccagccagggtgtctgtagaccatcaggcagtggccactccatgtagtttaatggacaagcccttttaatggaacaggaatctaacactgaaccaagctgcttttagacacacttttattcctcactctgaaatggcgtttggacaagccaaatatttcttcttctttcagttgacattttgtccatctttgaactgttagttgatgcttcttctgtttagttattcctgttctattttcctgttgccactagtccacccagggatggtaagaatggaagtcaatggttgctttttcatctgagatgcaccacgaaggcttgtcagtcagccttgtcatatggtctgtgctcccactgctccttctttctgtttcctcatctgcagaatttggagagtcctggacctgatctcaaatttcacatgttatttatcttcctgcagcacgctggggagaggaagagacagggacatagaaggttggagctggaacagacttcacatctcattccagaggcatttggtccatcttacagatgaggaaatggaggctgctcagtggactgaggctggaactgggccttccagtggccaggccagatcctccttgatctcccttgttgctttcctggtgggaagaccctggaaccactttatgtgactgtgtgagaagggaactgcctctcattttacccagcaaaatccaccttcaatccatcttcatttttgcccctggtgtgggcaaattctcccatacctaattcaggaagccagaaagaggaagtgagttaatgatccttagtgggaaggcgctggtaatggtccttcttgtgagagtttctgaaacaccacgctgtctctgtgttctggcctggctggagttaaacctcttcttggcctttccccaggaagctggtctgaggaagcccagatgcgtttgtttacagctgtctggtgacattcgccaggctctgttttcagaaggaacatttccattcccttatttacacctcccattggagtgctcggggggacacaccaattatttgcaactacctggaaacctaggagggtagcagatctgtaggaggccagtgttgaagtgagaagctgtagatctggtgacactgtgggcttgggagggcttgcccagatctgttacttatactctctattaagaaacttcagtgtccatggagaagttatttaaagtctgcgagcctcagtttccccatatataatatgggaaggatacctgattttcctattccacatgaaggtagaaaaaattaaattaaggcagccaatgaaagggttttgaaagcaaaaataataatatgatactgttctgaatttgttaaattattcttccaagtagttgcagatctttttctgtaccttagaaaaaaaccatgctatgtaaaaggagatgattccaatctttaaataaagcaactcagaggtcaggggctaggacagaaaacggccctttgttcacagaagcgctctcacttccaagaaagcaagcgtgggagaggcaggtggtcctcccgatgtccctgtgccccatggtgtcaagctgggttactatggcccttcgtgacccagtgcagcagggatgtgggaaccagtgggtgtgaagctgtgacgggtcacaagagggctgggacgtctcacagcttttacttatagcctagagcctggggaagggttgccactctagtgatgagagaggcgtgtgtgtgtgtgtgtgtatgcgtctgtatgtatgtgtgcatttgcatgtatatatgtgtgactgtatgtatgtgcacatctgtgagtatatgaatgtgtgtggaagtgtgtataggtgtttatgtgacagtttgtgtgtaaatgtgggtgtatgtgtgggtgtgtttatgcatgtacatctgtgggtgtgtatgcatagtgtgtatgtgtgagtttgtgtgtgtgtgtgcatttgcatctctgtgtatatatgcatgtgtgttaggggcaggcacacaggcctgttggtaaatgagacacaaaatacctacaaaatacaaaatgtgagacaggaaatacaagccccagttactcatttttcagtgcaacagacataagattaccatgtgaaattgctatgaaagtttccgaaagcttcctgtcaattcgtagtgagcagctagcagaggagtgcgggtccctggagcctgcttgtgcaacgctgagctagtccaagggggaagaatggggtgcatggctctcagctgcagaccagcctggaacctctccagcctgctttagcagagacttgttaagaggtagcagcaggtggcaagattaggagccggagtagtaggctaaggctgcacttccagggacacactgcctctgccaccacccgtgccacgaaaatgggagcccaggaccctgaatctctagcagtccgtttctgaatcagttaccttgggtatgtgcctctggttgatggaaactaacttgtagccctgctgggtgagagcctcacatcgggacatgtgacagctttgttgaaagtagctttggaaacgcccaccacgtggggccactcactgtaatataaacggtcatgcatcactgagcaacagggatacgttctgagaaatgcgtcgttaggcgatttcatcactgtgggaatgttacagagtgtgcctacgcaaacctagatggcagagcccactccacacctaggccagatggcagagcctgttgtttctaggatgcacgcccgtacagtaggttactgtactgaatactgtaggcagttgtaacaatggtgagtatttgtgtattcaaacatagaaaaggtatagtaaaaacaatggtgttatggtccgcggctggctgaaacgttatgtggtgcatgactgtaggtataaagcattacagttgtttgatttttctctttttctcacccacagtcttaaggcacctcttatgccttttgtctgggatgtcccgggcagggttggaacgtgtggttaaggcatggcggaaactgctttggggacagacgatggcctcagcttgccttggggtgtcagtgggaaagataggagctgcccctttgccttcgtgtttcttcgtaataatctcagatgtacccgtctggtgggcctctcctagaaaaagccccggtgctctttgctcctgcggtgtttctcaggagggttgttgcttctttgtaatggtggggactcagggaagggacgcaggcagagggtgatgccacatcaaaaagggacccttggctgggtgtggtggcttacgcctgtaatcctagcactttgggaggccgaggcaggtggatcacctgaggtcaggagttcgagaccagcctggccaacgtggtgaaacccggtccctagtaaaaatacaaaaatacaaaggtggtgggtgcctgtaatcccagttactcagtaggctgaggcagaagaatcgcttgaaccggagaggtggaggttgtgatgagccaagattgcgccattgcactccagcctgggtgacagagtgcgactccatctaaaaataaactgaaaaaaaacaaaaaacaaacttgggccatcagcttcttggaaaggctggtgtgaggttgaagcatttgctggtgcctctgctcaacgtttttgtggtgaacctgagcaaagaggttatcattagtggattttactgccttacctgggtgggcactcccttgggaggtggatggacatttgcagctgagcccaggtgggggaattgcgctcactccgccttcagaattccaaaggctgggcatgcatcttggcttcctctaacccatgtctttctctaggtggccacagcagagtgtcattaagtatctattctttgcttttgttctcagggcaggaagatcccaacagtttgcgccataaatataactttatcgcggacgtggtggagaagatcgcccctgccgtggttcatatcgaattgtttcgcaagtaaagagagccttcctttttcctataacctccgaagctttcaccgccactagcaaaacatgagagctatttttgagatacattaaagtgtcaaagtgtcactgaatatcttcctacttaagataagtgtgtctcccttagaacattttccctattcgactatataaatctacattcttgacccttctgaatgtttaaagaacctcgggctctgaagagattctctaagaatattttgtaagtggaagtttttgatgcatgcaaaaaattggcaggatgtttagtgtttaaatgctaagcccgatatataaaggagcgatggctaggtgtgtgtggctgttgcacaacccattaatcaatgcgttgaagcgttcattttaaggtgctacaggcttaagtgtgtactcctttggattttaggcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccaggtaagggtgttctcgcctgcagaggtgagttctcagatgccccggaacacccttggcaaaggcaccagagctctctgattgcagctgattctcggggggcactgaagccagtctgagccagtcacaggagggccttgaggagatgctgagtatggcctgggggtgtgggagaggaaggggctcaggaaaacttctgtaaggagccagataaaagtttttaaaataatgttttaaatgtttgtcaaagaaagcaatagatttgtaaagaaattagtaggtaagtagtgaaaattgattctccttcccattcccaatcctgtggcaactcttgttacagattttatttatcctccacagatacatcatgcgttcacaatgaacatagaatttactgggttttagactgagccatccttaacttgtcaacagttactttgaaaacaaaccagctctcccaaattggggttttgcggggttatgagatgtgtttcaaaagaatgtttcgtactttaaacatcttggaaaacttgaattaaaacagagctaatggatttcttctttccagaccttctcagagcttttagtatgctagtgtgcacgtggcttgcctacaaaagggtgttgactgaactatttgcccaaattataatcatttgagtatacagctttttgtgggggcaggcagaactgagacataccaaaatcagtttgggaaatgctgtatttgaaaatgctttctatttaaatattctctttgcaatcatttttgctctgttgatttgcttagcaaagtcttcatgtctgggacaatatccatttcttactgactcatcaaaaacccccactcgacacgtcgatgagagaggttttgtttgctgtgtggcatgttcagtgaaagcgtggtttccagtttcttcacatccttataattttctagacttcagatggagggaacaatcagaggaggctggaatcctgcctctgaccaaggaaaagaccagaggctgagccaggtggggtctcttgtccagccctctgcttgcctcgctttacctgggtgtgggctgagtaattccagacaagcgtggaattaatctggctgtttgtgctgttcagtggcacgctggttacacctccttctggaaacaactctgcgtgtgctgtttgggtggtaggattccgggtctccttctccgtctttttataacatcaagttgctgcccagctcaggctcctttacggccagtcttcagaaaaccaccagctaacacatttactaccctccttccccgatgttcctgtagcttctctatggctgggtggccaggcatggccgaagaggctctgggtagatataggctctgtgcccggtgtgtgtaactggccttgagtgaggctgcagttgtgtgttatttctattaggtcactgtggaatttctagcgacaactaatctttcaaagtgtgtttattggtcacaggattattgggccagcctctgccttcattctttttcacctaatctgcataatagctgtgttatccccattttagagaagaagaaacaggggctcagagaagtctagtaacctgtgtgaggccacacagcaaacacctcatgaccctgccctcctaaggcagcccatggctactgctggagggatagaggccggccccgtggtttgatgggacagcttgaccttaaacagcccatgggaaggcgggtgcatctggtttaggaacaggctgctagaaaggtatccaggatgtggtagtctcaccggaaggagccagtcagaatagcacagcctgtggccacgcgtgggacctgttcagcctcatggagctttgggaggcagccagcagcagggcatgggctgtgtgcaggcgaggcgctggcctggacgccgcccccactgcgtaacttcgtgtttggaatgcgtgggcacataccgtgcggctgcttctggccgggggatattcttttccaattttgagccaaggtggagactgtctcctcgtgccatccctggcatgtcctggcaagacgtgaacgatctcaatagacgagctttgcagagtgtgtctgacctgactcctgctgtcttgggagtttagctcttcagccagcagcatgctgtttgacatgtgtttcaagccccccaagaaagggtgcttgaaatttaaaattgaactgatgtggcttttcaaaatggaattggaaatgaaaggatattaaattgcagacacccacacaaaagactggtttccactgactaaactgcttttttttgctgatagtagttgaaagtagggagagtaacagcatctcttccagctttttctcttttgttcccttgttttgatgatgggttatttcgggggaagctctggctggccttgctttgtgtcatcttagggataacaaagaggatgaaagagatcaggaaaaccgagaaggcagaacagaaccagcagaaactgtgcttgaggaatgaaaatcacctacacggctccttgtcatatgagactgtggcccagcctcctgcaaagccatttaagagtaacccagtgaagctggtgagactgcctgccgcgtccgtgggcccagtgactaactcggtggcttatcatctgggcccagctcctcccctggcatcctgatttcacttggaggggcccccgttgtccttcataaacatgtttatttcattttatttttatgttttgagacagagttttactgttgcccaggctggagtgcagtggcgccatctccgctcactgcaacctccacctccaggactcaagtgattctcctgcctcagcctcctgagtggctgggactacaggcgtgcaccaccatgcctggctactttttgtatttttagtagagaccgggttttgccatgttggccaggctggtctcaaactcctgacctcaggtgatccacctgcctcagcctcccaaagtgctgggattacaggtgtgagccattgcgcgtggctgtaaacgtgatattcttgagactttcagtgaaataagaattgccacggacatctgtggtcattgtccacttgccactcacctacccccttttctggcagcaacagccggcatttcacatgtccatcatcggacagcgtaggtgggaccatcagtcatggtgtcctaccctctgtggccaaggagtggacacaggacccagttagggcaagcagaggctccccttggaatcgcaaagtgaagctggatgccacccacagagactaacatggtgaagctgctgtagcccctgctgttgagcccccagcactgcctgagttcttgcactttgtgagtccagtttaatatctgcttttcctcccattcttggagctcccctcacatctccagtggcttgaagttgccagagatgtttctgggcttgtgaccaaatgactccttttctgcttctcactgctgagcagacacatgtgcgctcactttgcctgctgagtcttgggacccggaagagcttttgggagacaatcacggaccagccccctcttgcctgccctgctgtctccctccaagcaggaggtgagaaggtgtccacctgcagccccggccaggcatccctttctgtgcttctgcccaaatctgaaattcccctctccttgggacccacgactggggccagcctgcctggggagggaatcccagctgcagaaagtcgggacagtgtgcgtgtaaacatgttaatagaaagcagctttgagggcagactagttcagcttcagttacaaactctttccaaatgcgtttaacatgagccactggctgtgcgcagcatatgtcaagctttcatccaatggtggcattttgtccctgcggggtttttttttcctgagcagtttggggcaggggtggggacagggagagagaaaagtaaaaagagagcagtttggtttcttcaggctggagtacaaggcagaggtaatgggatgtattgaagaaggtaggagggaaagttactttagctacagctatttgtccagctgtgctgattaagaaacttggagaaaagcatctttggaatcatgtccttcccatcttatatacagcctttgcagatttcctgctgttctgagagagatctgaactccttaccaggaccttgagggccccacctgattgggcacccctcactctctctgcccctcctccccttcccctcctcccctcctttctccacccccacctgctctgctcagacaccccttccttggttgcttcccacaggccagggctgtcccctggggccttggctgttcccctcccaggagcgcccctctccagctcctcatgcagccaaccttcctgtccttcaggcctctgattaaattctgccttagacatctctccccaccccgctgtgtgaggtagcgccccatgccccagtcccctcaactccactgcctcactttggggacacatcaccccagggacaactgcattccactcttggtttttccctcctcgtctatttatcacaatttagagtcgcctcactcatttgtcaaatgaagttcatctctgcagctggactgcggggttgggggcacatccggctgtcggtcctcaggtaggaggtgcttggcaaccttgttcagagtaggacgttcacagctgtctgccccggaggaagcaagggcacccgccacatggatggaattgaggggaaggcacccggggctcctgcatcgagcttccctcctatattcaatgaggaaatgaccctgcagaaggctggctgcagatgcccctgcctcccggctttgcctgcttggagtttgatggacacgtggtcctgtcagggctacagcaggtctatggtctttggtaacggaaagcgctggtgaaacagtgagctttcccgtgggtgcttttccctgacgccaacaaccaggtaaatatttggaaacggccttgttgaggcttgtgaggtggttttcctccctcccctgtaggcctgcgccacccccccaaccccacggccacctttgggccagatggcacccacagacctgtttgaagtggccacagagggagccctctgggcgctggggccgctgtgtttgcagagggtcctcttactgctgagctggctggtgcagtgagaaggaaggccgacacccctgatcctcatcaagttcagacgggggtcactgcgggtgaggggcctggggccttttacatgtcccgggagctgctgagcaggccactcttctccaggccaccagaacttggccctgcgcatggtgaatcttccctgagtcagctgagtgagggggttcaggcagccccccgggacatggcagtggcggggagtggactggggtggtgcttgccatgactcacgccggttctcctcaggcaaccggatggtcagatgcgctgactcagtggcctgagctcgtccaaaagcgaatcagagaacacagggcctgggctcacccgctgccctcttctggagtcatctgtcactcatcctcatgaaggaagcgcctgggagcctggaatgcacatcgcactgccccagctcccctcttgtttctgtgtttttccattttggattctttcccccaacgccttctgtactgggcattttgtggtctcttctttttctccgagaactctgagggctaccattgcatttgctaatgatgccacagacggtgttgacgttatgaggcttctattactgtattgatttttaccatttttagggggacgggaatcaatatttcatgagggaatgtgaagccagacagtgaagtagaagctggcttttattttgtgccaggctttgtccagaggcgggtggggacgtggctcctaagctcttgattgcagctccttctggcttgggaaacgtttcagttccccaaactctcagaactggatcccctgtgtgttctctggcccggattcaagaacttagttgattgtcaaggaaattctttggctatatttttctcttaatatggtaatgccttttttcactctggcactctcttttcagggaattggattaagactattatttatgggtctgacaaagcagttcccaagttgttgggactggatttgtttaggaatgtctcctgtcctcttcattgaggggggaatacaaattgcttccatttgacagtttatcaagtgtgtgacagagtatcagagtccagggttggccaactacagccagtagtccaaagctggccctctgttgttgtaaataaagttttattgggacatggtcatgctcacttatttaggtagagtgtatggctgcattcagtctacaccagcagagttaaatagttgtgatgaagaccacgtggcccgtgaagccaaaaatatttgcttcctggccctttacaggaaaaaaattcccagccccagtggcaggcaattaacaccttgtcctcgaggagctgaaagtggctggaggcaggaatgcttataagaaccaagcgaggtgaagcactaggtggccgcggcgagcaggaagagaagctgattttgtttgccctttcgtttgccagagattgtgggttctttttttttttttttttttttttttttttttgcagagatgaagctttgatcttgtcacaatagcagagggaggccttatttttgtctatttctctgtgacattggtagaaaggactttgtcagaattccaagctatttggcaattatccaattttgagatcctaatggatctttcgaggtctagtttgttcattcttttagtgattccttgttaattccctgattttataaatgtgtgttgaacatctgtcttggccaaatacttcttaggtgctgaggatgcagcaatagtgggcaaagccatggggcttaagatctagtgtgggaaatgggtgatgtaaagtaaatatggcgataagtacagtgcacgaagcaaacaagtgaaggggtagaaggtatcaggctgcaaagacagcagatagtgtaggcagggaatcttatctgagggggtgacatctaagctgagatggaaaggacagtgagagccagccaaggaaacaagttgggtgacaagagttgcaggtggagttgcttaatttcccacttctgctcagcctgcagatcctggatcttggactaattgcaaactgtcatttcctcgtgagtttattagaaccctccagaacaagtttctggttagctagtttctctgtgtgttgtctcatttcttgttggttctggttctttggggttcctactcatactctggaaagctccagtgtcttaagtagtcagtctcccaagagtctgaaagcacaaagattcacaatgatacgatcacctctcaatcatagcagcattgatgcagttccgtagctggtttcctaaagccatccagatctctttctgtggcaagagagaaataagaccttctggtgaattgaggactaattatcctaataaacatgcgaattaacagttcctttggttaaacaaagcaccagaatctgataatgggaacatgtgactcatggtatttccttctttgctttatctaccaggcagctcacagaaaccactggccttccctgtgttcccattttatgtcataaatatatatttaattaacttattataaaaggccctttgttcattgaccatatcaaattattcttatatagaagaggttatacatgttttaaacattttaaaataaatctgaaaagaatgctacatcctgggcaacttccctgcatttggggctcaaagaagctctatgtggttatgggtaatgaggagccagagtgccttcagggcagttcagcagatgctgaaaggctgctgtgtgctgttcgctgggcccaccaaatagagtaggactgagcccctgtccaccatgacagccgggagatacaagctgttccctttgcctccctgagccctgagctttatagcctatagacagctgaaaagcaggctgcatccgttacccagtcagttacccagacccaaatgccaggccttggctaaccccagttattacctaattttaatatcccaatggatgttttaagacctggctggttcattctttcatttatttacttattcattgattttgtaaatatttctggagcatctgccatggccacatgctgttgtagcagcatcagccactctgaagttggtggatgaaaggggatgcatcaaaggcgctgatgtatggaggagacgcaagttagacttgaccaagacaatattattcctcctctggatgccccgaatatatacagtcattagctgtcgggcccccatgtggcactgttgacattttgtggtttaaacactgaagagtaagggaatattggaaatggcaaacatctgatatagtgtaaaggagactaaatattttgatggtgttcataaacaccgaggaggaaagtcttttcatttttttcatttgtgtgctctctctttctctgtttttgcacactgtcctctgttctccttctccttctctttttccttttttctcccttcatctccccatttatctgatctctcccacctgaaccccttctaccctgctgccctcctgtccattctaccttctctactcccctccctagacagtagtaatcacatgtcagttggagaaacatgatggcaacttggtcacaccgttcttctcagtctgtatatgtcggtgatctcagtgcccatctggcagatccttcctgccctggctcttctgctcactgcgaccacccttgactttgtgatcactgataaccttcaccttctctaatctaaatcccaagcttctcactcttggtccaccacctcccagccttgtccgttctgaaccctgaacggaagctgaatggaaccctgaacggaagggttctgaagctgttcagaaccctgaatggaagctgaaatatcaatgggccattgcttttcacagtcctctgtgaaagattactggccaagccagcatctggagaattcctggtccaccacctccctgtctggagaagctggaacagccagctgcatgagcatgtgacccgtgtactcacaggccctgtgccctgagctcgctgttttaattttatctttgaatttgtatttttgtgaataaagccctatgagctaatggagcatgctcagggaacttggggctttagctcaggctggattcctcctgctgcctccccagtccctggtcccctgagaactccagccccatctgaccttcccttccctgtctctatgcaggggtcattgctaccctctatccctggaaaggatgtaggcacagggcagttctaggttccagcttgggcaccgcttaacatcttggtggtgcagggatcaggctgatgataccgtggttgttctgtgggctactgggcagggtcaagccactcccaccctgatccaggtacctaatgcacccgacacagaagcggcagtgtccttggggtcatccattatccatgtgttggaggagtgggaccctagggaagatgcttggctcgacttccccacccctagccagggcacaatcagaggtccaggggctggtgggcacaatgccaagtcgtgaggcctccagtgtctgcgctcactgtcccataaataaccacagtaataactagcaaatcaaaaacattgtgataggtcgagagagacagcatgtggaagaaaggaaaaagctttctattttagtacctttaacagtgctttctgtatgctttatgaacaaggagcctgcatttttattttgcactgggctctgctaattttgtagctggtcctgccccctagtagctcaagtcagcaaatctttggttcatctgagtccacagtccgctgacccgccctttttcacagttcctcccctgcccatgtgctcacttccctccttacccagcttggcgcactccctcaagcaagtctttggatgctgacatcccccgtaaacaacccttctgcggcctggtttgattttccttaggagacatgcaagttctatagcactgtttcttgctgggtatggaggatgtgctattttgtccattgcatattttttaaagaaaatgaaaggttagcataactgtttccagaaggcacattgaatcactcagttgagtcccagccagttgctgcaatgttagcctttgaagcaaacttgaaccaacacaggaccagcctagaagtcccagcctccagaaatgatgcagtggattctgcagattcagcaacaacaatatttttgtaactcaagagcacttagtaattttcaaaggagagaaagaagtaattgacttggcttattaggttgaaaaagagttgccaactttttctttggttttgatgttattggtttttttttatttttcttttctccaagcttcagggaatgagattgaatgagcactcaagtgctactaggcagaaccctgaatggaaggaagctgaaataccgatgggtcattgcttttcacagtcctctatgaaagattactggccaagccagcatctggagaattctaggaacgccccctcctcttgcagcagtataagtttgcggggatcatctgaccccattggggagttgtatgaaaaaggggatttattggggaccctgttgcctgtttggatcttacttacatttaactattgtctgctaatggattttttggaaagcaaccaggttttccgtaaagaatagctaattgtcagagctgagatgaccattggagatcactgggctcaactccctaattttagaggtgctaaaaccgcaatccagagaagctaatcaagtggttcaaggttgtagactgagttcatataggaccaagacccagcccagatgtcctactgtctgggacagtgttctctcagcatacgtggagcctgagggggtaatgtgtgtgcgtgtgtgtgcatgtatgcatatacacataggtgttttgcctaagttttcacttctgccccaccttggttgatcttggagaatgagcctgaggcgcgctgtcaacctgggggcctcattcagcacaggcccaacttttctgccctgggggagttccagcagttatggttcatctgtggttcagttatggaactcacaccacacatagtgcccccaaaaccgaggctgcgtgcacagacctcccctcccttcccgtggtgggcccctgcttgggttcttcctaaacttcccctttgccctgctctgtgttataccctctctggtcccctgtccctgtggagtgatccggggcacaagggcagctgtttccccgctgacctctgtgtgccctgagcatctgggaggtggggagcaggctggtgagaagaacacctggagtggaggttggggtcagggagggtcccagtcccggtaccacccccacctgctgtgggacctgcagtcccctcatcagcagaacggctatgaagccatcctgcccatccacagggtggtgggtcgtgaaggctgcatacctggcagagcgggagaagctctgggaagatgccggacacgcgccgtgggagtgatttccctgccttgcccagattctgctcccatcacctgaacctgcctgtcaccaccatggaactgctgtgaccattgctttccttttaagcagattagcagacatctcctgctccaccctgccaaacaaacaaacaaacaagcaaacaaacaaacaaaaatgtgcatgagggagtatggacttgtagagtcttttctaaacattgttaggtgcttgtattgggatcctctcttaaaatgaaccatattccccaggctttggatgacactcatggttgcccaccctccaacttccttccctgctggcagagccctgggtttgttttagttccaaccctgaccccaccgcattcctgactcaggcaaattcgcagggtccaatgcagtcaggggagccacgttccctcctccaacgagtgctgaggtcgctgcttgattggatactgccgatgacctacgaggaggagggtgccagggcgcttttgggactttgcttttctggagagatgcttccacagcatggtcatggacacagtcacgtcttgatgtgatgtctggaatggtggtggccgtcttgtggctgtgagaacaggctgaggttgattggatggagggaaggaaggagccttgttcttgatgctgtctgtgagcctttgagttatcagcctggtaccacccagcccttggacagatatctactctacatactccatttggagtttttttttttttttttttttttttttttttttgtcacttgcagttgaaaacaccctaattgatacacacaaactatttttagtgctggtctgtgtttggcccttatggaagactctgggctgagctgcccatggtgagggaggtggactttgtgttttcttactgctctgtgtcctggtggcttgtttgtgtctctgcccatgagacaaaagccgagagggcaagggcagattttcttaatcatatgttccctgcaccaagctcataggagacactcactgaatggttgttgagagagttctctttcacggaggcaatgttttgtgaaacgatgctgcttgttgttgtctgttggttgtaatatgcatgaacactaagagccatctttaatcatgctgtgggccgcctcttccaaggtgttagcattactcccactacctggtcagcatcctgcctatggctaggactttgcaatttacatagatatggtggggagacctggagcccatggccaggactctgacaccctcactggatctgtttctacatctacctggatggccgtctaggacattagaggatttgtgtcttcctaaagtccctctgttgagagacttctggctctgttaagaggacactatttagcattgtgagtccctgcaggctgggggccagtgggcgtttttcttctagatgccccctctcttcttctggcctcccaggcttcctgctcctgagattgtgagaactggcctgtgctgggctcactgcagaaagactgtcgtccccaaaggttttgcaccaaacttgagctacaagatcttttagggggacctgagatctccgcctgggctctatgagagcaggcatgggttgtttttgccccgtcactgcagtcatgcccacacttgcattttcttttccccccagcagtgtgaggatctggcatgaggagtgggactcgcgtgccctctttcttctcctcttccctctggccttttcatccgtcagtgggggacagatgtttgccctgtttacttctaggcttactgtggggctccagggagatggtgaagtggccaaggagaggagctgccaccttcaagacggcctgtggccggtgccgctttaaagggagactcagaggtgctttgctgtgggtggcgcgggaaccagcctggggacagcagtgcagaggccttggactcagagtgcgtgggccccgcggggcttcacggcgcctgtggctgtgcacttccagccatatctgtgctgcatctcttccacattcccccatggagctgatgtctagacagctatggaattaaatgctcaattaccgagtaggaatttggccagcagaggtatagctgctgagtagacagactcgaggtgaggctcacggctgagaacaggccccatctggctttggaatgagctgaggtgcccgatgctcctgcagccagtggctcctgtggggagctggggccgtgacccccaaaaggcagcttgacctcatggaccaccataaatctggcctggtcaacatctctgccagacatcattcccttgcaaagatttctgcctgtgattggaattctggatgaacatgtactgggcgtgtgggtctgacagctgggaagcttgttctcttgtttagccaggctgcccatcatctgtaagcctcagtatccacatctttaaaatggggggaaaatatagctcaactcctaatggtgccatgagaatactttgtcacctgccaggcaaaagcttattcctttcacagaaatccagggtttacaatgtgagacccctccccactccgccgcatgtgtctgcttgcttttttctgtcttagggttgcccttcatgagctaggaaatgtctgagtggatgaaaacctaaacgagatgatcactggtggtgcccattggtgcagcctttgcctaaatggctacttacgtagccacatttcctcgtctgtgttcaggtgaggactggttcctgggcagactgcctgggtttgcatcacgggtgtccatcttgtcgaagcccatgtggtcacccaagtgtgactgagccaggcttgcccacggggtgctctgggccccattttcggcagcaggcagcgtcccctggaggcctggccctccccgggagcatggggagtagcgcctatgggcaagcagcctgcagcctccatccctgcctgggggctcccccgccccagcctcacagcttctccaaaagtgtttgtctccttgccgcatcctctaggcctgagctcagacggtggaaaagaagagctggaaggagagttgcctttcagtctctctgccttctgaggtctcctgagacatagagcctgggcctgcctccctttctaggaggcgccaaggggtggtaagaataggggatgagtgagatgtgaattaggatccccacagcaagccctgcctcgtaactttctgatgggttttcaatgtgtggtgaagcagacgcctgctgggcccccttcctgagttgagtttgacctcctgcctcctgtctatctccttgggcagccaggccaccccgctccattaacctgtgccaccccatccctttacctgtcgcaagcccagccctgaaggcctcaaaggcctggtcttccagccagtccagggcctgaagggatggcagtgtccctggtggacctcccctggtgtggcctagtgcacatcccagccctgcctcctgccccgcctgcacgccatgagtgctgaagtcatgcctggcaggggctgctggcccaggcccagagtaaacacactgcgctgagctcgctggtgtgctgctggatgctgatgagcttgaggagtgtgggaagtgagcatggggctgagtagagatgcggcaggcctgcacctccccgcagctgccctgcatgctccagcctcaggcagccacacagggaaagggtcacccactgtcagggcagacctttaccatggctgggtgacacgggctggctgtggaaaggtgtttggtggttcccgctgttggatttgcacaggcccagatgctcacagcaaaaccaacacctagatggtgcttacaggagccagcgggtattcaaagagctgttcagatcttaagttgcttcattctcacagtggaccattgaggtagctgtacgttagtcccattttccagatgagaaaactgaggacctgagtggtcataagctcaggccctcatctaaatcacgcagcctggccccaggtgtgtgctcttgaccatggacagtgctctcctggtcctcttggtatctgtgatctgagggaccttcctcctcctcagtctcgtatagtcagttttaggtcttggactctgtcttcatatccctttctcccttcgtgagctttctcacccagcaccttccttatttggtgtgtgttgggggatatttgtggtgtggcgtggcactgtgtagtggatgagagagtctgtttttccgatcccagtcccaggtttcaaaccctgctctgtctcgagtcacccagaatcttggaccctcagtttcctcatctgttaaatgggcatggtggtcaccccacctcatcagctagtgtctgctccatccctggtggaggagatgactcaagtaacccctgggttccacctgccccaccccactggtcccctggctctttctttgttgagatagacgaatgtgaggctctggagttgcagttcccacgagggctggggtggctgtctgatttctgggcctggtccatgttgttcagggcagctgctcgttctaagtgaataaaggctgaaggaactcgggaggtctgctcggctccgaggaaggcagagagggaaagggccccgatgccttccctgatagagctagggaggcccttctgtggttccccccagctccttggcctgggtgaccctggagctggcttctgttccattttgttgtgcagagttgtttgagactcctggctttgcctggcctttgtgggacgctggagatcagggcttctggagttggccaattagcctgcccagaccaggaagcacaggtggctgacagagggccgtttcaggagaggagagacagcctacctattcggtcttgctgtccccatgctccatccctgcccctgaccagtgtggccctgtactcagcataggcgtgcacctgagtcagtacagttccctgcccgcagagcaccccaaatattccaggcctcaggacggatgtgcacatgatgagtcggggcaggtttcactgcctgtagcttgggatccttccctggggcttggttctctagggccatccccagcagtctcaccccaaaccctaaattcatgttgtcttcctctgtctcttggcctcaaggtttcagagtgagtctgtgctgatagcttcaagatgtgatgagaccccgacttggcctccagttacctccccacggtttccttggtgtgtgtgtggcttcagtgttcactggctcccgcacggcttgcaatgtgtggattacgggtgggagggaaatccagtcctgcccgcagcaaagggatgttagttgtgagctcagttccccaccgggcctggtgtttccaaatagcccgtcactgtccctgcttggttttccatgatatctgtgcctttacctatttggttaaattaaaccaactcagcaacgccagccattgtggtttcagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaacgtgagcctctgtccctctgcgggtggggattggggcagagttttgccagggggagaggagtcagcataggtcttagcccctgactttgttgtagtctgcgtgaagggatggaactagaccaagccatgtggattctagtgccagcagcatggcaggggtcacatggcggggacggtgacaccggagcaggtggacagccagcctcctcccaggaggaagaagttgtattgggtgctttagggtgattgcagttggcttctgggcttcagagagaaaatctccctgtttacggcacctctaaaactttctgaaaattgttaaggtcatttttttccggcaaaatattaggttaatgggaatgaatctcagagaagaatcgtgccccccactctaggcaccgtgctcaggaaacgaccaggcagggacatagattgaaccatgttatgacacgatttgtaaccttttcatttctgtttaattgcagtatggaaactcgggaggcccgttagtaaacctggtaaggtcttttaaacctatgttaggtcatttgtttttatctatgtatacgctgttttttgtttgtttgtttgttgtttgtttgtttttgaggcagggggtcttttcaaacataaggttgccaaagtgtattataaattcctttaaaatggctctgtaaatgtactgcgtgcttgcaaatgaccctacggatcttttctggaaagagtaaggcaggccggaggtgagggttggaaatgttatgccagagaacacacttgtgtctcagagttacaggtaaacaccgtgaaattcagggccaatgcaggagtaaggtgaaggtcactaaaaatgctggccagtcaccgaaagcacctcctccaaattaaatctcctgggctgctgaaggagctggctgggctcatacacattttctcttggccaggaatcctcccttaaggcctggctggaatgaggaggagttacccacccacaaagatatcacttaagtcttcccttaaatacttgagcagaaaaagtgaagccttagaacacagaccagcagagctagagggcagctctggggccatttatagagggcagctctggggccatttatagagggcagctctggggccatttataggggctgtctttagcaaggcccagtgtgatggcacctcctagatggtgccttggcatcaggtactgacatctcagcactcctgggaagtgtgcacttggcagctttctcttcccagcagaggggcagctgtgctcccagctctgtcctctgcctccccgcgcagcacttggggatggagtggagatggctttgctggtaatgaagcatgacagccctaagctctagggttgtttccccctgaagtcagcagagtcatcttaagatcattagacatgggagaagcaggaaggtgtgggcagccacctaaaggagtttgagcctttggaaacgtattccttgtgaaacaggagcaaatcatatcgtgcattttgaaactatctgtgcttaccgtgaggtgagcacccagtgccgacctggagtatgtgcgattcttccacagctgcgcgtggctcgcgctgcctgggtgtcctgatgcctctctccctgctgccacggggatcccctccttgcatctccccacttcgatctctgaaatagctcagggacttctttcaggcatattctctctgggtgtgtacctgccggtaaagcttcacgattcagtaagccgtgtccttcttgcttttcaggacggtgaagtgattggaattaacactttgaaagtgacagctggaatctcctttgcaatcccatctgataagattaaaaagttcctcacggagtcccatgaccgacaggccaaaggtaggcaaggcccacacagccctggggactccggagatggggcctgaagctcagctgccctttgggacttggggaagggaaaagcggcagcccctaggactagccaagccgtctctgatccagaagtgaacgggaatgcacattactaaatccctcgcagaaggtcacagacatttcaccatttttgtcctctgatcatggcaatgtcacttgagtcagtctaatatgtaccaggcatgatcctaggtgacttgtgtacattatttcactttctttatgtatgtcacttaattcttttgccctatcagttaggaattactagtcccattttgctgatgagaaaacggttcagggagatcattctgcaaacgtttattgccccatctgctctaagtcaagcagggagcttggcagtggacagctcaactggggcctggggctcaacaggggcctttgccggtgtgacttttatgttctgttgggggatgggaaggctgacagtaaataatcaaacacataagatactattagtgctcccaagaaaacggatcagggtggccgtcaagggagcgactggaggggcagctggtggagatggtgtggccaggaaatgccttccaagctgaggtctgagtgaggaggaaccagcgggcagggatgtggggggaacactccagaaggaaagacagaggactcagcatagttgagtgagcacaaggcccctgaagtggcctgagggccggagcacagtgacagcatggagttccccggggtggaaagaggccaaggccgggcgagcaggctcacagcaggccgtggtgagggacctgggttgcatcctaacgacatttaagaacagggaagtttatgatctgattgatgtcactgaaaggacactctgatggctgcggggagtctgctggaggggttgctggaagttggggaccggttaaggggctctcccagccatctggatgagacatgctggggtctcagacaagggtggtggcagtggaggtgggacagaggggtcacattccagatatatatggggggtagagcaagcttggggaagggccagctgtcaggatgaggccatgaggaattaagggtcatgcccaggtacctgaccattaattgaaacaatgggactttcccaaggtcccccagaggggaggggtccagaccaggatttgagccgcaacctcagtgtacccttctgtggcccttcctgcaacctgggggattgggcccccggcccctggtgtccccagcacccccaccaactgggctgaccttctgctgtccctttgttgtctcaccaggaaaagccatcaccaagaagaagtatattggtatccgaatgatgtcactcacgtccaggtgggtaaacaggatgcgtgtctgtgtcttaaattttaataaacctgaacttcagaaggtgctcacgggcacccctgaaagagaaaccttatgctgccttaagacgtctcagtttctgcttataatgaagtagcatcgggaaagaggacaggtcattagccttggcccctttgtttggttttaacctgtgtttttgcattctgagctggttttcttcactggcagcaggccctccggtgtagaaggttctgccctcctctttgaaggcaggcctgaacagtgtgtgcgtggtggggctgttgattcactctggctcacgtcttccttaccccacattctgttgaaacccacattccaggagggccccaagcccctcccgcagctctaggcactctgctttcgttgctctgcagctcgtgggccgcggctccaggaatgccagggcaggtccagcgcagggaagtgaatgactgatgtgcttgttttccccgagctggtggaattgcggcctgtggttggcaggctcatggcatcctggtgttctaaactggatgaaaaattctggtgtaatctcatgagtcctggtagtagactcacctggcatggctaaaactgtcagaggtaaagtaggtaaagactagaatatagtaacagatagattaatgtgttcattactatgatgaattaatgattcactcactgtgaaagtattaatatattttgatacatgttatgaatggtggtccctttcttagcactccagaagatggagccatttgtcaaggttaaagtgtcccctcagttgtttgcctttggaactacgaggtgtagggaaagatggtaagcccttggtgcccagcttcctgggttcctgtccctgctctgatatgtcctgccttgtgaccttgggaacgatatgacccctgagtgcctcagtttcctcctcttcaggatagggatgacagcgcaggtgcttctgatgtgtggccaggctcagatcagggagtggtggcaggggtcaccagccacagtgatgccagccactatgtatcacacgtactgggccaggtgccttactgggatgatctcatctgatcctcacaactcatgttgtagggtactgttattatccccattttgcaggtgaggaaatgaaggcacagagaagttaagcaactgtccgaggtcacacagctagcaaatggccgagctagggctgcaaaccaggccaaccactgtactttactgactccttagtaatagctactattaattaagaaataataacaatgatgatggctgggtgcggtggctcacatctgtaatcccagcactttgggaggccaaggcgggcagatcacttgaggccaggagttcgagaccagcctggccaatttgtgaaaccctgtttctactaaaaatataaaaaattagccgggcttggtggcaggcacctgtaatcccagctactcgggtggctgaggcaggagaattgcttgaacccgggatatgtaggttgcagtgaactgagatcgtaccactgcactccagcctgggcgacagagcaagactctgtctcaaaaaaaaaaaaataaataaaaaaaataaataaataataaagcactttccttgctgttaccaagtaaatctttgactctggtagacaggcaattttaattttaaaataggatcagaattcctggaggaattttaccttagacctaaggagaagacgggaactggtgagagctgagttttgcgtgaggaaggcctggtgtttcttcacactaacacgggtgctttttctctggagcagcaaagccaaagagctgaaggaccggcaccgggacttcccagacgtgatctcaggagcgtatataattgaagtaattcctgataccccagcagaagcgtgagttggagtcgttttctcttttcccaatattcttgttgttcctgtgggggtagcaggaagagggagcgctgttccttttctactggctcagatgattatgttgatccttgacagacgtggtcggacgttgcttgtcattcctgctggccaggccttccgacctggctcggctcgggactcatccataggagggtgccttctgtcttcaaaagtccttgctccacgaggaccctccagatggacagagcaatagcagactcgtaatgagtctctgagatggcccggctggccagagagagggtttcaggaacagtgtccccaagccctcacttggtggtccttttctaggcttcaggacccttctcttcctggagtcttccagaatgtctctgacaattaggcccatacctgtcaacacctccagaaaaataacccaagtgatatcaaagtaacatgacaagaagtagctcaaccatccatcagggtttgttacctgtattggcggaatatccagagaaaagtgcgagaccagggaccagcaaatgtgccttgggggctggatctggcccactgcctgcttttatatggagctgtgggctaagaatagtttttgcattttatttttatttttacttattttttattttcataggtttttgggggaacaggtggtatttggttacatgagtaagttctttggtggtgatttgtgaggttttggtgcacccatcacccaagcagtgtacactgaacccaatttgtagtcttttatccctcatccctgtcccagcctttccccttgagtccccagagtccattgtatcattcttatgcctttgtgtcctcgtagcttagttcccacttatgagaacatttaaatggttgaaaaaatcctgaaataagaatagtattttgtgacatgttaaatttgtatgaaattcaaatttcagtgtccactgtaatttggtttatgacatctatggtggcttttgtgctggaacagcagagttgagtagcttcaacagagaccatatgtactgcaaagcctaaaatatttcctatggagccctttacagaaaaagtttgcagacccttgtgctagcccatgaaggaccatgacagcgttttgacgctgagctatataagagctacagttatagtggcaaccacacaaaggaagtgcctcttaacagaaacattccgcccacccctataggaactgcattctgagttgcaatacccattataagcaagttggccagatagtggccaactatctggcagatatctggccaactacgtggcagatagtacctggtacatccttccccactttggggtcaatcttgacctttgatctccttggggtcataaagccacacaagtgttagtaggcatttctacagtggacacaatggatgatttagcctaaaaatctcaaaaggagcccagcatcctggcacatgcatgtaatcccagctactcaggaggctgaagcagaaggatcccttgagcccaggagttcgagactagcttgggcaacaattgagaccccatctcaaaaaaaaaaaaaaaaaaaaaaaaagagtggggaaaaaagaacattattaaaaaaaaaaaccttaaaaagtaatccaatctaccgatggtttattttttattttattttattttttttgagatggaatcccactctgtcacccaggctggagtgcagtggcacaatcttggctcactgcaacctccacctcctgggttcaagtgaatctcttgcctcagcctctgagtagctgggattacaggtgcccaccaccaaacctggctctttttttttttttttttgtaattttagtagagacggggcttcaccatgttggccaggctggtcttgaactcctgacctcaggtgatccacctgcctcagcctcccaaagtgctgggattacaggcatgagccaccgtgcctgacccactgatggtttgaattattctaagttcgccaccgtccaatcctgtttgctctgggcttttaggttctaagctgtgcctctgtccatgtaaagtcagaccaggaggaatggaaacacgaaacattgccattgtgtttccctttgtgttgcagtggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattg

SEQ ID NO: 35805 - DNA, 44801 bp, Homo sapiens
cgcggcgctgcggaaccggagctccgggcggcgtcggcagcggcgcgagaggcgacgaggcccgggcggcaggagccggcgcggcgaccgcggcgagggcggcggggacggagcagagcacgacgaagacgcacaggcagccgggccgggccgggccacggggagagcggccggcgggcagcgggcgggaggccgggcgggccgcgggcagccaccgagccgcgaagcgacatggtgctgctcaaggagtagtgagtgtccggcggccgtgcggaagcggggaggagggagggtggggacggccgccggggcgacggcgcggcgagggacgcagggcccggatggacggaggggcagcagggacggagggtgcctgaggcgggcccagcggggatggaggggatccggggcgggcggcacgtgaggcggggcccacggggcacggaggggcggccggggcgtggaggggcggccggggcgtggaggggcagccggggcgttcggcatctgagccggggcccacggggcatggacgggcagccggggcatggaggggcccacgggcacggagggacaacccgggcggacggctcctcaggcgccccgggggcctcggaggcccaagtggacccgaggagaggccggggacagcgagggcgaggccaggcccgagacggggtcagggcagggagagctggcccgggactgggggaggccgaggggacgccgagcgctgggagtgctgtggggtcgctctgcgcgggccgagggcgcgggctcagccgggactgcaggcggcgctgagaggccccgcggcggccgaggaagaggcgcaccggggcaggcagggcctcccggcggtggggaaaggtggagggccgaacagttcacacggagagccgggtggatgggtcagaggctccgcgatggagttgggatggggatggggaggagtggccgccttaggcatcgggtgaggggtggtggtaagtggacacaggaggaggactaggaagtcagggcctggctggggagacaggtgaagggtctgaggacatgcagagggggctgagatgcgggccggagtaaccgtggtgcccaagcagctggtgcggaagaggaggcttttggaacaagcttgggatgactgcttgggacgtggggagacttgggcgaggaggccagaaaatgttgggtagggtccgaagtggagaaggccgggaagttaccggggtcgaggctggtccggaaagagagtatgttgggatgagtatacctgccgttggagatgggggagaccagggcagggccagcttgtttctaggggattctcagtcttggtgcaaagagatggggaaattctttgaggaattgaggggtccatggagccgtgaactgaggagagatggtggaaggggtggggagctcttgagtagtgaagaggggtgcgtgggaaactggtgacttctggaaggagttgcaggatgacgggtttgctcctgaaatccaggggactgggggacaggtggagatgtttggtgtgctaaatctttcaagtacaagatgagccatcgttgaagctcagggttccaagtaagcatcacaggacatttttctccccaaagaggagagataggatgggtgtgtgtgtgtgtgtgcgtgtgcgtgtgtgcacagaatttacagtgaaactgctttcctggagggagggccagaagccccaggagtgggagatggtcaaacagagagcaacttgtgaggcagccaggcaggtgtgcagagagctcttgccactttgtcagcgatcgcactttgaccatccccaccaggctggctccttggaggtgcttaggacatttaggacatagagtggagtttgggtaacagagggagctgagacccacatgtcatcccagctaaacacctcatctgaagagcattattttgaggcctcatcccctctgtttcttgacatccagtctgatgttaattcagccagggctcggagcttttcctggtgaggaggaagaactttacgatgccaacaggagaacgtggtgcactttagattttaatcttcagtgtccagactgacaggcttttcccatccttctgattctttttcctgttcccaaatgaaccctagaatctgtagaaatctgtggttttgaaatgaaggtcaggcagggaaaggaagggaccttcagaggagatctgagtgaggtttgaagagaggcactccttccctgtctttgttctcctccccttgaagcctgcaagggaaaagtccaaggtgccggagatgcagggcctgcctggtatctgcgtttccttcctgcccgactcgtgccccgtgtgtgcatccctgggcgggggacgggggaggagcaggggcatcagggcatccgagacactggctgtggccgcagcgttgcagccctggaaagggtgcgagtgaaggtcacattagagtgagtgccgctccaggcccagcccggcagttcctctgtggccctgtcctttggaattgtaccctattgctgccgaagtggttttgttcctaaggagcaagggggcagtgtcagagtgtgcagccgtcacgtcagcagcctcagcgcatcccgtcaggaattggcccatggcattctcttttggggtgagacttggttcccacccagcgtctgcaggttgcccctgttgatttttccaacacttcctctaacaggattctgtttaatttgatttctgcaaaatcttggatgtgattttgactgctgttcttgaagataaaaggcttattgttttctaggaagtttcttctgagggtgcagaaattctggcctccaagttgggagtatttttctgcaccactggctttctgtaatgggaggggaggctcactggcagcattcagtaaactggaggatttatgttgtttgagttgctctggaggaagggagttgttagcaggcagtaaagacttggagcccattttgtttttcctgctactttcctgcttggtgtcttgcctttgaggtgatgttttcctcagacccctctgtgtccttcttgcttcctgggggacctttgtggaactagaaaatagctgtttactagcctggagcaaggagcctgagtggtgagccggctgcataaggaaggcacagcagctcatgcttccctaatgcttcactaaacatgcaagacacaaaaggacccagagggctccagcaagggtctggggaccgaacgtctaagcttggaaactggctggacttgtatgggtaaaaccaagagtttttgtcttagctctcccgcctcacagctttgaactgggggtggctcttggtctgcatttcacatgcacggcacctggagaagtgctgctagccctggcacctctgtggggttctggccctggcggagactttgccggccacggcttctccaataggttgctggtggcatctccagcaattggtggtcattgagttggagaagaagaaaagaaaatgataaattgggattcctttggacagctcctggaggtcaggacataagttgaatgccctcttggtggctttgtggtagcagcttggattgtaatatccagccccgagcagagatgcccggtgtgtgttcttaggcttcaaggggcttggtcccttcctggcccttcccctggagggctgttgttgggaggttgggtccacagaaatttaagtccccagggcctcttgtttgggtctgaatcctcaccatgataggtcctcctgtgttaacctgtcttactagactcactggcaagtcttgttggggggacgactcattggcaagtttgggtgaagtttatcatccatatgtccagttccgaatgtgaggtggaggcctgggaagtagctggcgggaggataggtttggactgaatcacagggttctaactgggatgcctcaaggtacagagggtcctgtcctcagagcactaagagggccattctctgggggggggggcggggggggggtgttgtcacagagtttagtgtcttacacctctagggcacagagggtcctgtcctcagagcactcaaagggccattctctgtggggttttcgtcactgaatttagtgtcttacacaatagaatgctgctgactgttttaggatgatgctttaaagagccttgagcagattgcacagcctaaagttgatactctcttttccctttcttatagtcgagtaatcctgcctgtgtctgtagatgaggtaagtccttttactttctggtccatagttgtgtgtaactgtttgtgaccattggctaagctgggctctgagtggttatcctgtttatatagttttcttatttgttctaacataaatatttcaatgtgaatttcgtggtgccactttcagttgaaaaatggcacttactttgtatatctgggtaactgtgtgcaacctgtcccaagctgttggtatgctggatgagtagagattaaaccagccccttttatctgctggggctgtgcatgtctggggacccttttttttttttttttttgagacggagtcttgctcagtttcccaggctggagtgcagtggtgcgatctccgctcactgcaacctctgcctcgtgggttcaagctattctcctgcctcagcctcccaagtagccgggattacaggtgtgtgccaccacacccggctaatttttatatctttagtagagatgggctttcaccatgttggccaggctggtctcaaactcccgacctcaagtgatccgcccgcctcagcctcccaaagtgctgggatgacaggcgtgagcccccacacccggccggggacgcattattgatgggatcaagtgtgtgcatttctgggacgtccgtgactcggctggcaagtgtgcgtggctctttctggttgtgcaacaaaccagcagggcaggaaatctcttgaggctctccctagccacgataggtgactgctggaaagaccaagacacagaaccctccttttacgaagggcagggaataacacataggcttggcttgtcctctgtccttttacggttcctgggtctgacatccttgtatgtggggatctggcagcaggatttgctgtaagaaggttcataggccatgctgactcagagtcagtctcttggacaacggaaaactgtcacggaacctcccttgtctcactctttctctgaacttcttccactctcctctcctggcgcagccttgttctttgcttccttctgaaatcacagccccaccccgccccagcttccagttaaactcgagtttgggtgaggttcgtcagccagtatagtgcctccagtcactgggctccgtctctctttcctgcagtgtcagcatgaagctcctgtgataacttccactctgttcccaatatgaactgcacctttgaaaaatgaaatcaggccagcagagcctgcagcacatttagttgagacagacatccaggcttgttggcccccgagaggggtgggcagacactggccctttagaggactgcctccaggggtgggctacatatctgataagagctgtggggacctggggagggggccagaggtgggccttgaccgtgatcttggggttctgggaagggcagaaaagagaaacgagactggggaacctgggaaccagggagaatgagggaatggctgggtagatggctctaatccctgtaggcactggggatgtacctggggcctgagaaccaggtgcctgggctgacaggtgttggcttggaagggtcttgttaacccacctgctttggccatgctgtctttattttttttattttataatatttattttaaatagtggagatagggtctcactctgttgtccacgctggtcttgcctcaagtagtcctcctgcctcagcctcccagagtgctgggattacagatgtcaaccacttcacccagcctgtgctgtctttattgaaaatagcaagcgatgattttccaaaccagaaggccaagcaggaaagcccagcgcgtcccttgccctcaaactcagctcttggggaggtgtccagtgacgtcctctctgctgtacaggatgatcccaccccgatcgttaggaagatgtgccccaggaactcgggatttccttagtgtggtgattaggggtgaaatggatcctttgatagggagtttcttgatggaacgaagggcgagagtgtctctgagaagtgctgcagaccaaggagggccagcctgtcctggagcacctggggctgttcttggagtaaggctgaagggccagacactgatggcttatggtggggccaagactggaaggaaaggggaacttccaccttgagagcatccacagttggcgggtgttcacttgtgatggtttttctgcagcattgaggaagtggtggggcggagttgagtaatcagagcctgaagtctaagcagaagcttgggaagtgagtgctgatcaggattcacctgtctgcctggcagtggtcagcccgttctcagcaagaaaccattgacaagaaagtaccacgtggcctgggtagggtcgaagcggaacttagtttcagagaattagaaaaatcttggaggggaaggccgaagaagaaacaattcatgatcaaccttctcagagtctttgtcagtaaccccatccccatcctgacttaacagtttctatgggaacagctcagcatcttgtgactggtggattcacttcctaaattggaggccatgacttgaggcctttgcagttttctgatttaggggaaagtgaagaaagggaaagagaaggtcatgcctttgtaatcattccgatggcctgcatcaatattttgggggcagaattagcttctgggtggccagagcctttggtctaaccctgagtgtctgggcgttgtgcagcagagcgagaaagccctggctgtttgacggggtgtgtccaccagtgcttcctggcacaggtcggccgggctgcttcacttcttgtttccagagattcacggcaccagtccccctctggtacccagcctgacagggccatgttggtgggaccaaagctgtactgttgtttatgacgtgtttcatgtcagtatttcaggcccacccactgggctccccctcccagattgccaaagttgtggagtctgtttttcttagttgaatgtcttagttctctgggataggtgaacagatctcaagagcaaggaacatcatcgcaggtctgaggaggctagattcccagtcctgttggagttttttaaatctgatttaatgatctgaccctcccactcctatctctgccccatccgagtctggctgctttcccagggggcagagcagctgtgccaaaaggaactctaacgtgaaaagcgcccttcacttgtagcttgtgcaggccagtcttgcttacccctttagattaacaaaactgccttcacttgtctcattgggattaaaggatcagaatatcaagagagattgaagggggaagatgccagccaacaggctgatcctcttagaacctgccctctgattcctgcagctgaagagaaaccaaatgaaggcgattagtctctgcctggggtcccccttcccaagtggtaccactagctgggaacctcgccccctccaccaggccctctccccagcctgtcctttaggattgctgagtcagtggttagatgttcttacggctcttctctgaaacggagttactgctccttcttaggcacccctggctcagccaagccctgacccacctgacgggttttcatgtgtgcctagctgggtggtggacttggagaggcacagggacagcttggggctccaggggggcattgaggcagcactgatgcagcttaggattagcaaggtcaaggtgactggctttcacccatatgttcctctgtatggatttcactgagcctcgattgctgccccttttcatggcattttgttctgggattttgctttgaaagttagggctctttcagccttgtggtgagcagtgaattgtcctcgtcctctgcttcactttccagattttgcccagaaatttccctgcagtgcttaggaagctgcctggtagagcaggtttctaagtttgaggcgaagcagctctggaagctgcctctgtccttgctgttggaggcagtgatttaagtagcagttgcctagagatacatcctttctgttttaatctcaaagagagaaaaacccagtccctgtaatcccagctacttcggaggctgaggcaggaggcaggaggcaggagaatcacttgaacccaggaggcggaggttgcagtgacctgagatcgcaccactgtgcgatctctgtctaaaaaaaaaaaaaaaaaaaaaaaaaaatagagaaacacccttgtcttccccccgggggtgccaggagttgggcatagagctcgaggaaaccctttgtccccctccaccccccagcatgttgggtaatcccatagcttttttcctttttctcatactccctaagcagccatgcctgattagcaccggcagcggtaggaaagacacatccgttggtgtagacataatttcctgcctcaaatgttgctgttcattttcttttcaccttgttttctcctctggacagcttctcagagaagaaggcggaagggctaagtctgggcactgcctaggtcattggcccatcctgacagggtcagaggaggccaatcatgttgactggtgacttgatagggtggcatgtgacccaaataaaggaaaactaggtttttgccatgtagtaagtgccaacacagagggtgcacccagccggcacagactgtggggcaggaatctgtaatatctcatgtgggaagcaggaatacttgcttggccccaccaggaatctggaaaatgtcaagaggtttcattgcctgaaagagctacttgcggggtgaggagaggcctaagactagagaagaagcgagtagatgagccagttttacgatagaggttgcggatttcacagagcgctgagcacctttctttgacaagaaatcaagtcttaggatctatttaaatgggtgagatccagtgatttctagcaaccaacctaggtcttctggggtcttaataccagaagcaggcttagcacaaaagctcctttggactctaatctgttttctgcgtggtggtgtcaggttaagtagactcacctgcctctttaaatcctgatggattgactgggaacggtggctcatgcttataatctcagcactttggcaggccaaggtgggaggatggcttgagaccaggagttttgagaccagcctgggcaacatagcaagaccctgtctctaccaaaaaaaataaataaataaaaataaaccctgatgggtggtgtgaaaatgagaaggatgaactaaacacgtctgatgggtcaagaggggccatggagcagcactgtcagttgctttgggtgggtttgggcaaggcctgatgtgaaactccagaaccagctcctgcatgaggagaccccagggagatccagttagacacttactggcagctggattacgtgtaaccgttgagaagggtccgtgttgagaataacatctgtctctgtcctttagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagaggtatgcggcatgagcagcggggccggatgctggcttttgtgtgtgtgtgaatgagtgttatttcctttattgttttatatagatgggattatactaattgttatatcctaacaattaatagttatatactgactgtataaatgttatactcacatttatatagatgggaatatactattccttttttgttgttacttatcatggcctcctctcccagcctgttctgtctgcctcggtctctgaagtccgtgtaggattcacagtatcatgggggacagaagtgctataggttgttgaaccctcctgtcttgacgcatatttctagtcatttccagatgcctacataatccagtaaaactccttctgtgtagatcttctgatgtacttgtatatgcagatttttagcaaatattcctaaaattgaattcctagaattgctgggctggtagggtttttaattctgatatcgtgaaatcgatcgctagagaaattttggtacctctctttggatcaaaggcatcagcatttttaaatgaagcttgaactgatttgtgtactggaatccatatcaaactacacaaatttgctaaatccctaacgaaaacagtaatgtttcagcaaactgtgagcagacccaaagggcgttgatggtattaattatacatcagcttgagtggaagtcaaaccaagctagttttagaagctatccagaactggtaaaggtaaacctgaatctttttaaaaattgtgataaagtacacgtaacataaaattcaccattttaaccatttttaagtatacagttcagtgacatttaagtccatccacactgctgtgaaactgaaagctggatcttaatttctagtctctaaactgaactgaaatcaattgactttcatttggaaaaagccccacttcactgtggtctgtcactttgatggtgtcagagggtccaggacctcagtgccagggtgcgaggagagcagtgctgtgcagtggggaggaacctcaccatcacccagtctcctcgccagagggtccaggacctcagtaccggggtgcgaggagagcagcgctgtccagcggggaggagtctcaccatcacccagtctcctcaccgtcacccagtctcctcgccagagggtccaggacctcagtgccggggtgcgaggagagcagtgctgtccagcggggaggaacctcaccatcactcagtctcctcaccagcacactttttctccatgtctcgttttgctcctcctctggtatttgtatttcttaaagaggattttgaaaagagatggtgaagttggtattttaggtagaagggaccaattgtttcctcaagactaagttggtccaaccaaactgacagagacgaggtctctacatatgaaagatggaacctggccgggtgcttcgggggctcacgcctgtaatcccagcactttgggaggccgagacggatggatcacttgaggtcaggagtttgagaccagcctgggcaacatagcgagactccatctctacaaaaaataaacaaaattaggctggtgtggtggcgagtgtctgtagtcctgtctactcaggaggctgaggtggaaggatcacccgagcccaagaggtcagggctgcagtaagccatggtcacgccactgcactccagcctgggccacagaatgagatcccgcctgtctcttacaaaaaaaaaaaaagaaaaaaaagaaaaagaaaaggccagcagtgactgccaccactacctctccccatggtgacaagagaagctttactgtgtcagccatctggctgcccaaagcagaaagcagagctcccctgcagtactctcactcgcccttcttatcgcatcaggccccgctgactccgccccgcaacactctcactcgcccttcgtgtcccatcaggtcccgctgactccgccccgcaatactctcactcgcccttcgtgtcccatcaggtcccgctgactccgccccgcaacactctcacttgcccttcgtgtcccatcaggtcctgctgactccatctcctcagcgtctccaacatgtcccttccttgccacctcttgcctggattactacagcagcttctaacgagtctccctgcctttcagttctccgcaccgcttcaagtgttcagtctggatggtctgtcactcccagcgccaaaactgctgacggcttccctttgccttcaggacgaagtccgtgctgtctgacataacttataggaccttttagccagcctgggcaacatagcaagaccctgtctctaccagaaaatacaaaaatgagccaggcatagtggtgtgcacctgtagtcccagctacttgggaggctgaggtgggaggatcacctgagcccaggaagtcaaggctgccagtgagccatgatcacaccactgcactccagcctgggccacagagtgagaccctgtctcaaaaaaaaaacaaaaaaatcttttaggatccagcttcaggtgtctccttgaattccccaccttgtacctgcaccggttactctgaacttgtccctcttttctccagcttttcccaccccactcccatctgtctcttagcttagccccactcattgtcccatgtgttggttcatcctgactttcctcgcagagcctgcccggtgcactgcatgtcccccactgtgttctcacagcactccgccacccagggccctgtgcccaccgcattatggcatgaacttacagtgttgtgcttggccttgtctagttacacgccccagtagaccggaaactccttgagggtgggagccacatctgtttggtttctctgtgtgtccccctgcctggacctagaaatactcgcctgaatggggatggcagtgagttcgtgaatcacagaggccgccccaagtgctccaggttagctctctgctctagtttgctcttctttcttaggcctgaggcactaaagctgatgaggttgccagagcttgccaaagactggacagattatctgttagaaaccaaggacggctgggcgcggtggctcacgcctgtaatccccgcactttaggaggctgaggcaggcagattgcccgaggtcaggagttcgagaccagcctggcctacatgacaaaaccccatctctaccaaaaatacaaaaattagctgggcgtggtggcgcatgcctgtagtcccagctacttaggaggctgaggaaggaggattgctggaacccaggagatggaggaagcaatgagctgaggtcgtgccactgcactccagcctggcgacagagcaaggctccatctcaaaaaacaaaaacaaacaaaaaaaaggaaaaggaatatatgtaccattttcattttaattttaaaaaatctttctaggccaggcacggtggctcacgccactgtaatctcagcactttgggaggctgaggcgggcagatcatgagctcaggagattgagaccatcctgtctaacatggcgaaaccctgtctttactaaaaatacaaaaaattagccgggcgtggtggcgggaacctgtagtcccttctactcgggaggctgaggcaggagaatctcttgaacctgggaggaggagcttgcagtgagccaagatcgagccactacactccagcttgggtgacacagcaagactgtctcaaaaaaaaaaaaaaaattctaaatgttttcctactccgtcaaaccacacacctaccaaaaaaaaaaaaaaaagcagggggcttatactgtacatgttgttctgtaacctgagataagaattgagtagaagagaccgggcgcggtggctcatgcctgtaatcccagcaccgtgggaggccaaggtgggtggatcacgaggtcaggagttcaagaccagcctggccaacatggtgaaaccctgtctctactaaaaatacaaaaattagctgggcgtggtggcgcatgcctgtaatcccagctactcaagaggctgaggcgggagaatcgcttgaactgggaccctggaggtggaggttgcagttacccgagatcgcagcactgcactccagcctgggcgacaaagggagactccgtctcaaacaaacaaacaaaaaaaaagaattgagtagaagaaaatactttgtcctgggaggcaaatggttctaggccctcctggcctctcagagctgatgaaagcagatcagataatcctggatcccaaacccaagttagtcggctagttaccctggccctaaaccgagactggttcatgcttggaggcatctcctttgtgtttttctcgcaccttgtagtataatgccctgggcccagcaagctctggaaaaatgtgtaatgctgatggaaggggtgatgagccacagcaggtagcctggggtctcttgtgtggtcctgtttctggtggctggtggggcacgtcgtgggtgtgtgttaggagccagccaaggtggggtgtcaggctctcatacgtaacttctcactcccaccagtaacctgctcattgcatggaaacttgcttgtcagctccccatgaagaagctggatctgaaaagcctcttgtctcctttctctctaccatttctctttatacccctttttttccccgctatagcaaagtacccacgtttgttcgaatgctggccccagagggagccctgaatatacacgagaaagcctggaatgcttacccctactgcagaaccggtgagtgcagccggggccacgtcggccaggcaggggcgggcagcagagctgtgggtcccacctgcgtgttccggattaggccagggaaaggctcgggctgggtcccttccggctgatggtgggtatcagtgctgtgtccagcacagcttggtggacagcagggcgagaagcaccggtcgtcacggcctgagagcacagagccagtctctcacttggggatgctgcgattttgattattgttattcattataacattttagtatatttttctagtcatttttatttatttatttattttttgggagatggagtctcgctctgttgcccagactggagcacagtggcgtgatctcggctcactgcaacctctggctcccgggttcaagcaattctgctgcctcagcctcccgagtagctgggactacaggcgcataccgccacgcctggctaattttttgtattgtagtagagacagagtttcaccatgttgcccaggctggtctcgacctcctgacctcaggttatccgcccaccttggcctcccaaagtgctgggattataggtgtgagccactgtgcccagcccagacacattttctcgaaaaattttagatcattactatttattttattattattttttttttgagatggagcctggctctgttgcctaggctggagagcaatggcacaatcttggctcactgcaaactccgcctcctgggttcaagcgattctcgtgccccagccatacaagtagctggaattacaggcatacaccaccatgcccggctaatttttgtatttttagtagagacggtgtttcaccatgttggccaggctggtctcgaactcctgacttcaagtgatccacctgcctcggcctcccagaatgctgggattactaatatgattactaattttttaattgctttttttgtctcactctgttgtccaggctggtgtccagtggcacaaccacagctcactgcagccttaacctcccaggctcaagtgatccttctgcctcagcctcccaaatacctgggactataggcatatgccatcatgtccggctaggtttttttttttttttttttggagagatggggtctcaccatgttgcccaggctggtttcaaattcctgggctcaagcgatcctcccaccttggcctcccaaagtgctggcattacaggcatgagccactgtgcctggcctaagtttctcatttttcttcagtgaatggataacattttccttgtcactaaggtgtctggtgttttgttttgttttgttttttaatttataatagctgcatagtattccatcatatgaatgaactgtggcttctgctgaaacagcatgttctgtaattgaggatacaggtataattattttcttaatcttggccagtctcctgcatagagtttcttgaaaggaaaggaaagatttgaacctccacagagaactttctattctagtccagacattcttaaatttctttcgagtgattcagattcttagccttccaagattcctaggtttccagggccatctaggaatagacctgttgggagggcctaagctggtactgattcataaccctggggagtcctgagaggtcccctggcacttgtctgtgaggtaggtgacctttcctcccaccagcctccatgtgtgggtacagacagtgttgggctgcggggtcctcccaccagcctctgctgacctgtcctcctgcacttgctttctttgttggcacctggtactccctagagtctgatgagtctgggatccttacgtgacgcatatcacccttatcctgtggactttgggaatgactgcaatccagaatacggggtcattgctctttccaaccctcagtggccccacacaggttcagggaccttgtatcaggagatttgcggtcattggtggggtctgggatgtgtaacccttagagttttcttgctgtagctgaagcacagccctccctactccttaagcactgggctggaagttagattcttggaaatgagggatgcacagatgttcttaaaagacagggtcgggcacggtggctcatgcctgtaatcctagcactttgagaggctgaggcaggcggattacttgaggtcaggagttcaagaccggcctggctaacttggtgaaaccccgtttctactaaaaatacaaaaagttatccgggcatggtggtgcatgcctgtaaccccagctacttgggaggctgaggcaggagaatcgcttgaacctgggaggcggaggttacagtgagccgagatcgtgccattccactccagcttggacaacaagagcaaaactccgtttattaaaaaaaaaaaaaaaaaaaaaaaaaggcagtatgcagtgtggctgggtgtgtctggtctagggccaaaggtggattttcttgatgtctaagagagtcgcagtgagcatgtgttgcaagtgtggacatctccctgcctggggcagggttctgggtacacagcttgtgccaactgagagatgcccctgttctctgtgtcattctgggaagagtgttgcggctgacatgggcatttttctgcacgttaaatgttcatatattgatccttggccaaaagaaaagaaaaacataatttctgtatcagcaccatgcgctaaccaattgcgccactggagctccactggaaaaatgtaatttctaaatatttcatggagacagggagtaggggaaggaaggttggtttcctcagtgggtgctgacctcctattcaggatacaccttcacacagaatggatatgttgaatcttagatctgtttagttagacacttgctcttttaaaataagagataccagcaggcaaggaaggctactttccagttccctctgggggctgatgggagagaggttattagttcagacatcttagcttggcctcagtagatccaagtttgaaggaagatagatgaaggagcatgaagtaaaatgcctcatggcttttggaaggctcttcctttctctgagcggagtgaaaacagattgggacaccctggtaatgatcagctcttgctgttcttagcttgtttccctctctctttttcccttgaagctgatgggatgggctggaagtgaggagagggtaagataggagttggtctgtgaatgaatgaaagtgggaaaaggaaaagaaagtttgtttctccttccatctcttcctggaactatagtcctcggctggatacagtatcactaagccatgcttttatttatttattttaaatttttttattttttgagacagagtctcattctgtcacccaggctggagtacagtggtgcaatctcggctcactgcaacctccgcctgctaggtttaagcaattctcctgcctcagcctcccaacagacagtgttgggctgtggggtcctcctcctgtcagcctccatgtgtgggtacagtgcctgggattacaggcatgcgccaccacacccggctaatttttatatttttagtagaaacgaggtttcaccatgttggccaagctggtctcgaactcctgacctcaggtgatccgcccgccttggcctcccaaagtgctgggattccaggcgggagccaccgtgcccggccctgccatgcatttaaaatgccttattagtctcatttggaaatctctgctctcccactgcaaaagatttcctgcggcttttctgtgtactttgggttacagtttgaacaacagggaatactggaatgcagaggtgtttgagggcctgggagggctggagaaggtttggggaggattgtttgatcacccaagtttgcatgaaaaggtcagcaagggctgtcaccctcatgatttcggaaaaccaggttgtcagaactgagtggatctgtctctcggggtctcacaaagatgaatgtgtaaaaaccccagcgccagtctatgaagttacactaaaacgcagaattgctaccgaaacgggacattcccattcgatgatcagggcattcttttcttgtggattcttctacatgagaaaccaaattataatcagaatgccaatgtgtggcaaagaatgtccgcttggctgagtgatcagattcttgggtccattgatgagcacgtctcggagaggccgaactaggagagactttcttagaggagatagattcaaaaaaggtgcttagttggagaagtttagtggctggtgtcatcagaccaggccatcctggcactgctgcccccactccagggatggcgctgccagagatgccacatgcgggggctgggcctccggggcccaccacggcacaggagaatttctgctgacgagatactatacccatgatttccttttcttattctaacgtggttttcttgaagctgctaacagggcagttacttcagtgtaggcctttcagttgtaatcttaatctggtgcttccttctaagtgtctttcgttgggtatgggggaattactgacagtcttttgggttatttctgtgcgtgatagctcttactctttatatttcaactttgcctcattttgtgctccggggtcaccttaacttcagttctggagtttgttaccccacacactctacaaacatggcagtggggcagccagcagaagtggacataggtcctaaattcagagggtacagaatgaaccgggcggtctcaggagcagagctagtctgttccccagtgacatgagaggtgcagtcattttctctgataaataattgaaccatgctttctaaggggttcccattacaatgagcaggagtgcagagcctgggaggtttgattacagcgagaggaagggtgcaggaggcagatacagtgcatggccaaagcaccctgctctgtgccccgggaggtagaggctggggtaggggtgggaggcgccggagaacgctctgatgccagagtgatgagttgcggcacctctgctgatcagagctggtccctgtcagtgccctgctgaaaagaatcccaagaagcccatagcggcgtcgctttaattaaattccctgtttggttttttgggatgtttgtctgagtgaaatttgagggttggtgcgttaaggtatttctgactcactggggcttggaggtgaccgtggaataagccacagggagtaaagtacactctgccattcgtcctccttgtggggggtggggggcagatatttcttcatcttcattaatctttttctctcttctttccatgtccttgcctcggagcagttattacagtaagtattgtcaagggggttggaactgtagatgatgtataagaacaggagagagaaaaatgtaactgcactggtggtcttgggtgttctttcccttggctgatgtttggagttgctgaggctcagtcctgtcagtggactaacaaggaacctgttaactggcatgatgacctcctgctttaagctgcattggcctgcggctccattaagtgcatcctggctgtgggtctgacatggacacagtggctcgaggccctgcctccccaggtcacaccttttcaaggttgtagagagagctccattcaactgacctgaccgacatcccttccccatctgtgcatctgttgagtccactgagcactgatccttggcaaagtcgtgaagtcagcggggtttctcttccacagccgtcccctctgtcattgcccacccgcccaccattcagcacactcatctgagtgccttgtccctgccggtaaacactggctgtctctgggaaactggttcctgctgaggcgttaatgggtgaatgtgttcctcctttgagaagttccaatttttaagaagcaggaagggagggagggaggcaataattagcttgaagggttcagttactgagaagaaaacttaaggccttagccacaggctagttggagggaaaggggccatggtgagtatcttcgatgggttaggaagtcttctgtgctctttccacactgcttactacccagagtggctaaatgcatggattctgaagtcagacgaaactgttttgagacccaactctgtcgtgatctctgtgacttttttttttttttcgaaacggagtcttgctgttgtttcctagactggagtgcagtggtgcaatctcggctccctgcagcttctgcctcctgggttcaggcgattctcctgcctcagcctcccgagtagctgggattacaggcacccgccaccatgcctggataatttttgtatttttagtagagacgggtttcaccactgttggccagactggtctcgatcttgtgacctcaagtgatccgcccgcctcggcctcccaaagtgctgagatgacaggcgtgagccaccatgcctggcccgatctctgtgactttggttaagtcacctaacctctttgaacctcatctgtaaaatgagggtgattctacagagctctcaggctggggtgaggattgaatgggataatacatgcctagtgtgtcgtgggctcccagtcaagttaactgttattacaaggcagaggctggaatctcctagctgcccatgatccagtaatgcccatctccagtaatgggagatggttactctcaactgtgaacctagtgactttcatgtattttttttccttcttccagaatgagtacatgaaagaagactttctgattaaaattgaaacctggcacaaaccagatcttggcacgcaggagaatgtgagtagtagttcccaaaagccccaggggtgaggtcttgagtctctgccttgtagcctctccagggctaccatggggtcctctctgtggtcctcttttgcctggccgggaaggcagtggcctctgcctagacctatcttaccagcatgggattgctatgtctctgatttgcaaaatgtgatctccggaactttttatggggccttctcgtactgcttggattggtgcagttcctggtacatgggagctatatctttaaaagaccaaaattacagttttctatagagcacaatttgcagtaactcccaaaaaataaaatacacctatcctttagcatttccatgcccaagaatttagacagttattttcacatgtgtgaaataacatatatacaaggagactcattgcagtcttctttgtgtagccaaagatcaaaaacaatgtaagaccatcctgggcaacataacaagactctgtctctaccaaaaataaaaaaagaattagctgggcatggtggtatgtgcctgtggtcccagccactctggaggccgaggctggaggatcatttgaggctgggaagtcaaggctgcagtgagctgtgactgcaccaccacactccagcctgggcaacagagtgacaccctgtctccaaaaacaaaaaaacaacataagagcccgttagaccgggtgcggtggctcacgcctgtaatcccagcactttgggaggccgaggcaggcggatcacgaggtcaggagatcgagaccatcctggctaacacggtgaaaccctgtccctactaaaaatacaaaacagccaggcttcatggcgggcacctgtagtcccagctactcaggaggctgaggcaggagaatggcgtgaacccgggagtcgaagcttgcagtgagccgagatcacgccactgtactccaacttgggtgacagagcgagacactgtcttaaaaaaaaaaaaagagaaaaaaaaggcccgttagtaggacaacgttaaatgcattgtggttcagccaaatagtgacatccttgcagccatggaaaaaccaatagagagcagtcttcaagttgactgttcagtgaaggatggaagttatgaaacaaggtgtgtgcatgccgcccttcatattaaaagaaaaatccacgcacatggatgtttgtatgtaggatctcttagaggtggctgttactagactggggacgagggacaagcaagaagaggagttactctagttactctatattgtatccttttgtaattttgaatttgtgtcataattttgtattatgtgcatgtacagcctgatcaaaataatcagcatgttgctaaacagacgccatctctagaagggtttacagtctttacagcgggtcagcatgttgctaaacagacaccatctctagaagggtttacagtctgtacagccgggaacacatggaaatggtgtgggcaccgtaaacatccggaaggcgttttgacctgcagaagtgacgtttaccctcaatagtcagagcattcgttctcagtcatgtcacttaaaatccagcgggggctgggcgggaggccaaggcgggtggaacacttgaagtcagtagtttgagatcagcctggccaacatggtgaaaccctgtttctactaaaaatacaaaaattagctgggcgtggtagcccacgcctgtaatcccagatactcgggaagctgaggtaggataatcgcttgaacccgggaggcagagtttgcagtgagccgagatcgcgccattgcactccagcctgggcgtcgcagcaagactccatctcagacaaacagacaatccagctgggttcagtgttgtgcacctatagtcccagctcctcaggaggctgagacaggaggatcactcaggcccagctcctcaggaggctgagacaggaggatcactcgggcccagctcctcaggaggctgtgacaggaggattgctcgggcccagctcctcaggaggctgagacgggaggatcactcgggcccagctcttcaggaggctgtaacaggaggatcactcaggcccaggcaggagactgagagaggaggatcactcaggcccagctcctcaggaggctgtgacaggaggatcactagggcccagctcctcaggaggctgtgacaggaggatcactcgggcccagctcctcaggaggctgtgacaggaggatcactcgggcccagctcctcaggagactgagacaggaggatcactcgggcctaggcaggaggctgagacagtaggatccctcggtcccaggcaggaggctgaggcaggaggatcactaggagcctgaggcaggaggatcactccggcccaggagttcatgctagagtgtgctgtgatcactcctgtggatagccattgcctgagaaacacggtgagaccccatctcttaaaaaaaaaaatccattctcccatttctttggataattttgtatgtaattgtataattacttatcattaggaatcttacatctgtggctatgggaatggcagttcctaggtgtccattctggctaaaggatattttataactgacaaaaactgcatagtggttccccacttgttcccacaggtgcataagctggagcctgaggcgtggaaacacgtggaagccgtatatatagacattgcagatcgaagccaagtgctcagcaaggtaggatccgtttaaagacgtgggtggccttcgagacgcagaaatgacttctcaatgctaaagaaaccaggaaaccatacccaacttggcacaaaaggaaattctgatgtgtcttgcttgttttatttttaaaagtgagtattaggagatttcttgtcttgagttggggatgccaccagaaaattagtggcccaaatttgtgtgccctgtttggcctctgaaaattattactggactaagtaggtattgtagctagagtattttgccctgctaaaatgatgcttagcctgaaaaatcggagcaccacttctcaaatttatttttccaactcagtaattaaaaaaacatttacttcctgcctactgggttgtggaatattgtcaggatctctgggttccaggtgagggatgcagaatgcagggaaagacaggtcccctgccctccagaagtcggtggcgccttttcagagtaacacacactggagcagacccctggaaaaggacagtccactggtggaccatgaccttggtcaaaagagggaccaggtctggcttgctcactgttttgcacccaagaagtatttgctcagggaatgagggggttagattcctcctcattcattaccattcttactaggcagaggcctcattgggattaaaagacaggaatgtaactctctgcccactgatagggaatgtgtgtttgctctttgtatcccaggggtgtgatacctctttcctgtggtcactctgcacttaagatattttggggcctggcacggtggctcacgcctgtagttccaacactttgggaggccaaggtgaccgatcatctgaggtcctgagttcgagaccatcctgcccaacatggtgaaaccccatctctactaaaaatacaaaaattagccaggcctggtggtacgtgcctgtaatcccagctacttgggaggctgaggcaagagaatcgcttgaacccgggaggcagaggttgcagtgagcagagatcacaccatcgcactccagcctgggcgacacagcgagactccatctcacacacacacacacacaaagttattttgatttgtgcatttccgaaaagatataaaaaccatcttgtgcttccttgcccaatatcccaacccccaccttcaaaacgttggtggatttttcaaaaagctttttatggaagtttaacatatacagcaaagtgaatataagtatgcagcttgatgaattttctcaaactggatactagcaaaaagtatgattctttgagtattttgtcaactctggttgatctgtgtgagtggagggaagcagtgatggtgaatatttattttttaaagcacacataaatataatctcctcagaggctgggcacattggctcacgcctgtaatcccagcactttgggagaccgaggcaggcatatcacttgaggtcaggagtttgagaccagcttggccaacatggtgaaaccccgtctctactaaaaatacaaaattagggccaggtgcggtggctcacacctgtaatcccggcactttgggacgccaaggtgggcagatcacgaggtcaagagatcgagaccatcctggccaacatggtgaaaccctgtctctactaaaaatacaacagattagccaggcgtggtggcaggtgcctgtaatcccagctacttaggagactgaggcaggagaatcgcttgaacccaggaggcggaggttgcagtgagccgagatcatgcctttgcaccagcctgggcaaaaagagtgaaactgtgtcaaaaaaaaaaaatacaaaattagctgggcgtggtggcgcatgcctataattccagctacttgggaggctgaggcaggaggatcactggaactcaggaggcggaggttccattgagctgagattgtgccactgcacttcatcctgggcgacagagcgaaactctatctgaaaaaaaaaaaaaaaaaaaaaatcggccggacatagtgactcatgcctgtaatcccagcactttgggaggctgaggcatgtggatcacctgaggtcaggagcttgagaccagcctggccaacatggtgaaaccccgtctctacaaaaatacaaaaattaccctggcgtggtcgcaggcgcctgtaatgccagctactcaggaggctgaggcaggagaatcgcttgaacccaggaggtggaagttgcagtgagctgagatcgtgccactgcactccagcctggccaacagagtgagatgctgtctcaaaaaaataaaataaaaaaataaggcagggcgcggtggctcacgcctgtaatcccagcactgtgggaggccaaggtgggcggatcacgaggtcaggagatcgagaccatcctggctaacacggtgaaaccccgtctctactaaaaatacaaaaaaaattagccgggcatggtggcgggcacctgtcgtcccagttgctggggaggctgaggcaggagaatggcgtgaacttgggagatggagcttgcagtgagccgagatcgcgctactgcactccagcctggccaacagagcgagactccctctcaaaaaaaaaagaaaaaaaaaaaaaacttctcagctttgggaaatactttatgagagagagaaatttattatctttgttatttttgttaagtagatgctataagtttgtatctcctgagcccacattagtcaatgtagagggacagctgaaaattaaacttttgttgtggttaattaacacaggaaattgactgcattataaatctgtgaagtgagactcaccagtagtggataggttccatacactgaacatttccagtaatgattttgttaaaacaagccagagggagattgcactggaagatttaaggaatgacagccgggtattctgagcgctggctgtattttagagtcacttgcagagatttaaaaaaacaaaaaacaaatctgtgctgccgtcacctgcagatattctcagtcactgggttttagttggagtgactcaaaaatctgtgttttaaaaaggtcttccctggtgatctggatgctcaccccaggttgaaagtctctgtcttcaacacggtaaatatgtgcctgctcagacagtctggtgatactttcacactggcaaaatggaaaacaaaccctatcggagaaaatcacatagaactctcctctgaggctaatgtaaacagttctacatcttgtttataacattttcccatatttgctttgtgccatcagcatcaagatctggtatggagtgaatgctaatgaaagatctgttctccccatctctcactccctctcccactcccctccaaccccaattccacaatttctctcaggattacaaggcagaggaagacccagcaaaatttaaatctatcaaaacaggccgaggacccttgggccccaattggaaggtaccattcacaccttcactgccagggggctgggcagcatgtgggtgggccgctccctgtggaggaggggcatggctggggtgagctggggacggcctgaggtctgcccgttgttacttgcgtacccatgggtatgtttctaatgcagcaagagcttgtaaaccagaaggactgcccatatatgtgtgcatacaaactggtgaccgtcaagttcaagtggtggggcctgcagaacaaagtggagaacttcatccataaggtaagtagctcggctgaggccttcccagtgactgcgtgtgtgtgttgtgggggggtggtggagaacttcatccataaggtgagtagctcggctgaggccttcccagtgactgcgtgtgtgtgcggtggggggtggtggagaacttcatccataaggtaagtagctcggctgaggccttcccagtgactgcgtgtgtgtgcggtggggggtgtttggcccagtgaagaagatggcccagcccatgtggcctgcatgacagggttgccaacatgagcatacctcacagtttggcggcttcccagctgcccaccttcccttgcactgaaatgtcttacggtttaatgctgtccttccagggacaccacatgtgacagggaaggaaactgaggcaaaagaaggccacaggaagggacttgctatgactgacctacagataaaactcagtctttcttttcttgcagctgaaaggcaagaggtgctgggagccaggttggccggtgccctgaattactctgctgggcaggtctaaggagttttagagccttttaatcctccgacatgtttgagcctcacttgggccatatttcatagctgctggccagttttaatctggcattagacaccagagacaggaagaaatgtggcagtggtttggggcccttggcttgcctaggagttcatgggctgctgtcttgctggtgctttgggcagagggcctagtgtgaggtaggcatccttctttcttgggggctccctcctatgtgaagccatacctgttagacacgtgaaggcaaaggtcattgacccatggctggtccagataaccagccgggcattactcctcctcctgtccgcccgtccccagtctagtgtgggtattcgtgtggagtgcatggagagaagggctgtggcagcagcctttgccttctgcgttctaacgtggttccctcctttctatagcaagagaggcgtctgtttacaaacttccacaggcagctgttctgttggctcgataagtgggttgacctgaccatggacgacattcgaaggatggaagaagagacgaagagacagctggatgaagtaagtgggggctctgggggctctcaattagataaacaaacgaagattaaggagactgttttgctggggcgcttcaccgagagcaccatcctgtagttctgggaacacgtcagtgtctgctacagggacggtatcctgggcagtacgtgggcactatacggaagaaaacagcctgtgctcttgaattgacagttgagttgaagtcttggcatacccacagagacaaaaatggcagtatgtgccgaatgccaagtgggtaatacagctgctacagcgatgcttcagagcctggtgggaaagagcgtgcggggctgcagagctggaggtgaccctgggaggaggcaggctgggctgacctgtgaataccatgcacattacccacagaggacagccacagcgcacgcaggagctgacagctggcggctgtctacggtcattttgagctatcagagttgagagcttttgcttttctttttttggtcttggcgtggatcgcagaaggagggttccctgttccttaggagcctaaagacccagcacttctcatgcctcatttggagatgctgatgcttccttgagaggcccactcagaggagattgtcagttagtaacattcaagcactcactgtgtgccgtctaccattctgagggcctttacctactgcagtcttcacgataccccatgaggaggcgctgctgctctccctaccctcagatgaggaagtggaggctctgagagctcaatgctgcggtgctctgggtcacaccgtcttgcaggtgatatggtcagagtaagagcccaggactctctggccctggaaccacagctcttaatcactcccctgtactcctccctctaaatgcaattttgggccctcctgccatcttggagctaaaaatatgataaggcaggaagctctgtttcataagaactgccatcacttctccctccttgccccaggtggggttggcatggagtttgggtatccagtagaggcattgctttgcaacagcccactcagctctcctgcagggcctcaggtgagagccaggcttgggcgcccatgctgcccatgctgcacggacggtgtctgcttcaccatgctggtctagggcgaaaattgggtccagaagttcttcctctggaaccccgcagggaactgtttttaccatccagaatgacacttttcctgggctgactcactggtaagtggtgcactgagttggttcctcttgaagacagatgttttggttattcatttagctacatttagcagggaagtggcaggatttcattggggcacagtccctgattctttcgctaaggatctttaggaaggggtagacctcagtgtccaggggtctggtgattgtgactgtgtaagagaagcctgaggcttttggtcaccctagtcctgacaaaaagaaagggaaaatgttaacaaatgaggaaacatggagactttcattggagttttagcctggagcttcagccatccactgcctgacaaaggccagcatgacgtatgttggggttcgtggaagtatttgctgtccacctttcattccttcgggtagaactcaaattcttggagctagaagaactctccagaggatctactggatctgctttgttcagatccaaactttgagagccctcagtgttagagagttattttttaatctctcagacccttttgaaaatctttctcggccaggcacggtggctcacacctgtaatcccagcactttgggaggctaaggtgggcagatcacgaggtcaggagtctgagaccaacttggccaacatggtgaaaccctgtctctactaaaaataaaaaaaattagccaggcgtggtggcggacacctgtaatcccagctgctcaggaggctgaggcaggagaatcgcttgaacccaggaggcagaggttgcagtgagcagagatcatgccattgcactccagcctgggcgacagagcaagactccgtctcaaggaaaaaaagaaaaagaaaagaaaatctttctccattccatggagaatcatgccaaaagcttaggtgatcactgtcctccaggataactgcaaatagaagaaactctctttggaattagaattttaaaactcatctgcagtgggagagaaagcaagtccacctcattgtggtacatgttgtggtctcttcagcaactgtgcaggacctttgtgtgctgactacgcttgatgtggcttgcctttttatttttttgtctatctaaaaatatatgtttcatcaaagttatattttgtagttttaaaactcagcatcccaggattatgagtcccacccctcagaagcagccccttgtaattccgatggttgttgcttttgttaattacttccatactttcaaataatctatgctgatgctcttagtagttcttttttttttttaagaggtgaggttgtgttctgtcacccaagctggagtgcttggcgtcgtgcagtggcatgatcatagctcactgcagcctcaaactcccaggctcaaaatccttttaatttttcttatttatttattttttttctgagacaggctctcactctgttgcccaagctggagtgcagtggcacgatctcggctcactgcaagctccacctccctggttcacgccattctcctgcctcagcctccccagtagctgggactacaggcgcccgcttgtactcggtagttacagtggggggaacctctacctcagggtactcggtagttacattcgggggcgggaacctctacctcaggacttcgagtctttttttcacggaggcttgtcactttccctatagaggactcccctgtctcttgctgtgggagacaggcaggcagccagcattctggaggccacactgaggaagggtcccagtgggctcattgtgccattgattcgctttaactttaattccgtcgtattctgcctcttgcccaccttccccctagcagcacctggggtcctgaggtcagggttccctcagcgcttcagagagtgaacctcctggcttttgctgtgaaggaaaggagggtggttgcttgacttccagagcaggagaagggaacaccagttcctaaccgttctccatttggactttcaaaaagtcaccagttttgagccacacctggtactcccatctgcagcgggacctggtgcttccagttcctgagcctttgcagaacctgcagctccttctccgctctccatcctccaggcacttaggttcagcttttgctgctctgcaaattagctactgactcttctgtcctttttccatctcccaaaaggttgttaactggctcttacctgctgtggtgtcctctgttcctgttgtcttcatagtttttatctttttaaattcctttactgtcatgtcatagggtttgggggaggaatagagatagatgcctgtcttccatgcaccgtgatgaactgcacacttggaataggaattatgactgttagtctctaagccagtacatagtcgtctagtgcaggcagattttgtttgtgagtgatgaagggtcactgcaaggccacagtcatcactgctgtaactctagtccctgtccgggcggacccaccattcttgaatgaggcttgaagatttgggaagcaaggcatcgagagattagttcttcgccctaaaaagaaaaaatttctggaactatgtgcctgtaggaaagcagtttctgtctctctctttctccccaacttgccttttttctccctttcccaagctcttactctcttaagaggcccataatctgaaaaatggaaggaggtatcttaaaggtcatttggtccaattatatgttcagtgcttgagtactctctgaagcttccctaccagcctttgcttgattactgcctgtaatggggaactcactgtctcccaaatatggtagtaataaaaatatttgtattattaatagaagctaacatttattgaggacttcctgtgtgcctatcacgtatgctaagagtttcacatgtattacatcacccagttttcatggcaacctgtaacacaggtattagtttcattttatagataaactgtggctcacagaagttgaggacgttttataattcactgaacaagtacctcttggcctttggccattaactctttagataatgagattcagaaaagagaattcacttaaaaaatgttaagaaaacttgttttctttttttttttttcttttgaaacagagtctcgctctgtcacccaggctggagtacagtggtgcaatcttggctcattgcaacctccaactccccaattcaagcaattctcatgtcacagcctcctgagtagctgggactacaggtgcccgccaccacgcctggctaatttttgtatttttagtagagacagggtttccccatgttgcccgggctggtctggaactcctgagctcaggtgacccacccgcctcagcctcccaaggtgctaggattacagttgtgagccactgtgcccagccaagaatctaaaattttattttattttttttgagacagaaccttgctgtgtcacccaggctggagtggagtggcgccaggctggagtgcactggcacaatgtcagctcacagcaacctccacctcccaggttctagcaattctcctgcctcagcctcccaagtagctgggactagaggcgcccgccactacacgccactaattttctatttttaatagagagggggtttcaccatgttggccagactagtctcgaactcctgagctcaggcaatgcacctgcctcggcctcccaaagtgctgggattacaggcatgagccaccatgcccagcctctaaaactttcataggagctgcagaggctgcaggatccctatatgtgaaggatgacactgccctcatggagtctctctctctctttttttttttttttttttgagatggagtcttgctctgtcgcccaggctggactgcagtggcgcaatctcggctcactgcaacctctgcctcccgggttcacaccattctcctgcctcagcctcccaagtagctgggattacaggtgtgcgccaccacgcccagctaatttttgtatttttagtagagatggggtttcaccatgttggccaggatggtcttgaactcctgacctcaggtgatccgcctgcctcggcctcccaaagtgttgggattacaggtgtgagccaccatgcccagccactcagggagtcttaattccctccaacctgctggcagtgattgcagaccatctggaacatcagccaacatccccaattatggaagtagctttgttttcttttcttttttttttttttaagagagacagtctcgctctgtggcctaggctagagtgcagtgctgtgatcatagctcactgcagccttcaacttctgggctcaagtgatcctcccacgttaagctcctaagtagctaggacttcaggtcccaccactacacctgactaatttttttagagacaagatctcaatatgttgctcaggctggtcttgaattactggtctcaagtgatcctcccaccttggtttcccaaagtgctgggattaccatcatgagccactatacctggccctgttttctttttaaatacagtttaaggcacggtggctcaaaagcctgtaatcctagcactttgggaggctaaagttgggctgatcacctgaggtcagaagttccagaccagcctggccaacatggagaaaccccgtctctactaaaaatacaaaaatcagccaggtgtggtggtgtgtgcctgtaatcccagctacttgggaggctgagacaggagaatcgcttgaatccaggaggcagaaatggtagtgagccgagatcatgctgctgcactgtccagccttggcgacagaacaagacagggtctcacactgttgcctaggctggagtatggcagcctgaaacgcttggattcaactgatccacccacctcagcctcccaagtagctgggactacaggtgcaggccaccacgcctacctaatttttaaaatttttttaatttttgtagagacaggatcttgctatgttgtccaggctggtctcaaactcccagccacaagtgatccttccacctcagcctcccgaagtgttgggattgtaggcgtgggccaacacacccagccagcttcatttctgcaccgaaccttttattttgaaatgattgaaagattcacttgcagttataaaaaataacgtggaaagatctatgtaccctttacccagtttttgccaatggtaacatcttgcaaaactatagtacaatgtaataactcggatattaacattgacactttactatttttttagatcaaaggtgtatttcatacttaatggtcaaaatgattttcaaaagatagaaaaaaaatttaaaaatagaagtccaaataactaataggtgaatacataaataaaagtcttcttgtttcagcccctggcctcattccctaaaggaaaccactgttaaaaacaaaaacaaaccagggctgggcacggtggctcacacctgtaatcccagcactttgggaggccgaggcgggtggatcacctgagcttgggagtttgagacagcctgagtaacatggagaaaccccatctactaaaaatacaagaaattagccaggcgtggtggtgcacgcctgcaatcccagctactcgggaggctgaggcaggagaatcacttgaacccaggaggcagagattgcggtgagctgagatcgcaccattgtactccagcctgggcaacagagcgaaactctatctcaaaacaaaccaaccaaccaggattgaagtttctattttcctattttcacatacacattttcttcagccatattatatgtgtatgtatagcctacattggctaaatctgaggaacaccacaaacatcagataaatctctcatgtcgtgtaggccccaggaaacaggaaataagcattcttagatcattgtaagactgaagtaatgggctgggtgcgatggctcacacctgtaatcccagcactttgggaggctgaggcaggtggatcatctgaggtcaggagttcgagaccagcctggccaagatggtgaaaccccatctactaaaaatacaaaaattagctggatgtggtgcacctctaatcccagctacttaggaggctgagacaggagaatcacttgaacccgggaggcagaggttgcagtgagccaacatcatgccactgtgttctagcctgggtgacagagcaagactccgtctcaaaaaacaaacaaaaaaagattgaagtaatgaattttatttcagtggtatggggaaccttgtttctgacagtaggggaagctatcatgttcctggtaggaggttgcatcttatttcaagcggtgggaaaacaggacctggctttgcattagtaactgaagccaggtggtgaactctcagcatgtgtaaggagccggctgagaaggagctttgctcccatgatattaaattatctgattattgaaaacttttgtaaatggtcattagtgagcaaattgtctttttaaaaattctattatgaaagagttttaaacttaacagaaaataggcaagaacagtgccaagaactcctgtacactcctttgcccagagactattcctttagagcaaaggctacagcccagaatcacgcgcttcaccccattcatcacagctctcctttctgtccatctggtgccactcctcagttttcctgaacttccgcgattttggcgtttgtggaggttataggctgatcattttgtagaatgtctttcaatgtggattcgttgatgtttctgcatgattagaccccacctgtgtgtacttgaagcctgaatgtcacagactctgttctttttatcctattctgtgtctttctgtccagttactggtgaggttactgctgtcgccttgaagcacaaggtgttctgggtttgtcttgttttttcatgaccctgtaactggccacatcttcaaggagcgctgcttccatatagtggaggggggtgtttggaaatgagatctggttgctggtgtgcctatttccactagggtattgcagctcccagaccttctcataggatagagctaggggacttgtacatttatagttatttctgtatctgcgtcatatatcatgttcacacaaatgcatctaattccaatctaacatcacagagttgtcttttaaaaatatgacaagctggccatgcgtgatggctcacgcctgtcatcccagcactttgggaggccaaggcaggcggatcacctgaggttgggagtttaagaccagcctggccaacatggagaaacctcgtctctactaaaaatagaaaattagccaggcatggtggcacatgcctgtaatcccagctactcgggagtttgaggcaggagaatcgcctgaacccgggaggtggagggtgcagtgagccaagatcgtgccactgcactctagcctgggcgacagagcgacagagtgagaccttgtctcaaaaaaaaaaaaaaaaaaaaaaaagtttcccagtggagaactactgccagagatagaatctccacaaaatgtggcagtattaaattttcagtgactagaatacaattctgaagtgggctatggcttaaaattccaggttcttcagagcttctatacacatctcctttgctataggacagtgtctggaacgaaagaataaaataaacaacatttgaaacagggtctcaaataattttttattggccgggtgtggtggctcatgtttgtaatcccagcactttgggaggctgaggcgggcggatcatgaggtcagaagtttgagaccagcctgaccaacatggtgaaaccccgtctgtactaaaaatacaaaaattagccaggcgtggtggtgtgcacttgtaatcccagctactcaggaggctgaggcagaagaatcgcttgaacccaggaggcagaggttgcagtgagtcgagatggtgcctctgcactccagcctgggtgacagagcgagactctgtctcaaaaacaataataattttgtattctataacataaacagcatttggaaccgcgtctccagtaattttcatctctacacaggccccgaatactcagtgcatactccacgtcaggcactctgctctgctaagtacacgaaaacctctttttttttcttttttgagatggagtctcgctctgtcgcccaggctggagtgcagcggtgccatctcagctcactgcaagctccacctcccgggttcaaacgattctcctgcctcagcctcccaagtagctgggattacaggtgcctgccacaatgcccagataatattttttgtatttttagtagagatggggtttcaccatgctggccaggctggtcttgaactcctgaccgcacatcttaaatcttcatcacaatcctatgtactgttatctctattttattattatagaaattggggcttaggccatacccagtggctcaaacctgtaatctaagcactttgggaagctgaggtgggtggattgctcgagtccaggagtgtgagaccagcctgggcagcatggcaaaactctctctctacaaaaaatacaaaaattagccttgcatggtgatcgcaccactgcactccagcctgagtgacacagtgagaccctgtctcaaaaaaaaaaaaaaaaaaaggccaggtgcgatggctcacgcctgtaatcccagcactttgggaggccaaggcgggcggatcatgaggtcaggacatggagaccatcctggctaacatggtgaaaccccgtctctactaaaaacacaaaaaattagccgggcgtgttggtgggcacctatagtctcagctactcgggaggctgaggcaggagaatggcgtgaacccaggaggcagagcttgcagtgagccaagatcgtgccactgcacaccagcctgggtgactgagcgagactccgtctcaaaaaaaaaaaaaaaaagaaaaaagaaaaaaactgaggcttagagagcattgcagtaacttactcaaggtcatacaattagtgatggagtcagaatacaatccaggccaggtgcagtggctcattcctgtaatcccagcactttgggaggccatggcgggaggactacttaagtccaggggttcgagactagcctgggcaatacaatgagaccctgtccccacacacaccgaaaaaataaaaaatcagccaggtggctgggtgcagtggctcacgcctgtaatcccagcactttgggaggctgaggcaggcagatcgtgaggttaggagattgagatcatcctgaccaacatggtgaaaccccgtccctattaaaatacaaaaaaaaattagccaggcatggtggcgtgtgcctatagtcccagctactggggaggctgaggcaggggaattgcttgaacccgggaggcagagattgcagtgagccgagatcacaccactgccatccagcctggcgacagagagagagactgtgtctcaaaaaaaaaaaaaaaaaaagccaggcgtggtggcacatgcctgtagtcccagcttcttgggatgctgaggcaggaggatcacttgagccagggagtcgaggctgtagtgagccatgattgcgccactgcactccatcctgggcaacagagccagaccctgtctcaaacaaaacaatacagtctagggagtttcattctagcagctatgctcttaggtgctcaaaatttgttgaacattataaagaacaaaagttgagcagaaaactaatggatagtgaagaaatacttattgacattcttcacatagaatggagttttcaaatcagaactgattttagagagatgacgtctacagtatccccagtgatgtctgcctggaaggtgccagtgacagggaccacttggtgcttccacagaagcccccatcctgttttccagcagccttgcacatctgtggatctgagacctgcacctgcactttccacctctgcatccttgtgcctagttctgacaccacattgtgcccacctttaaacaggtcaggaaagggaagttctgttactctgccgggaactcctctcccggagagccacaggattttctccctcatttctctcaggtttcatctcaaacctcacatacaagcttctgtaactacctaaaatagcacttacccacagtcattctgtatccgagcagcccacagtcctagctgacatagatgaatgtttgttctctgcccatcctgccccagaatataagctccttgaggagagaactggtctgtttagttcacagctaaatattcccagccctctggaagtccctagcactaaagagatgcctcactgaggctgggtgcggtggctcacgcctgtaatccaagcacttcaggaggccaaggcaggcagatcatctgaggtcaggagttcaagatcagcctggccaaaatggtgaaaccccgtctcccctaaaaatacaaaaattagctgggcgtgatggtgcatacctgcaatcccagctacttgggaggctgaagcaggacaatcgcttgaatccaggaggcagaggttgcagtaagccaactttgcgccactgcactccagcctgggcgacagagcaagactcctcacacacacaaaaaaagatgtttcggccaggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcggcagagcgagactccgtctcaaaaaaaaaaagatgtttcataagtatttgttgaatgaataaatgaatgaaacgggccaagtgtggtggctcacacctatgctgtaatcccagcactttgggaggttgaggcagaggatcgtgtgaggccaggagcccaagaccagcctggtcaacataggaagacccccccacacacacctctttaccaaaaaaaaaaaaaaaaaaaaggtgcttcaaacaccgtgacacgagagaactagaaatcatggatggtgagaccagtgacacagatctggaaatgtatggcttcgagtccatatgcagaattcttccgtccttccagtgtcttgctttttacacaaaatatgccccaccccacctatgggcaggactgagaaggcaggagttccatcagcagcaggagccttccatttgtcctgctttttttgttccagatgagacaaaaggacccagtgaaaggaatgacagcagatgactaaagccgcctttcccctctgcactgtacgtaccaaatttctcactgtgcgtgtcacagacgctaaaatcagtttgggtttcaaggcctcagcagctcactatggagtcagaaaacctattcctccttccctctagtaatgatggttgccacgctcgatagctctccacttccactaggagattatggcccttgggacatttcagggacattttccaaagaaccacccagatagagacaatggacagggagggggtggtggatatagaaggggagttcatctgctgcgaatcactcctcctgtctgccagcttgatccatctcaagttgcagctgtcatgttgggcactccctggccttcccacgccagcgccagctcccaaaagctgccattacctgcccttcccccttggaaaacttgctggccagacagcttttgttagcacccactgttgtctggtgcttcatttccttctttatacccccgatcccatactaagctgccctcatcagaggtggcatctttcagatgctgggagggtgtttctgcccaggtcacagggccagattgggggccccttgtttcatgttgtcacttttccccaagccccctccttccgttaactctcggtgctggtttcccagtgccctgtacaccacccgagtcatgggattccagcagctcaaagcagtcttaatcactgaatgaaaaacctggctctgctcccaattagcctcagagagaaaattatttttacaaataaaagctggcctctaaccctacgggcaaggagggccagggtctcaccaggagtgacggcaggccctgcttactctccctgccccatgttcccaaagcagcctcggggaggctggagggtggaatgaggcggactgctgtgatgccagcttctcagtcactgctctgggcctcagtgctctcccccactcccttccccacccacccactggcttccctcctcctcttgaaattatccattcaggacgatttacagtgtttctgttttctcctcttgcttccttaatactttcatttttcttctagttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtctttcaaatagctgccttttgtgatgtggtgatttaaatgatttaagttcatttgttctcaaccttggggtaaactgaggtattttgcttcctgggaagatcttcgcaattttgagtgctcctgtggggagcggggatgagctaaagatacaatgtttccctgccccgcaccgcttccacaaaatagcaatgtggttttgcagctctgacttctgctcccagtaacccatcgttagggcactctagcactatggaggtacccaaggctcagccagtctctatttaagaaaatttaacaaatacgagtaaccctgtcccaatcactgaatctctagttactactcttagaaacacctgtggcttcttggccctcctgttgcccgctctgaatctctctgcagtctacaaaatcgccccagtcaactctccacttggagggaattgtccagtgtggcccctagaattgagtcaccccctagataccaactgtctgaccccgaggagctctgtaagtccctgctcctcctcttccctttggggctggtgctgccactcagcaataatcctcttttctctgtgctttcttaggtccctgtcctctgtctttgaggctggttaggaagcaagagtcctgatctttcatgctgcacaatatgagcatgcaaaaagctttttccagcagaacatgttccctcgtctccagttgccggaaaggaatttggggatcaagaacttagctcgtcctacccccatgttgagttctgccctggaaaacccaaagcaagtagtgatcatagtacagaacccgaccaaagtaggctggtgaggaagtccaggctccaggggaacagacgctgcccagtgttcatagcttcctgcaacttgacagagcctgagtttgcctcttagtgggagaatgagagagagctgtagtgtcacctgacattccccaaaccttgtgaagcacgttggcctaagtgtgccgtgatcccagcccacactagcctgggtgcatctgctaatgggagaccaaatctttgtccgggaagcaagaagtgggtgggagaatgtatcctgtttttgtcagtttgtttgccttactcatttctaagtgcaataagggagtgtctcacaggattgcacctgtgacatcctgatggatgcttccctgtggccctcctggggcaagggtggacagactcagacccccagcatggttagcgctgaccttcattgaggtccctttggaaccagatgtcttgttacagacaccttcctctgtgtaagtctcctcaccttgaggggtctttagtaatgcatctgggtagcatctcaactgctggtagcatttatctgacttggaaagttggagaagaggcattcctactggagaaaaatgtcagtgttttcctataagctctgtgttagctattcattatatttgtgcttaaagatgttccttcattcatcaactaggggaagtccagatgcgggttatcttgaaagaaacaaactgacattctaggcagacagttgtctatgtggtctgagggtcagcagctgttagtctccttcctttggctcttgagacccacacatatcactttagccctaacaagggctcctcccacctccacctgttgccccagttgaaaagcatccattatgagctgaggtcagcctggatctggaattgcagcccacataaacataaaggaggatgtccctggtctgttccatccccacggatggtgttgctgctgggcaacagtgttggcttcttttaagtaccccctttcctcctcacccacctccaaactgactagcactcagagggacttatgataaaggttcagctccaggggtagtacctgagtgtgtgccatgccccttcagaccagctgcttccatcagaattccagggtcacagccccaacagaagcagcagtgcctctgtaggaggggtgctgggctctggccttctcatgcagagaggtccgggacagggtcagtatcgtgggcatgtgtatagcttcccaagttcttttacagtccctgctgggactccctgacttactttggttggttcctagtgctacttgttttacaaactacactttgtagaattgattagattaccttgtttatttaatgtgagtttgtgcctttttgtctcaatcttccaatacaggtatattgagaaaaaaagcagtctaataaaatcctagacag

SEQ ID NO: 35806 - DNA, 18853 bp, Homo sapiens
cctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggtaacctcaggctccaaggggcggccccggtccctggctgtggaggggtggctctaattccgcagaaggcaggaatggggtaaaggaaaaaagcgcagatcttgggtgtggagggagtcaaggcctgcgtgcaaagaagggaacaaatccaggtattgagaatgggaaaagaaaagggaaggaggggatgctggatgcttggatatgcagaaggtctgcttttgggcctgggagggagaaactgggcggtgaggaagttggatgcaacgacaaggggaaaatcaggtctgcacttgggttggaaaatcgaggggtggaagttgcaagaatgcatgtagaagactaagcctggagtgtaggaggaagaaaacgtgcagcagctgggggctggatgcaaagaaggctgtaagccgcagacgggcgtctgcaggcaactcaggcggcgaggaatagccttgaagccgatccctcgcgtccgccagggggcgtggaggggcggagctccagcggccttcagaggggtcgctaggccacacggggcgagagggggctgggggaaacacccccgccagttccgggtgcctggagtttaaaaggtcccagcaccagcgaggggaggggaggggaggggcgggcgtggagacctggaaggaggtaccgatccagccttgattgcagccctcttgcacaacggccataaggacgggtgcaggccaagagcaaggacatgcaaaccccaagacctgctaacgggcggcgaagcgggggcacgccctcgcacacgcagagataaattgtgctcccatgacctttatttggaaagtgcctgcgggcctaaaattggcctttgtcccaccgagtacactcagcactgtactttaaaccggataaactgggctgtctggcaggtactaaaaacagctaaattctcctgtgagtgttctgtatgttaacacttttattccttgttttgttttaggcgataaactacattcagttgagtctgcaagactgggaggaactggggtgataagaaatctattcactgtcaaggtgagaattagcaaattttcccccttcttctgtactttctttgatgtggcagtacagtgtttaactggtcttgggggcaggccgaggcactgcaagggaatgagtgaggaatatttccaacaacgaattccaacagcttccttgtttcttttaatacagtgtcttatctgcaagagatcctttttgcccagaaattattgtagttcatgaactcggcaaaaaacaatctggccaaaaacttgaggttgatgaaaataatattaaatggctcttttttttcattaaactactctgtattgttattccaggtttattttctggaattgcacaattatgttaggagataggattcagctacttcatatgagctggtgcctgctggtcttggaacagcccttccttctgaagttgggattgggttggagacaaaatctgaggggcaacaaaggtggagaagtcagtccagtggggcctcaagcccatcccatggaaatcagatccagaagaaatacaattatgttccacatggtagtaacaataaagcttcactgttttagttaaaagatggtaaaaatttcatggctaagtaatgtgaggaaaacctgaagcgtctgaagtatgcattatgagataaagaaagattactgcagagagtacagttgctttaactgagaaggaaatagtgaactaaaaagatatcagtcttcacattttaggtacaatatttgacctctattaactgtatttgccatcaagaataaattgccatgtcatgactgttgcatcatactatatagggacatggccatggaagtgtattatcaggaaccagataagttcactgcctccttttttgctttgttttaaaacaaggataggtgtgacagtggaatcaaacatgaactgaatcatatgctttcagctgtactacaaattatacttgacattacaaatgggaagtaattgactcatccacaccattctgttcatttcttttagtctagttcagttccagaaggttcccccaaaggaatctcctaaacactagtaagaagaattctagaattgcgaatttgggaagtgaaaatgggcctggggattggaaatacatccaggcttgtcaagaaacagacgcttactgtctactaatcattacatttttatttaaagaccaaattactttagctcaatttttcaagaaagactattttaggcttcttatctaataattctttaaagtcaattctcttgacttttttagtccttaagagaataaaagcaatttgcagctgtgttgttggattaaaaaagagtttcgattagagcatcattagaaggaatagataacttttagcaggctcagagcttcttctgcctctagggacaagctgggacagtttcatttcttccaaagcgtccaaccttgcactttctgagaatcagattgatttgtatatgctacccccacaccctatccttaaagtgctgtcttcctaggacaatgcacagtttgtcctatcccactcactagcagcttacccttgcctgtgaacagccagaagaagatgacagggacatgcttgggtcctgggcagtggccctactgtatagagattcttctaattgagaaatcactttgttgtatttagccccacatctccaatgtctgtgttatctctaggaaaacagttccaccaggaattcttcgtctcgcttttagacttaaagtttccctgaatatgggtcacaggaaccagctgaatctcctcatggctagttatttttattaaataacaaaaacagcctcttaaaggaggagaaatgctagcactcaccattctggacatcttgagagcccagtaaaatgatgagttggactgaagtgttcaataaacatgagattgtggaaataatctcatttcttaagacaaaccagtagttgagaataatgattgcattatgaagggcacgttatagggtcaggctctgccacgctctagctaggtggccttgggaaagctcttttttttttaacaaagtaaaatggggaaatgatggccatttttttggattgttatgagggctagctcagaaaccgcgtgtgaaacataacacaatactttgttcagagaagatactcaattctaatggtaaatagaattgctgttactagctttttattcaactacacataaattgaattgcatgaattgttcttttagtagtcactacgttgtttatataaacactacgttgtttatatatttcactttataatgaaataaatgacaaggcatgtattttttttttctttttaggtttattgaagtcaaaatgtccaaaaaaatcagtggcggttctgtggtagagatgcaaggagatgaaatgacacgaatcatttgggaattgattaaagagaaactcatttttccctacgtggaattggatctacataggtaaatgagttacccctccgtgtagcaaactcagaaaggataatctggctgggcatggtggtgcacacgtgaagtcccagctacttaggaggcagaggcaggaggatccctcaagaccaggaattcaagtccagcctgggcaacagagtgagaccccatcactttaaaaaaaaaaggaaaaaaaagggaaggagaaacaggaaaaaaaaaaagaatataatctgaattattttgaggtgaagttagctttttttatatagatatagctgtgttttgtgaataaagtttgttttaagcctaaatatattcagatgaatcttctaattttaacatactgctagaaaaactggatttatcatctaaaagtcaagaattataagggaaagaatgattttcagattcttctaaccttctgtttcctgtgaaggttttatttgtaataaaacagtggctaagaatagtacaatgtattgagaaaagggaaataagagaggatgtaagaaacagtaaactaaatgcagttaacacaattttgtcatttcaaactcaattttctatcactttacttagtcaatggacctgtttccttttcatgcctcaccttttgcccttttcatacaattgtagtgcagaaagaattcatgatgtttcttagttgaacccctcctttccagcaaaattcccttaaatcctgtgtccctttgccctgtgtgtaaagtgcctggggacagatgcaaaagtctatgtaattctctcatttttttcgctgtgtttttcataaacttgcttctgttctttgtacctttaggtagagatagaatttttaaaagggtaaagtggctgaagactggcatagaaaaatattgagcaacacgtttcagccaaactattggcaactctaagtgtgtttgcctcagcccagaattagtcatcaaaatttgtcctaaggacctgtttgagtggagacatttaattcacataatgtcattaaacatactttttaattgttctaaacctaagctgctgatgtctatattgaaatcatgataagatataaatacttgcagaagtcaaccaaacataagaaattaggcataaaaacatcttccaactaggttaaaaaaaaaaagcatcttaggaactcctgtttcaggactttacatgacagtaggtgaactggcagggttcttttccttataatggctgcaactaaagatgctttgagcctctttagtgtggaatcatgaggagttttaaaggggagtcactatgactaggaggaaaaaatttggtggctgcagactagataatttttggaggctcaaacaagttttaaatttttccaaaattcctattattatcactgactggttctttttcaggagaatggagcaggtagtttgttttatgtaggctggacagtggtctgggcaatttgttccttcctttcttatcttcttagaaatgttaagaagacaagcaaaaaatctaataatttgctgatagattctccttatgagaaatggttcctaggaacttgaaaactactgatcatacttcctgttggagttgggattggatcaacatttcctatgcaagaagataacaaaggacatgactttgttagatttatatgaattatctaaagtcgaagcagttggaagttatttttatttggaaatatgtcaagattactatctctttgtttgcatcatgagttgggtaggagatctaagaaaggaagataagggaaccaaaaagaaatctagaggcaggttttaagagctgaaaaaccttttaaatccttggagaacagaataaacaaaacattattttgttttcttgctttttaacaaactattgcatgcttcaaataaagctttgcagtcattttctatgctccctggacaactaacattctttcagctctgaatgacctgcaatctttgtgttggtgtatattaagctattactctctggtatgtagaaaaccattgatggattcctttacttacccaataaattgtaggcttgtttccagagcaaacacttgctcaagaattacagaaggaattagctgggcatggtggtgcatgcctgtagtccccgctactggggaggctgaggcgggggaatcacttgaacccaggaaggcagaggttgagtgagccaagatcgtgccactgcactccagcctgggcaacaaaacgagactcatctaaaaaaaaaaaaaaaagggaaaggctcattttatgactaactggcattaatgaagtagtcattcgcatttttggcatcaactgtcacatctttacctcccaccacttcaacgtcaaaatacaaaaaatcctttaacccctcccacccccttttatttttaaagagcaatatttactaagggaaaaaggtggtccttagacttacacttattatactaattatatggagagaaaccaggccattattgcctctatctggtgaaaaacaggaggcaaagggcagagtttgatggtttccattcattttcctgatagacagcttcccattacaagaggaggggcagcccagcagtctagcctctcttagttctctttgtagttggcacccatcttctgtgtttagggtgtgccagtgctaaaacttggcagattttggtgtactcagagccttcgctttctgcataatgagctctatatgccatcactgcagttgtaggttataactatccatttgtctgaaaaactttgcttctaatttttctctttcaagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaagtaagtcatgttggcaataatgtgattttgcatgttttttttttcatggcccagaaatttccaacttgtatgtgttttattcttatcttttggtatctacacccattaagcaaggtatgaaattgagaaatgcatatatgtataactgtatatttacacacatttagctaaaggcaaatacaaataaacttacaaataggcgtccatctcaacacattttttttcaaacatgctgttttttttcctttatccttttattcagttataccatatgatattgccatttttatgttggtaatttcatatggttcaaccagatctgtggttttcaacactggctgcacaataggatccccttacaagtttttttggtggttttgttttgctttgcttgatttgtttctttgttttagtttcaatgcttgagtaccaccctacacaaattaaaatctgaattccatggggttcaggcattttaaagctccccaggtgaatctaatgtgcaaacttgagaaccaccaaagattgtattaaacatgatcccatcatgcataaaagaaaaaactggctgggtactatggttcacacctgtaatcctagcactttggaggccaatttggaagcactgcttgaggccaggagtttgagactagcctggacaacatagcagaaccctgtctctacaaaaatgaaaagtatttcaataattatgtcaattgttcatggaagagccagttttgtttattcatatacaaagtgagtaggcgaagctgagtggggtggcatgtgcctatagtcccagctacttggaaggctgaggcctgaggatcccttaagcctaggagttcaaggttacagctatgagctatgatcacaccactgcctacgcaacagagcaagaccctgtctcgaaaaagaaaaagaaaaaaaaaactgactcggtagttgaaagcagccttactaaagcattccttcctgcctggaaaaaaagtattgcttctttacttctgtaccagtacacttgttgccaaattaagcaaaaaaactgccaagtaaacaaaatcaaagttcagtgttgaaactgaggtttcagactttcacagaaagtagtttatgtcttaaaaggaccttaaaaacaggaatctctcatgctgaaatccagaggttttaatgtagccatcattgaaaacagtgtgttgagggtaaacagtttagtccttgaggggtcagttaactttgttccactctgtggctaaaactatcctttcatcctggccaaagccttcagaaatagctcccaggggcccaagcaagggaaggtagatggcagtggtgcaaactcgctaatcttgtaaaaatcaccctagattctttccagttcagtcgtgccttttttctgcgtatatcctttttgttttttgtttttgagacagagtctcgctctgtcgcccaggctggagtgcagtggtgtgatcttggctcactgcaacctctgcctcccgggttcaagcaattctcctgcctcagcctcttgagtagctgggattacaggcacatgctaccatgcccggctaatttttgtgtttttagtagagacggggtttcaccatgttggtcaggctggtctcaaactcctgaccttgtgatccgcccgcctccgcctccgcctcccaaagtgctgggattacaggcatgccaccatgcccggccttcctctttttttttttttttttaattattttggcatcagtcatttgtaaaaatggccattctatttattaaagtccagaaagagaatttcaaacctcaggttgattcatggactgtttaaatatacataaacctatacaaagcatttatggtgctttggtacctcagtttctcccttttcagaaatagtaataaattaccacccatatttactttatggattttatatgtcaaaaatgttctgtgtaaagtaggtgtttaatctttattgttacttactgctcttttaccagttgttattagtatttctctacacttatagatgtggccggcacctgctggtacctaactctgcaagtatctgattcaattcattgaagaagatacaatgcagcaaagacttatggatgtctagtatatgccaggcatattattccactgagtagctgaggcccatgagggaggtgcctgtccttgaacagccctttcctaaaaatcatcatcatcccattgtagctgctcccagaatgatttgattgctccatatgaacaagtcctataacactagtaacaatgataccatgagagaccgagccccgatggcctaagtaaggacgagacctcaagtcctttgaccctggatgcattatttctactatatcatagttccctccttgtaagactgatgtaagaatcaaatgagattatgcaagttaagcatttaaagcatctggcatagagtaaggacaaagcattagctacctcagtactacaattagtattgttatcatcaccctctagggagacttccctgacttccttccatggtcacctcttttcctctgtcatcctatagtttttttttttttggggggggggtctaataccctcttttggcatttgaaagctcttatattgcttttcacttatatatgtctttatagggttgtaaacttcctaaaggaaagtggcttatgttattctctgtcctcttcaaatcagtgctcagaaaactttcctatacctcgtataggcacctaataaatatttactgatttaggggaatgtctggacctcttcatccccatctcctaaaaaaaaaaaaaaaaaaagaagtttgacatactgccctatttgtctaggtgtcttctaggtctatattatatgaatattctccttacaattcctgctagggtattttttttttctttatacctttttcccctctacacagtacagagcaactgattttgttgttcctgggcctggaaaagtagagataacctacacaccaagtgacggaacccaaaaggtgacatacctggtacataactttgaaggtatgtatgactgtagcataagcttcttttttttttaaacaaatgatttagataatatttttattgctttttttgttagttatgtgactgcctaaaaatataatctgaatctacagtgtttttgcaaaacccgaaacttgacataaagaagtaatttgcttccataccttcctgtggcatgaataaaggcacaaaagggttacccacttaattggaaatgcctttaggcaaagacaaggagatgattatgcatttatcttaaagcacagagagaaggttggcagaaatctgctgtgcatgaattatatacattaaatattaatattctcaaatcacccagcatataatcctgccctttgctctggtagggctcttgtatctggaagaggtttccttatatatttgctgaagttttcttcttgcccttctgggtatttatcctgtgaaaaagtagaacatttgctttttgccttttctttcccagctaccctgctacctttgatggcaaatcccacccaaaagttgttgaaataattagtgggcccttttccttcactattgaagttgttgaaagcactcacacaaacaaaaatacccaacactcacctaccttttgtttttcttgcctcttccaaataatatctgttggaatctggttctgcaggcttcagcacctttcaccctgaacccaagttaaccctgagcattggcatggattcaagttctatctttaagtaataacaaagttcaataatagttgtaaaacacagtgattacatgtagcataattatttctacttatttctaccaactacagtaggagtgctcagtatcctccaggagattataagaattttcattcagtatttgaaatttaagtttttctcaataactgaggattgagtacacccctaaagtttaaaatagatgttgggaattgtaaaggtagggtgtttgtccattcttgcgttgctataaagaaatacctgaggctgcgtaagttataaagaaaagaggtttaattggctcatggttctgcaggctgtacaagcctggctccaacacctgttcctggtgagggcctcaggaagcttccaatcttggcagaaggcaaacagacaataggtgtatcacatggcaagagcgggaacaagagaaagagaagggggaggtcccagactcttaaacaaccagatttcaagtgaattaactgagcgagaactcacgtaatcaccaaaggggatggtcctaagccattcataagggatccaaccccatgttccaatctcctcccactgggccccacctccaacactgggaatcacatttcaacatgagatttggaagggacaaatatccaaaccatatcagtatgtaaaagaagtttcaaaattatttgccttttcttaaatgtatttctggttcatatcagtttttggcatttctgcatcttcaggattttaaagactgtatgttttttcatttctgctgtccttccaaaacaagttagaatgtccttatctagaactggcttttctctcattatgtgcctcagaaatttgttggaaacctgtctgggacttctgaaatctagtctcagatgtgagagctgagaagtaggtcatttggttgtggtgggtgattttagccttattacaactacattacatttattcttctcccttttttcctctcactggcttctcctctacagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagtaactatagttcttttttaactttttctttattctcaagtaagctgacatttgcatatagagtatgtatctccctatccctatgattctgggtaaattgagtgaaaatcatcactgtctcttaaagataagggcaaaactgaggtttagcaggagtgaaacaaaaccactctgacttgcttttataagataaacatgttcttaaataaggtccccacatgaattgttttcagagccaggttctttaatgtttaaataaacgtacgctgttagtgataagttctaatttttcatgtgtgagtttctaagtcagacccatttccattctttctgaagcccattgttagaatttaaaattctgttggccaggcacggtggctcatgcctgtaatcccagcactttgggaggccgaggcgggcggatcacgaggtcaggagatcgagaccatcctggctaacacggtgaaaccctgactctactaaaaataccaaaaattagccgggcgtggtggcgggcgcctctagtcccagttactggggaggctgaggcaggagaatggcgtgaacccgggaggcggaggttgcagtgagccgaaatcacgccactgcactgcagcctgggcgacagagcgagactccgtctcaaaaaaaaaaaaagaaaagaaaagaaaaaaaagaatttaaaattctgttttagtggagtcatttgaacttaagtctaagtttataacaacactggcttccacagcacaggaggtgagcatgtgttaatatttaagattggcataactccctttaggtgcaagtgttcaggccaaaatgttcctgaggcattttgattcctcctcctgctgcccatctataccaagcccagaaactgtctggaatatattttagtttcctgaatgacaccaagaagtagaacagtcttttcaaaaatgtattttaaaaataagctgaatctcaagaatctgatctatagtataatgaaaactgaaaagtgaagtagtcattgggatactctactgtctcacttaattctcacggcttccctgcaaggtgggtaaaattgttcctacagatagtcaaattgagttttacagttagaaaatgattgggctaggatttgagccaatgtctgtcagattcctgagtttctgctacttctactaaaatatgctgcttcttgtgtgtccggtcttctgtttgggacaagcagatgatatccctaacaaaatcaattttctttattattattctcttttaccttttgtttcccaggcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaaggtacagaggtggagcctggcctgtaggaacagggtcattccagggtagttctctaatttgggaaggggagttttgtagtcctttgttgtaaaatcttggaatgttaaacctccaggtccaccgtcttacctgacagctaaggaaattaagctcagactagagaaatgatttactcaagaccacatgggaagtaaattagtggattgacactcctggctccagtgtcactccttgaagttttaaagcctacctgatctgaaaatcactccctttccctgccctccttgtcctttggtgaaaatgtaaaaaaccagggcactcaggcaaggagggataaagtgaggagcttgatcatgtcataaccaagctttggtgcctgcaaagctcatttattgggcagcaggacctactcatgtccctctgccagctgctgttctggtagaatataaaacaaatgtgtttggctgggcacagtggctcacgcctgtaatcctagcactttgagaggccaaggcagtggatcacttgaggccaggagttcaagaccagcctggccaacatagcaaaaccccatctctacttcaaaaaaaaaaaaaaaaaaaaattagccaggtgtggtcgcatgcctatagtccctggcactcaggaggctaaagcatgagaatttcttgagcctgggaagcggaggttgcagtgagctgagatcacgccactatactccagcctgggcaacagagcaagactcttgtctcaacaacaacaaagaaaaagtgtttttgtttactgcttagcttacacacaaatcaattgagcaaagaaccctaggggctgtttacagaaattccaggagaagtttcatgcatggggtaagggccaaatcaacagaaacacagcgcctggtttcctcagcaccaagttgcccttcagtttcagttgcccttggtagctgtatgaacttgaatctccccagatgaatgtttgttaactttaattatgtttgtttttcccaagaagtactactttttctgtctcttatcagtgttaaacatctcctctcagtttgaaaatcagtagatcaacctggttaaagataactttttgccagataaatgagttacacaactctccttaccatccttctgtttctctacatcctcacaatcatttgtactgaatgcaacagaggaaggagtgttattgctttgtgatgactccgtggttgattattaacttcacaggtgatgttgggaggtagcaaaaatggagaaaagaagaaaatcaattatatagatataagagttgtaatgtggttctttcaataagaaaccacagaagagaactgttgtactgagggtatgaaagagagcgaggaagggcaactgggatgttcttagatccaaccgatcctgtgtttacctgccttctcttcccagtcccagcaagtgtatgagcagcttgagggttcttaagagacagctctcgtccatctttatttccccagaacagcagagcattgcacataagaataacaataatagattgagctctgtgtccagtactattctaaggaatataaatatatattcatatatatttatgaatatatgtatatttatctaatcccacagcaacctagtgaagtaggtgctgttattactcccattttacagataagaaaactgagccgcagtagctatgaagtcatagaactagagtggaatgtaggcagttggaccctgaaccctccatcaaggagtaggtatccctgaaataagtgaggggaaaatgcagcctttccagacccattggctctgatatctggagcggggatcctgccttctgaaaggcagaattattggtgattccatgtgctcttgtttactttgcttaccaagacctatcaagattgagtcatttatgctctcatctctgagagactcagtgctcttcatgcagttggacccaacgcttcatgctccactacttacagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattggtaagatggtgtttacattgatttctcaccagagagtgctctccaaagcagcccagatgtgttcccttggctgctcagtgttttgtgtgcaaagtcatcaccaagtagctgatttgttctactagtaagatctatttgaatatgcttcttaaaatatacaatatttgcttttctgttttgtgggagaacataggttacagagaggaatgttatcaacaagcattttcctttacctctggtgcagtgaaatgtcacataaggctacaaatctaaaagtcacatggatagatccttttaacaagtttcaaagatagcacttcaaaaagagattacagcctggaaaaaggagaccaatatagacaagagatagaagagattgtgacctttttcaaattagaaaatgccttaagtttcaaacactagtaccatgccatgaaaatgtgtttttttaaagtttctgtttggtaaaatatttctaactctcctaaaacttctagcccatgtggttagtatctaaagaagtctgtcacctaaacaaaaaactattctgttttggggaactatgagacatttggaaacctctataactaggatgattggagtgttgtgttttttttcccctcttttagcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaagtaagtataagatgccctagtttctatggtcaaattaacacttatcctcactgggctcagagcatcggtgctttctggaattatataaattgttattcatcatctagttcaggagtcagcagatatctgtaaattgtcagatagtgaacattttaggctttgtggaacatatagtctttttgcaactacacaactattcaactttgcctctgccattgtagcaggaaagcagtcatagacaatacagaatcaaatggtgtggctggtaccaatcaaacttttatgttcaaaaccagcctcgatttggttcatgtgctgggctgtaatttgctgacatcccatctagttgataatcattgaacgaaaaggttctatttaattttaagaagcagattatagacaaatagaaacaaagatacttcagaggctattttattctactcctttattttctttaacttactgatgagaaaagtgagcagcacaagtttaaggtgtgcaattgattacagtcccttaagtatctgtaaccaatatttgggcaaatatttgacagcccatatgtttactgagaatttttctgagaacatagtagccagtatcctggggggattgtctccatatctcaaccagtgcatctgcagaggtcccaggtagggtcagtataccccataatggggatatacttggtcactgcatgtttcttaatttaaatttccaacaagattgcagtgttcgctgggtgctgtggctcatgcctgtaatcctagcactttgggaggccgaggtgggtggatcacgaggtcaggagatcaagaccatcctggctaacacagtgaaaccccatctccactaaaaatacaaaaaattaaccaggcgtggtggcgggcacctgtagtcccagctactcgggaggctgaggcaggagaatggcgtgaacctgggaggcggagcttgcagtgagccgagatggtgccactgcactccagcctgcgtgacagagcgagactccatctcaaaaaaaaaaaaaagattgcagtgttcaaaatggtcttatcagtggaatacctttgtagcctatttaacaggcacctgtcagcaggattatgttatcctgtcttttgtttttctttttttttctttttattgagacagagtctcgctttgcccaggctggagtgcagtggcgtgatcttcgctcactgcaacctccgcctcctgggttcaagtgattcttctgcctcagcctcccaagtagctgggacttgtgccacaacacccggctaatttttttttttttttttttgtatttttagtagagacggggtttcactttgttagccaggatggtctccatctcctgacctcatgatccacccgccttggccccccaaagtgctgggattataggcgtgagccaccaggcccggcctgtcttttgtttttcttaagacactgatagaaataacaacattataactttttttaaggacatgtaacggtttgtgggaaggtgggtaaaggtttggctatgccctgaataagttttgttatgtttaagaatgaggaagaagtgtgatgattttggtctcagcagcattagtctgaaccgaaactcaatgataatttcacccccaaagctacatagcaagaaacctaactgagtatgtatggctgtctctactgccggttgcctagagagcctgagtactgagcctgggtcagccccaggaaccctgaacatagtcattgtctatagattttgtagcttactaacatgaatgcgttttcttccagaaacaaatagaatactattttaagtagcatttctaggactttaccactacctgctaccatatcagagaccaactaaattttcttttttttttccttcccgttagtgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtaggagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattacc

SEQ ID NO: 35807 - DNA, 115865 bp, Homo sapiens
gaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccggtgagtgcggcccgtagccagcgcctggagggaggagccgccgccgcgccggcttttagctgagtcagggccggtgactgggcgcctcccggcggaacgccggcctgggcagcttcttgctgcccagggcccacccccgggccggggggctgggagtctgatcaggtcactgcgtgcttctctggcttgagggaatcgagccgggtcgaccgcctcggcatccctccccaatcacaccccagcgccaggacccgaggggcttcctgggccttcccctgaccccagaagggcttaccttttttctgtgcctcccattcttggccgtgtgaggtcgtccagccccagttcttgcccgcagggggccggggtgggatgggcccctgtgccattgaacagtaaggcaaacccccctgatcgggcagcctaactgctacagaagtgtttctggacgtggccgagctccattcgccttagaatgaaacccgaaattaggtttgaggtgggtcatttctgggtccgatccaagggtgttcattcaaaacacccagagaacttttgggttcggcgaagaccctaaagacgccctggagatacctttatactgagagcctacttataccctttcgaggttatgtgctcagtctgttgactgtacattcaagaaagaatggatggatctgcggagcaggtttcatacgcgcaaaccattgcataggtagattcacgtagtgacatttgcaatggagtaagttacagagatcaagtttcaattggagacttaagctccccgttacagattgacttgcatatagctgtccagagccttggtgcttttttccgttgcctatttacatacccttttctcattttcttactctgtgtttgacccacaaagaaagcattttattgtaaacaaactggtgagcagaagacagtaatctgaatggtaaggcgatcaaaactttatttttatgaggattggttaaggagatcgttggagatactgggagacgtagttactttcaaacatttgaagagctgtcacttgtacctgaaataagactttttgtccccaagagatacaagtgatcgcgagatgaattttagttcagtatcaggaagtttttccagtcagagctttgtaaagatcaaataaacactcagtttcttgccacctataggcctcattctatttcaaatccatccattaccaatgtttcttctaactcggcccaaaccaccttcatctcttgtctgggttactatatcagccttaaggctttgttttcgaccattacctccgtacagcccgtttttcttgtggactatgctttttaaaactttaatcacataatacttctttgcttacaatccaccagtgcttacattgtgtttagagcagccgtgtccaaccctttgaattcgaggactttttttcttactgtggtggtcggacatcgtgaaaattatatacaaacctttttttttttttttaagctcattagctatcattagtgttagtgtattttatgtatgccccaagatacttcttccattgtggcccaggggagccaaaaggttggacacccctggcatacagtaaaatccagactcttaaccaaggacccacatgatctgattcccgccttgtcttgtagtactgtcttcactcaatacatcctaatcacactggactttttgttccttggatatgtcagtttctctcctatctcggggccctggcacattctgttcctttctagtcttctcttcctcagattttcccttagcttctcaatcttttgtctcaactcaaatgttatccttccctgatcattctattaaaacacgcttactctccctccaccacagctctgtaattgccttgtttgtttacttgcctgatcactgtctctctctctctctctggtagaattttgagcaggaagcttgttttcacaattctagaatactgctgagagcatggcagaaattcaaaagtatgtcttgactgaagagctcagtcagccagtcaaagcaattaatcagtcccttgagtttttaaagtagaggcggaaaaagcacttggtgacaatataatagactttaagcctctttaaggtggcaaaactaataatttttgaggtcctatcctgagattctgtgatgatcatatagtgtatatttattactgccatttaagtttattggattacttgtcaacttctgttccaaatcttttgtcactttgttttctgtcctatggctcatgttggcttagaatttgtcccaggtgctaaacaggctagtctcatggttctggtgtggattagtcagtttgttcattcatttattgaccaggcagttgctaggcatcaccatacagtggtgaataagaggtcaacatgttctattagttttttccaagaggtttgactatgcaggggaatggagagagagagagaggtgcttccaggcgggagatgtgaaattgagtgggttggtgttttcttttttaaacataatacagacacataaaggaaagttgtgctaaaaagctttaaaacaatagtcccccacctcactttccctttcctgatccccagaggcaggtattcccaacttttaagctgtgtcttctggaacatacctccgtatttgtaaataaatatccaaatatttctgtcaattgattcaacagttttagaccaatatctgctcagttcctataacggcataagaggcttttagcatccttaggcctttcccattctctcccctctccagaagagagttctgttttgtttttaagatgggaaatactaatgtatggagtgtagagtatttgatttagttctggtccatggccagaggctgagtttccaagccaggacaaccatgtaaccagttagtcataagtgaaaccaaaccagagaatataaaaatccatctccctttttggtaaaagccgttcaaatacattgactgaggataggtagcagttttagtattaagtgttctgttatttaagatctgttctacatttaaagcattctggcctgtcatcttactccacatcactagtttgcaattttttctttttcactgattgaattttgaaatttatctgttccctgtgctgtccattcagaatctctgttctggacttgtcataccaacctagagtaccaagaggttctttatatctgcttttatgctactttagttttgcttggtaaattttgtatcttttcctgtgtggcttcctaaagattgcttaagctatttggcaaacctatacttgtcaattagaaatggctacatctaactaagttgccttgacactttttaatcaaaccacagtttcaactcggtgttctggaatgattttaaaacccacatggaaagcatttgagagtggtttcctttgtggtcttagtacaataatttcccatatcatttttccaataatccctttgacctttgactatatttcaaggtgtgttcttttggagaggacaattattccttttactctcctatgttagtggtaataccttgaggctaagagaagccatatggagaacactgtgcttgggtaattgaattcagaatgagtatgattgttcatcatttggtaaaacccaggttacttgtgataggaaagaggtgccataatatacacaccttgaaataattgaagtattttaccttgttgatttgatgactaaatgctcccatttttgtaaataatcttataactgttgatttattttgtatgaataattttattctaaaattgtataggaaagtttcccattttaatcagtaaattaggccaatggttctcaaactatagagagcaaaagaatcacagtactgggccccatcctcataatttgtgattcagtaggtctggaatggggccgagaatgtgtatttctaacaggttcccaggcaatgctgttagtccagggaacacactgaaaaccattgaattaggcaaatgatgtaatatatgtggtgccatgagggtttgataatatagttaagtcttaaacttgagatataaacctttacactttcaaagaaaaataatcattcccctggagaagttacgcctcaaaaaaattgtttttcagccatcatgtatttttgaccaggtgttaatttccactttagtgagaatgtgtttcataatcatgttacatcttttttctcatagctggaattatttctcttctggatgaagatgaaccacagcttaaggtatgaattgaagaataagtaactaggcttagtgtgaatactgtgaagccttttgaatttagtgatatctgtaatcttccatcatttaaagttgctgtcctagctggcttgtacccagttactgtaacctagccagagaggacagtattttggccacagcagttggtttcccttgagtttaacaaagctaagacaaataaacctcgttacgacacttgaatagccccctaatttctttcttttttttctttttttaatcttttttcttttttgagacagagtctcgctttatcacccaggctagagtgcagtgtgtggtcatggttcactgcagccttgacctcctacactcaaatgatcctcccacctcagcctcccaagtagctaggactgtaggcatgcaccaccacactcagctaatttttaaattttttgttgtgatggggtctcactgtgttgtccaggttgatctcaaactcctgctcctgggctcaagtgatccccccgccttgacctcccaaagtactgggattacgggtctgagccaccacaccttccgcttcccccgccccagtttcattatcaacagaaaacacaaaaagttgttgcttctgtttcacatatttaaagttttttatttgatgaaaatttggaatgtccttctggtggctctagatacttgattcctttacatctaaaccagcaacctggagttaattgtttatattcaaagaagaaaaatgttgatgattgaaaacagaaaagaaatgtgtaaactcaagaaaaagtgtaagttggtaaatttttatatttgtcatagagtaaaagtttgagtaaatattactgaggatttgatcattgatttgctgaaaagaattttttaaggaagtgtaatgataagtctatctcaaaataggattttggttatcttttacaggaatttgcactacacaaattgaatgcagttgttaatgacttctgggcagaaatttccgagtccgtagacaaaatgtaagaaattatttttataaatcagaataagatggatcaaatttaattgtgaatgtgggtcttgtggcttattgattcatttagaaatttgctgttaactgaattgtggcttgaatatttagatttgggatttttagggaaaaccacagtttgaactagacctgtacttcctaatttctttcagagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattataggtaattatcgtctatctggtaaggctttatcttgtcggcttctttcttgctgtagtgcacatagaagcttttttcctgaatttgatgttgccaaatttcattttaattggaagttcctaatctttctataataattttatgcaggctgagtttttagatctgcccttcaactgagtgctggttctcagtggttatgatgatcaccagtccagtgagcctactgttagaggaaaagattaaatcagattagtatgagtaacaagtggtaccagtttgtgtagttttttcgaatacaggaaaccattatttagtatctgcattgtgctaggcaccgtgctagtcactctgcataccatggtttattccacagctaccccatgaggaaggagctagccgttttacagatgagacaacttggattttgagatgataaagacatggttattaaatagaaggataaaatttaaaacctggttttactcactctaaaacccatactgtttctatttgtaaccgttgttttcttacttgtttccttatttttgaaggaaggggataacacacaggcaaggctttgaattttctgacacatatttcaaccagagttgtaaattcaactagttatgtaagatttgatacaaagattttatagtgtaaaaaaatgcttgaaaactgttgatgtagtaaatgaaagaagggactgcatacccttcagacatgtgtttatcagactttggattcatagtacagagagctcaagggcatgttctgtcaggagtgtgcagtgcagatatttcacattgctgattagtagaaggtctgtattattcacttgaacacttacaaggaggaagttggtattctcttttagaaattgggaagtcctgcacaagggggttgatagaggtaccatcaactgtccttgggattctgtgttcatgtttttaaagtttttgctatgatgatgtgaaaattttgcaagttactttattgctgttggaggctcattgaattgagctgtcatctgtgaatccagtgggaagaactgatggcttaaaaggatggaccgtattatttgaaactagactactttcttcactttaagctagaagcagggggtgaaataccttacttatctcttttatttgatggatttttttttttttgaaaacagggcaggatctcactgtgttgaccagggtggtctcaaactcctggcctcaagcagttctcctgctttggcctcccaaagtgttggaattaacaggcgtgagccaccacagccagccttttttttttctttaatgaaggtttatggttttttacaacagtgatctacaaatgcttaaaatgccaccattgtacaaattgtgcttttaaactggactgttggtatgaagtgctatggcatggtagatgccttctaaacactgtatcattttacctttggaaggtgagttttgatcagtagaccagttctgtttgcatttatttatttaaaagtggggttcacccttcctctagttttgtagggcacattttttaagatgtcagtgagattcatgagggggtatacaaaacagaatttgggtaaggcttcctagcgtcttaatgaatatcgtaaacagtacctccagaaaatccaggactcataaatctccaagttatgacaaggctttagcaggaaatgaggctgagttttagttataacataaacctgggatatatttatgacatatatgcaaacctggtgaatgagaacatgaatctcatttgaaacctgggacatacatttttccccttcagttatataatctaaggaaaattccccaaatgttctaattttgaggttcctctctgatggggtaggggtaatgtttcctcacttagctacagttggttcaaaaagctcacattagggcctggtggacattttcaacaactggaattctttaaggtctattttgcattataacatccactgtgtttttttgtttgtctgtttgttttttggcagtttttctctgttgcccgggctggagtgcaatggcacgatcttggctcgctgcaacctccacctccctggttcaagtgattctcgtgcctcagcctcccaagtagctgggatgacaggtgcacactaccacacctggctaatttttgtgttgtagaaatggggttttgccatgttggccaggctggtcttaaactcctggcctcaagtgatccacttgcctcggcttcccaagattttgggattacagatgtgagccactgacccaacccactatgttcttattaactgtacctgaaccttcatggttccagctgaatcttgaatgtagtatattccaatttataaaagtcctctgcttccttcaagatatagacccatttaacccgggtcatctagtaggccaacaatcatttatgctagttaaaattatttttatttcttggggctatggtttgtaactaataaatcttgccctcgtcttcttacttatctttgaaagggaaagaaacaagccaatgaattatggagaggataattaatgtatatgtcattcctcttgggtgactgggttttttgtttttttgttttttttgtttttttgtttttttgttttttgttttgagacagtctcgctctgtctcccaggctggagtgcagtggcgcgatctcggctcactggaacctccacctcccgggttcacgccattctcctgcctcagcctcccgagtagctgggactacaggcgcccgccaccacacccggctaatttttttttttttgtatttttagtagagacggggtttcaccgtgttagccaggatgatctcgatctcctgacctcgtgatccacccgcctcggcctcccaaagtgctgggattacaggcgtgggccaccgcgcccggccagggtgactgttttatcttccttatgaaggtggaaggcttagggaaatgtccttcttttggttgtacttagaaagtttaaggtgtgattgcaaagatataactaaattgcaaacaaatgtttcttatcaggtgtgctattgatatccttcagtatgtcacaccctcccctccatgcacccaaatcattgtgaaatatggaagctaaattgggcacaaacacttttgcatgaattttcagacaccttcttgggagaaataggttccacctacctcacattgagacaataaatagagtcaggaatcacataatgacagactgcatagacaacagatgtcccataagagtacaataccatatttttactgtaccttttctgtgtttagacacaaatgctattgcctatagtattcaatacactaatatgctatacaggtttgcagcctagaagcactaggccataccatagagcctaggtatgtagtaggttatataacatctaggtttgtgtaagttcactccatgatgtttgcacaatgatgaaatcacctaaagatgtgttttccagaatgtattactgtcattaagcgacacaggactgtttttcaaaggatctgctacagttgctggaaaagtttttggaaatctttggaactgccttttaaacttgtggcacatttcaagtcatttccccattaccctacagagacaatttagacatagttcttactctcaggttgctaatagtttcattaatgcaaagaagtccgatatactactatgtgataattgctataataggccttttaaaatatcttcagtaatggcaaatgtttgttttttgaaagtgaagcagcagctatttgtagccagttcttttgaataagcagcttaatcgggtagagtaataaaattttgatcaaaatggagtaacaagatagaaactttaaaaataaattaaataagagacagggtcccattgtggtgctcaggctggcgttgaactcctgggctcatgtgatcctcctgcctcagcctgccgagtagctgggactgtgggtgagcactaccacacctggcagatagaaatgttttgaataatgtcaactggattggaattaatgtgtagttctccggtgtaaatattatgggagaacagtattcaaatgcataagttctagcatttcaaaatttgcttattgctttatagtcatcccataagtatatatgattataaatataggcattgccctttctgatagtttagcccaatttacaagataatcagttattttatttcctcaacagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcggtaggtagatgatgttattttagaaattattgttgatagggaatcagcaaagcaagttattcaaactgaaactttcataggcagtgaaaagaaaatctagtttagaaatagcaggtgatcttttgccaaatattttattttcatatttatgtatgaaccttggttgtgttttgtgttcatgaaatatctgcttttatcttaccacataatcctttgaagtcttgcatggggaagttgtattaattactctgccctttttaagaagacaataaactatattttaatgcatttattagggttaaaactactcagctagattcctggtttgcggtgtttgcaataattaagacaatttaagtcaccaaccgaagtggtcagaaaggtacaaagctgagtaaaatggacattgatctgcaggcttactttgcctcaccagctatttctttccatgagctagctctctgtacactagccattttggtatcttctcatctagatgaaccctgcctcgttcccccttccaaaaatattttttacatttcttttttctttcttttttttttgagatggagtctcgctctgtcaaccaggctggagtgcggtggcgcaatcttggctcactgaaacctctgcctccggggttcaagcaatcctcccatctcagcttcctgaatagctgggattacaggcgtgtgccaccacacccagctaatttttgtatttttagtagagttggggtttcatcatgttgaccaagctggtctcaaactcctgacctcaagtgatccacccgtctcagccgcccaaagtgctgggattataggcatgagccaccacacctgccctccattcctttctttgcctgctttatttctcctcacaatccaaaacttagctcaactatcccttgtttgcagaactttgatcccaatacccatgccttcctcagcccctaagcaaagactaggtccagttctgttgttaatcttatggagccctgtacattttttcatggtgtttatcccttgataattgtattagtagatagttaatagctgtctttcccactagatcataagctatatcgggacaggtatttgtgcctttttcaccactgtatccccaaaacctaacacagtgtttagcgtcgataatacgatttgtttaaatgagtgaatgaatgaatggcctaatgtgatataatggcccttgtttccctctcaatttcatttttgtgcagttttagcccatccttgtcttcgtgtgtgtaagattacatttttggctttcatttattcaacaaatattttttcagtgcttactgtttgccagatactgttctaggcattggagatgtgcattgtccccattcatccatggttttgctctctgtggtttcagttacctgcagtcaactacagactgaaaatattaaatagaaaattccggaaataaacaattcatgtcttaaattgtgcaccattctgactagcacaacgaaatctctcaccatctctttccatcccgcatgggatgtgaatcatcctagtagatctatgctgtgtacactgcctattagtcactttagtggccaccttgcttatcagattgactgtcgcaatatcacagtgcttgtgttcagataacccttattctactcagtaatggcctcaaagtacaaaaatagtgatgttggcaatttagatatgctaaagagaagccttaaactgcttcctttaattgaaaaagtgaaaattcccaacttaataaggaaagaaaaaaaattgtgctgaggctgcgctgagatgtacataagaatgaatcttccatccataaaattgtgaagaagaaaacagaaatttgtgcataatttatatagagtttggtactgtttgtggtttcaggcatctgctgggggtgctggaacatagtcctctcagataaaggagcacctactatagtagcaaacaagaccaacaaagttcctgcccaaagcaaacacttcattggggaatctagaaggagaacaagcagtcaaacaaataaatatataaagtaaaagaatgaaaaatgttttaaaaaaaaaaaagcagagtaacaaatgcatctttctttgtatcccagtgcacatatacatatagatgtaatttaagctttatgaaactaatacctactcttactacttgtgatataactctgttatttttaaattgtattttttatttttttaatttgctagtcacacttcattaaattgattttattacgcagtggaaagtcacaactcactttttgagaaacactcctgtagctttcagtgtgctaatttatgttgaaggccttttacagggtgaagtctcaaatattggggatacttttgagaatcaccaagtaaacacatagagcctggatcaaagttttcttgtagggagagcaccagacagatgtggcagtactcaatgcttgagtcactgagagctgtgttgtgtttcctggccagcaagtgagtgtaggcagtaagtcatgagggagtctagtagcaagataagaagcagaaagacttcagcagacacatttggaaaacatagctacttagtgtatggacagttgtatatcttttataataattaacagcatcactttattatagtatactatgttcatgtaatagtgattctgagtaccactaaatattatttttaatccattttttatgatgatgtggaaatatgtaattcttttaagattttcatctaaaatggtttaaaattcttgagtttgtattgcttaagaggtctaaataattggcttcctagattggctaaagaagcaagattaaaataattcaatttctaaataaatataatgctgcaataaccagataacgttatatctttaaactatctctttcagaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcaggtaatgacattaaattatgtttcattacattgctccacgctgtactgtgctatgctataccacttcacattttattactttatattactataatggctttatacatgtatctcagctgatcttcacagcagccctgtgaaaataaggtatgtgctttatattcctttttattaataagaaactaaatctcacaacactaaaaagctattttgttgtaacacattctttctttgtattcttttttcattttgaaaatccaataatttaaggaaatttttagaaataacgaaggttttttaaaaagctagaagattaaaacagtgcctatgctatactatatcattctaaagagaattcaaagtgtataaattatatatggtttcattacccatacacaccaaaacatttgggtatcttttctttatctctttctatatataaatttgcttgcacataaaaaaaaattcagatggtacagaaaatatataaaatgaaaagtaaggcttctctttcccatcatttgggctttttcccaaaggtaagacatagatgtttttccctacttattcacacatgtggatctactgcattcttttaatgactgtattgtattttattgactggaggtgtgcatgggtttactttttaacaattgctatgttgtatacattttttgtattctgctcagggcatagcattttattgcacattttattgtttcttcattaaaatgtgctcctgtgtattttaatcctctagactttgaaaatttagattaaaacactgttttttacaatcccttttaaagcaagtttgaaacaaaatactagaagaaaaaatatccatgtttaaatcacccaaagtcaacttactattctaacttgattttttacatcacccaaagtcaatttagtatttaatagtgtatttcctttcagttttctctacataggttttcggagttttgttgtttgtaaatatttttcatagttttttttaaaactgacatgaaaaatagtagttccctgccctcttcctgtctgtatttcagttttattccttagaggcaattttatttctttcagctgttttattccttatctttttattatttttaaaaactttattgctcatttttaaaataatatatttttgagcagataatatgttcatgtgatttaaaattcaaaaagaatgatggggtatacaatgaagtcttcctattacttggctccagctaccaagttcttttctctgtggataaacagtgttaattgtatacagtctttaacatttttccatgttctaattcttcatagagtcctcttacttgattgttgtaatcattcagtgtatgtactttgccctacttaatcattcccctattgttgaccacttattttgtttgtgttatttcgtgttcttaatttataataactttgattaatgtgtttattttgaagttgagttacttgctgcctaagggaacaagaaaatttaaattgagtttttaaaagaaaaattctaactttgttggataattttgttaaaacaatggcagatcataagagtagtaagagaaatgcttcaaaatggtaattttaatgtctcttgtcctggcccaacacaacacaatgtatgttaaatgaatgagtaacttccataatatatggtaagggagaaaataacaaattaaggagcacttaggtataacttatggataagatttaaagaagccaagattcattcaacaaccaatgttgaatactgctgattaccaggcacagcattaagagttataaatataatttgtatgaatttttttatggaagacagatgccatgtttagaaaaatttcatctagtgctgggtttagaaatagagtgctagactggatagtctgccctagtttgcctgtgcttatattttaaggttttctataatgttgattttgtctccttaagtaccttgtagatgaagtttttaattattgaataattgttctttatctccatttcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacaggtataagtacctttttctgcatcaaaactaattgaataatctttatttcattttggggacaggtagaatatttataggaagcatattctaagaataaattttgccactagctttcatagattgtaaagtcttattaggctgttgctctgttttgtactgtgctgggtgtagtaaggaaaaccgaagaaattgacccttctggaaagaaatagaagtgattatctcgtagggagggcctaccagacaacatgtgtactatttaatcaagtaaatttaaaaaaacaggtggggataggttggggctaccttttagatatttgggttagatatatctgggttagatatttagaaagtaaagaacattctcagctttttatgcttttattagaactaaatacacaaatttctatagtattagaaatttgcattctgtacaaattgatatggtattaaaattttatttttctgtattttacacgtttagatcacttactaaaaacatttgtgtgtcttagttgtgcctgtatatgccggcagccccctagcccgctctttcactggatatctgtgtctgagaaatgtgggactctctctttcacttaagcactcagaggccattgtagggttattaattggcctaatttcaatattgttgtgtctcagggaatagggagtcccaaggagaaggagagagatgggggaatgaccggtgtgtggagcagtcagaacacacacatttattgattgagtttgctgttttatatgggtgtggttcgtggtgtcccaaaacaactacaatggtaacatcaaagatcactgatgacagattaccataacagatataacgataattaaaaagttttaaatattgcaaggataactaaaatgtaacacaaggacaaagtgatcacatactattggagaagtggctccaatagacttccttgaagggcagtaaaacaaaggtatgcctatatttttctttatatcactacctctttccttattactaaaactatgctaagtcttgcagtcaggtattgtaagacctacaattttgattcttttttctttttcaagattctttgggctattgtagattttttgcattatataagtctgtgggtgttctgattgggattgtattgaatatcttcaatttggggcacattgaaatcccgataatattgaatcttgtaatccaggaatatggtgatctttttcatttacttaggttttttatttttttctcagtagtgttttgtagattcagtgcagaggttttacacatcttttcttaaattaatgttcttatatccctaagtataatttgttttttgatgctgttgtgaagtggtatttttaaatttctattttttttgttggtagtatatagaaatataattgatttttatatactaacattgaatcctatgaccttgataaaatcatttatagctttataaatgatttttttaagtaaattttttaaagtagatccttttacagaattctgtttattggcatcttggtcatctgcagttagagagcattttactccttcttttgtaatctttataccttttccctctcttttttttctatattggctagaattcccaatacttacagaagtgataagaggcagtgaaaaaaatctttaatttttttcaatcttagggggatagaattttttatttattttcgagacagagtctcagtcttgtcacctagtctgtagtacagtggcacgatctcagctcactgcatcctccaccttcctgggttcaagcaattctcctgcctcagcctcctgagtagctggggctacaggcgcaggctatcatgcccggctaatttttatattgttagtagagacggagtttcaccatattggccaggctggtctcgaactcctgacctcaggtgatccgcttgcctcagcctcccaaacttctgggattacgggtgtgagccaccatacccggcctatttatttatttttgatttaacaagttttctttcttcttgccttctccttttcttaaggcttatgtgtggtggttacaagttccttctgagttaatcttcatttctgaaattattattttttctcttttatttctgattttctctagttctatcatgttaatttctgagtttttgtacttctaatatgtaatagtcttgtatattttatgtaattttcctaatttctcttgttttgaaataacttttttctaatattttatgagattttactttgatgcttttctgtagcttatttttactgaaattagtttttctaaacttttccaaaggaggcttgtttaggatagtttttccaattttactgccctccagtatttcctcttctgttgcatttatgtagtactatacaaaataatggcttttgttttgggatctcctgactctgtttcctttctccattgcccaggctagggtgcagtggtgcgatcatagctcactgcaacctcaaactcctaggctcaagcaatcttcccacttcagcctccggagtagctgggactacaggcacgcaccactatacctagttcattatttaaatttttttgtggagacaagggtctcattttgttgcccaggcttattggtaccttctttatctttgtccctgcctttttaatttggattctctgcccagcactttttcctcaatatggtgctttgacctacaagggactgttggctgattagatttaagagtagttggggtcccagccccttcttttcaagcccattttgtagctggtggtgattttgctttacctgactgtgttttgtgaatgaaggagatattttgtcgcctgttcttgttgtatttgttgtccatggttttgctaacctagttgctttgtttttattatttggaggaaatttaataactggattgcctccatcttagagatgtgtagaattttttatttcttaatggtaatactttagtaaacattattttcttgcaaaatattcaatttggacatggttcagatctgtggtataaacaaattgtacttctcttcagaaaaaattattggttcttttcatttcagtgactcgatggaaacagaagaaaagacaagcagtgcatttgtaggaaagacaccagaagccgtgagtgtgctttttttttttcctttgagacagggtcctgatctgtcacccaggctagaacgcagtggcgcggtctcggctcactacaacctctgcctcccaggctcaagctttcctcccaccttagcctcccaagtaaatggctgggattgcaggcatgtaccaccacgcctggctaagttttgtattttttgtagagacagggttcgctgtgttgcccaggctggtcatgaactcctgagctcaagcaatccgtttgccttggcctcccagagtgctgggattacaggcatgagccaccgagccaagccaccatgcccagcgagtgtgctttttgaagttgagattgttacttaataaatatttccacaggatattgtaaattctttcaagtatatattctatacatgcttttattaaagtttactgttaagtttgataccaaagtcattttataaaaatgaattttctgtaaagattaaagttttaaaaattgatccgaagaaaacatttagaagaaatcaaatccttagatccttacttcaggcagaagttatttctgtctgaaataacttcaaattacctatcacagggtgaaaaaaaggtatggtctctagcaaatggcaacatatatgggagggaggctaattgtttttgttgtttttaatgtttgcagcgtattggaagggtagggtaaatattacaacagtggtctgttggacttttggttcctgatgctcaggtgtgtaaacttcagctgttcttcacctggttggaaagttgtgttggtggcatggtagtttataagatcaaggctgggcactgtggttcatgcatgtaatcccagcactttgggaggccaaggtgggtggatcacctgaggtcaggagttcgaaactagcctggccaacatggcaaaaccccgtctctactaaaaatacaaaaattagctgagcgtggtggcacacgcctttaatcccaggtactcgggagaattgcttgagcttgggaagtggaggttgcagtgagccaagattgcaccactgcaccccagctggggcaacagagagaaactctgcctcaaaaaaaaaaaatcatatatatatgttgattaaaggtattttcagttttctcagtttcaagtaggaagtttctcaattaaaatataaattgactcatttaataaaaagtaattttcctgcgtgttatcagtaattattctttcccagtttttaaaaaatatttaaatattttacatcgaaagctagctggggatgaattgtattcttccatcaagctagtatcatatctcagtagcatctaataaagaaagaaataaattatcctttctcttaaaatggactgaatttcactggtttaggactgatgaaataaaattgggttactggattatagtaatactgtttatgagttttcattttttttttgtttgttttggcagagtccagagcctaaggaccagactttgaaaatgattaaaattttaagtggtgaaatggctattgagttacatctgcagttcttaatacgaaacaataatacagacctcatgattctaaaaaacacaaaggtaagaaattcatcaataatagaggattttaaaaaatatttagttctttgttgcatataagtaattatatttatttcttgttggatactttctttattttatttccaattaaggaaaaagtatttaagttttgaaaaaatagcaatcaattatcctcttggagttgttggaaaggaagaaaatgagcaatgattgagctcttgtttttatgcttatctcttattggggagcttagttaactcatttttcatttttaatgtatacatggagcagttagacaaatagcacaatcagaatattaagataggctcttgagccgcttgcttcagcctgctccaaactctgtggagtgtactttcatttcaataaatctgtgtttttcttttattacaaaaaaaaaagaatataggttttgtgtctgtatttcccattgaactatgatctccttgagagcagcgattcttaccttgttgcagtgtttgttgagatattgctcttaacagttattaatactgattttaattttttagcaagtaatatatttgattcaaaatattttaatataaaaagatatataacatgaaaaatcttccttctcgctctcttatttatccagtaccccttcgcaaagtcatttttttatagccatatattattgaatgattaaacagttgtttgattaaagcatgtgtaataatgctctttgaaacttttaatacaatttttgcaaatggcaaaaaatatggagaatcatatagtctccattcatgacaatttaaagctagtctttgtaatatagtctcattaaaaataaacaaaatttgaccaggcacgatggcttacgcctataatcccagcactctgggaggccgaggcaggcggatcacctgaggtcaggagttcaagaccagcttggccaacatggtgaaaccccgtctctacttaaaatacaaaaattagccgggcatggtggtacatacctgtaatcccagctactcgcgagactgaggcaggagaatcgcttgaacccaggaggtggaggctgcagtgagccgagatcgtaccactgcactccagcctgggcaaccaagcaacactctgtctcaaaaaccaaaaataaacaaaattatctggtaactgtcagaggtgcagcactgctcctcaggttatctcaacaccttggagaccttgggcaagatggagaagagaaaaagcaagtttaattaaaccaaagaatagaaaatctgctgtccaaattccccacttaaaatctgttgttgagctctgttaaaactgcaaataaaactttgacttgcttgtttgtataaactagctatttagtctttataaaagaaatacccaagatccatattttaaatctcagttcagtttgttcatgcttttaccacaaaataggacctctgactgtgtgtgtgagggtgtgcatatatgaatactttgccagtgatgaaacaattctgtatttgttgttgcaggatgcagtacggaattctgtatgtcatactgcaaccgttatagcaaactcttttatgcactgtgggacaaccagtgaccagtttcttaggtaaatatgcttgttgattttcactttggttcaaaatctttttcttttttttttttttttttttttttgtgcagtcttactctgtggcccaggccggagggcagtgatgcgatctcggctcactgcaacttccatctcctgggttcaggcgattctcctgcctcagcctcccaagtagctgggattacaggcgcacgccactatgcctggctaatttttatatttttagtagagacaggcttttgccatgttggccaggctggtcttgaactcctgacttcaggtgatctgcccacctcggcctcccaaagtgccaggattacagacgtgagccaccgcacccggcctaaaatcctttttaacagacactgtgttaacattgttgtagagatgttgaggactttccttgttaaccagtccttaattctaaattatatttttgctattttatgtattttttgttgtgtatttctacttgttttaaggtaaaattaattccttttattacttggcttgattataggctcttgaaggaaatatattaagctctaaaattttatataattttgtttttatttatagtagaattacgtatcgtgcattttaaaaatccttaaaatactaagaacaacttaagagttaaaatagaatcagtagtaacttgagatccacaaagtaatttggaagggttcaaggtaaaattttaatgcttttaaccttagagttaaaaagctttaaggaattcatttgttttaacactaattaaaatacatcatctttttttacagagataatttggaatggttagccagagccactaactgggcaaaatttactgctacagccagtttgggtgtaattcataaggtaatatatattggtcagtgtatacaggcatcagaaaagaagtaatttttctggggttaagaaaaaataacagtttattataattcattaacaagtacactttgttaagtcagataagtcattttgtggagaaggctaaagtaaataagatactgaagtatttatatgtgtgtttgtttttaataaaaagtggaaatttgtttctataaagactgtgtaagccattgaaaggataaattgaaatgttatttgcatagtctgagatggatttgggcaaatgttataaaacaaagggaaaaaattgaagcatttgtgattttttttttttctaaccagagtgtaactgggtctctttaaaggcttgtcctcttgtttgagttatacaattatatgagagagagccccactacctccttctctcttagcaagtgaacattctggggaaaaggcagtaatcatagaaaacattgtcttttttcttcttactttctctttttgatgtctttgttatgacttacctttacagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatgtaagtattaaaatggaaaactaaatttccaaaactcaagaatccaggataacatatttgccacattattttagtgactggagattttgtagaatttgcgaatacccaaaacaactgtcatcttggattttttttttttaggtaatttcatttccttcttgataagctaaaattgtgtttctcactcctttaaaccctgcgtgtatttgtaaaacatgttgttttcccacactttcatcttaaaatgttacaactacaagtgaccttagttatcatctagtctaggccctaacattttactggaaattaaggcctaaagaagttgcagtctctcagaagttagaatccttgcttgttttgatctttgataattgtttaaaatgtaaatcttttggaaaagcttactaagtagccctgttcttattttaaggaaccttaaaatgtaattttacactaacttctatattggagtgagggccatcaggagagtagttaagtgagccagaaaaccttgccctcatgcataagtgaaaagattgaagccagggctgggcacggtggctcacgcctgtaattccagcactttggaaggccgaggcgggtggatcacctgaagtgaggagtttgagaccagcctggccaacatggtgaaaccccatctctactaaaaatacaaaaaattagccgggcatggtggtgggcacctgtaatcccagctactctggaggctgaggcaggagaatcacttgaacccgggaggcagaggttgcagtgaggccaagatggtgccactgcactccagcctgggcgacaagacagaaactctgtctaaaaaaaaaaaaaaaaaaaaaagattgaagccaataggatgatgtctcaattaataagccccttagccacaaatcgtgtgtgcaggtacacacatttttaccttatttcccctggtctcaggtaaaaactttcttatcagatagggtttatggttacaaaaaaacaaaacaaaacaaaacaaaaacagcaatagacagcattaaaaaccatttctaactaacttgaataagaagtttattggaaatagcttatataattaatagaaaggctgatgaactagttctcacaaaggttaaagagccagagcaacaccacagatgctagataacaggaactaatgaaatagccttttcaggaccctaccttcaggatgaatgaacttgaaacatttttggccattgggttattccacttaaagatgaaaatcgcaaagaaggagcattgtattgctctggcttgggtcacactttggctaggggaaggtgggagattcttaaatgacagtcccaccaggactctaaccagtggggaggagtattaccaaaggaatgttgggatgctgtcactaatagaagcatgctgtgcattcagaaatgacagatgaccactaaagtttcctctttcaaatgtgtatatttcagaggtactctgacctcattttcaaccactttcttcacaaccatgttccattagatacctttttctcctctgtctttagcctctcactctgtactgcctcctttccctcaacccatgaacatactctcatctatcctaaacaaaattcttttcttgacatctccctcttagttgttcagtctttttcctccccttctcatgtaaacctactgaaagagagttgtcctctctgcccactttgttttctcacgttcatttcacaactcactatttttaatttattatcattattttttgagacagtttcttgctgtgctacccaggctggagtgcagtggcacaatgatggctcactgcagcttcagcttcctgggctcaggccgttctcccacctcagcctcccgagtagctgggatcacaggcatgcaccaccacgcccagctaatttatgtttatttttttgtacagaccgagtctccctatgttgcccaggctggtctcaaacttctgggctcaagtgatcttcccacctcagcctcctaaagtgccgggattacaagcatgagccaccagtccagcctcagctcactattttttggcatcagcaaatatcattctattaaaaatgaaattgctgggctggacacggtggctcacacctataatcccagaactttgggaggccaaggtgggtggatcacctgaggtcaggaagttacagaccagcctggccaacatgatgaaaccccatctctactaaaaatacaaaaattaggcaggcgtggtggcagccacctgtaatcccagctacttgagaggctaaggcaggagaatcacttgaacccaggaggtggagtttgcagtgagcccagatcacgccattgcactccagcctgggcgacaagagcgaaactacgtctgaaacaaaaactgcaattgctgagtttatcactgaccttttgattatcacatcctttgatcattcttactgagccaacctctgcatatttaatgtgaaactgtattttgaaattagaataaaaacttgtatgttaagtacagtgtaccaaatcaatggaatctatgttttttccttagatcgttagacacggtggcagtctgggccttggtttggcagccatgggaactgcacgtcaagatgtttatgatttgctaaaaacaaacctttatcaggatgatgcagtaacaggtaagcatttctttctaaagctaacaagcttaagtattaattaatgtaaatgtaattacattagtttctacctatattttgtagcctcttaaaattccgatggatttctctagttgaagaggaagtgaattttgctccatttgtcaaagttatcttttaaaacaagttttgtgatatataggctttctaaaatggtatatcctgtgtgtccactttcataactgacttttgcaaacaggaatttattagggtgatctgcttactccatactgcttggcgataatatagaaaaaatgttatctaaatgtctcctttgaaatcactgtaggatttgatggtacattctgtcaaagtttaaaaggaaaacaaccctaaatatgaatgtgcgaaccctaaatgtatgaatgtgcttccacataaagtatcctttttaccaggtggtttaaaaaaatgctatcagaagctaatgatttttttgatagtttatgcaaaaagagtgctactttcagttggatgttttactgactttaaaaacataactctctgttaacattttactcgttacttgccaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggtgagatcacatacgtccctcactgtccatttatctccagcatgtaaaaaacacttaacttcactggaaattaactctgttcccatcagaacatgtaggtacacttattcataaaacttctggcaatgtatatgaagcctaatagaatttaagaaataaaagcactgattagaaaaggtacatgggagtaatttgaggattttaaattttgctatagcttcagatcggtgatactcataagcagattcagcatagttctttaggaattcacgagttgatttcttttagaaataataatttttgggccaggcgtggtggctcacgcctgtaatcctagcattttgggaggccgaggcaggtggatcacttgaggtcaggagttcaaaactagcctggccaacatggtgaaaccctgtctctgctaaacgtagaaaaaaaattagccaggcttggtggcggacacctgtaatcccagctacttgggagcctgaggcatgagaattgcttgagcctgggagacagaggttatagtgagcagggattgaaccactgcactccagcctgggtgacagagcaagactccatctcaaaaatatatatatatatatttttggaatgatttgatagtcatttaataagatacaaagtttacttcattattcttttatcagaaaacagtaccaatctctatacttgtttatttgggtgaggttttttttccattgccttttgtttagtttttataatggtgttgtatatggtgggtagttagtggcaggtaatactgtcctctataatcaataagaaccactgctatagtttattgataaaattattaattaatttgttcagttaccaggctccatctttcttccactcagcactcagtacccaggaatttaaataaggtaaaaatgtagaattagaagccaacttccttgcttgattgttaaaaggaagtggactgccataggagtggctgttgctgttgacttgactttatacttcctaaaaagtatgaagcagggcaggcatattgcatagcgtattgggaattaagagcagctacctccttctgtatttatgtgttttattgccccatttatttcaaaaactaccaaccacaaaagagttattgagctcatcatttcctatctgagaccagcttacttggtggatgccactatgcctattagactgtagaagttaactgtttgaaataagttgatgattaatgttaaattatttttcttaggacccaattcttcgaaggtctggaatgtatactgtagccatggcttattgtggctctggtaacaacaaagcaattcgacgcctgctacatgttgctgtaagtactctgacctttcttgggaatggggtggacggaaaagcttgcagatggacaataagtgtctaggtgactccagcatccacagcgcatgaccaccaccagtggtcttaggttgtgattctcatttactggacccaacaggccataacctagcactagattcacttagcttttcagaaggatatgggatgggataacagtcccatataaatggaagtccttaaagccattcaggtgcaacttctaaaatcctactgcaaggagcaccctcatttgtaagggataagaccttgtgagtatgtgtggccaccctaggatagagaaattcagtgaagaacaggaaccatttatttctttttacagccggtagagttagcttccacatacccctaatgggtgcagtggctcatgcctgtaatcccagctactctggaaagtgaagtggacagtgagctataattatgccaccgcactctagcctgtgcgacagggcaagaccctatctctaaaaaacaagcaaacaatcccccacccccacaccccgggacccctaaggaacatgatctattacaagagatgcactgcacaggaaagccaatgcacatgttttccaaaaggctttccactcatagttctcctaatccaaatgtagttatcagcaataagtaatattgcctggtcacacagtggacattccacgtgtcttaataggtttttatcatcgtggtgctgggaaaaggtaaaccaagggtacctttctatgcagaaagacttagaactattgttaactcctttttcccagagataatattttccacagtatttattaataattaataaataatttttttagcagtgcagtatgttctaaatgttcatattttgcaaaagccataatgcagctgaaatagtctttttctttttttttttttagcgactttgagacagggtttcgctctatcatccaggctggagcgcagtagcacaatcacagctcattgcagcctcaaactactgggctcaagtgatcctcctcctacctcagcttcccatgtagctagaactacaggcacacaccaccgtgcctgcctaattttttaactttttgtgtagacagggtctcgctgtgttgcctaggcagatctcgaactcctgggctcaagcaatcctcctgttttggcctctcaaaagtgctaggattacaggtgtgagccactgtgtctggccagttgaaatggtcttaagaagtagccctggggccgggcatggtggcgtacaccagtaatcccagcactttgggaggcagtggtgggcagatcacctctggtcaggagtttaagactagcatgtccaacgtggtgaaaccccatctccacaaaaaatagaaaaattagctgggcatggtggcacacgcctgtagtcccagctacttgggagcctgcagcaggagaaacacttgaacccgggaggcagaggttgcagtgagccaagattgtgccactgcactccagcctgggtgacagagtgagactctgtcttaaaaagaaaaagagagagaaaagtaaccctgaatcttaaactttgtcaagctgtgaagacttctaagcccctgaattgaaatttttcaataactttttctaaactggggacagaaatttattcttcaaaaatacatgtggccaggtgcagtggcttatgcctgtaatcccagcactttgtgaggccaaggtgggaggatctcctgagccccagaagtttgagaccagactgggcaacatagggagaccctgtctctataaaaataaaaataaaaatacatgtgtctattttttgaatgtattcatttattgtatatgtttagaggtgtgcaacataatgttttgatatacctatcagtagtgaggtatacactcactgttgaatgatgctgacctctcatgtcagtttggtctagtggtagactacatagtataatataatcttaaacttttccccctaggtaagtgatgttaatgatgatgtcaggagggcagcagtagaatcacttgggttcattctattcaggtaataacttcaaacttcttattctatttatatttcattttttttggaaatgtagtagtcactaccgaaactaccaaacagtttagtcactaaacaaaaactaaatacctgaggagtatatctgggttcagagtgaggaccatttaatagcgagattagtactgttcatctgaaaaagaacaaagcatatcatgggattctgagaacctcttttagaagtagttatttctgttcattttttggtagcattctgcttattcatttaactttttaaatccaaataacacatccagtactcctcttcttgtatattggtagttcaaatggatattatctcttacacaggtttgtaaagtttttgaagggctttaatgaaagtgaaaggtaataggttttgtttaaatgccagagtgaaaatttttaaagattatcttttacttatagtcatggagatgtccttggcagtatgatatagttgtgtttaagaagtcatactcttggctgggcgcggtagctcatgcctgtaatcccagcactttgggaggccgaggaaggcggatcacgaagtcaggagttcgagatcaccctgactaacacggtgaaaccctgtctctactaaaaatacaaaaaattagccacgtgtggtggcacgcacctgtaatctcagctactcgggaggctgaggcaggagaatcgcttgaatctgggaggcagaagttgcagtgagccgagatcgcgccactgcactccagcctggggtgacagagtgagactccctctcaaaaaaaaaaaaagaagtcacactctaaacccatctgcctgggttgactcctgactcagcttcttactagctgaatgactttcagcaagttgctcaacctctttgcgcctcagtttccttgtctttaaaatgagtataatcataatacccatctgagaagatgtttttgacaagtgaattaatatatatatgcaatgcccttagagtggtgtctggtactagtaagaactaagtgtgtattaataatggtaattgtagtagttgtagttgtggagttggtggtagtattaatagatgtaatagtagttcttccagtaattcattactgtctacttagattcaatctcagacatcagtgtttctcttagctaagatacaagcataccttgttttactgcactttgctttattaagctttgcagatactgcatttgtttaaaaattgaaggtttgtgacaagcctgcatcaagcaagtctaccaaaaccatttttctaacaatgtgtgctcatttcatttctctgtgtcacattttggtaatcctcacaatattccagactttttcgttattttatctgttatggtaatctgtcatcagtgatttttgatgttaccatcgtagttgttttgggacaccacgaaccacacccatgtaaaacagcaaactcaatcaataaatgtgtgttctgactgctccacacaccgatcattcctccatctctctccctcttcttgggactccctattccctgagacacaataatattgaaattaggccagttaataaccctacatggcctctgagtgcttaagtgaaagagagagtcccacatttctcactttaaatcaaaaactagaaatgataaagcttagtgaggaagacatgtcgaaagccaagatagaccaaaggtaggcctcttgcatcacagatagccaagttgtgaatgcaaagaaaaagttcttggagaaaattaacagtgctactccagtggacacgcaaatgataaggaagtgcaacagccttattgctgataaggaaaaagttgtagtgctccggagagaagatcaaagcagccacaaccttcccttaagccaaagcccaatacagagcaagacgttaactcttcagttctggaaaggctgagagaggtgaggaagctgcagaagaaaagcttgaagctagcagagagcttggttcatgaagtttggggaaagaagctgtctccataacatggaggtgcaaggagaggcaacaagtgctgatgcagaagctgcagcaagttacccagaagatctagctaagatcattgatgaaggtggctatcctaaacaacagattttccatgtagacagaatagccttctatttgaagaagatgccatctaggactttcatagcctagagaggagaagtcaattcctggtttcacagcttcagaggacaggctgttcttgtcagaagctaatgcagtgggtgactttaagttgaagccaatgctcttgtatcattctgaaaatgctggggcccttaagaattatgctaaagctgttctacgtgttctagaaatgaaacaacaaagcctggatgacagcatgtattagtcagggttccctagagggacagaattaataggatatatatatatatatatatgggagtttattaagtattaacttaaacaatcacaaggtcccacaataggctgtctgcaagcttaaggagcaaggagagccagtttgagtctcaaaactgaagaacttggagtccaatgtttgaaggcaggaagcatccagcacaggagaaggatgtaggctggaggctaatccagtctctccttttcacgtttttctgcctgctttatattccctgagagctgattagattatgcccactcagattaagggtggatctgccttccccagcccactgactccaatgttaatctcctttggcagcgccctcacagacatacccaggatcaatacttttcatccttcaatccagtcaagttgacactcagtattaaccatcacacagcacatctgtttatgtggtatgctaaatatttgaagcccactgttgagaattactggtcagaaaaaagattcttttcaaaatattactgctcatagacaatgcacttggtcccccatgggttctgatggagttgtacaaggagattaatgttatttttatgcctgctaacacaataaccattctgcagcctgtggatcgaggagtaattttttactttcaagtcgtattatttaagtcatttcttaagactatagctgccataggctgggcgtggtggctcacgcctgtaatcccagcactttgggaagccaacgcggcagatcacccaagatcaggagtttgagaccagcctggctgacatggtgaaaccctgtctgcggtgaaaccttgtctctactaaaaatacaaaaattagctggacatggtggcaggtgcctgtaatcccagctactcaggaggctgaggcaggaaaatcacttgaacctgggaggcggaggttgcagtgagctgagatcacaccattgcactccatcctgggcgacaaagcaagactccatctcaaaaaaataaataataaataaaaaagactagctgccataaaacgtgattcctctgatggctctgggcaaagtaaattgaataccttctggaaagcagtcaccattccagatgccataagaacattcatgattcacaggaggaagtcaaaatatcaacattagcagcagtctagaagaagttgattccatccctcatggataactttgaggggttcaaggctttagtggaagaaggaattgcagaattggtgaaaataacaagagaactagaactagaaatggagtctgaagatgtgactgataaaacatcaatggctgaggagttgtttcttgggatgagcaaagaaagtagtttcttcatttggaatctactcctgaagatgctgtcgacattgttgaaatgttaggtgtaggaaaaaataaaaaagaagtaatcactttttgggtctgacctgcagaccctggccgagtgatagatgaaagaagttctcagacatggatatccagtgaaggagtgggctagggggctgctggcactagggccgaagagagttagccgcctctataagccagagatgctcgtgtttatttagtacagatttaatgagaaaggcttggagcaaacacaatttgtgggtaattaacattgtcgacccaccaaatagagagcagtcctgcacacgaatgatcacagattagtttctggagacaagagtaaacaagtttatctagataagttcctttacattcccttgttatgtaacccttgctcttaagagaatttaactgccttcagctaaatcctcttgaagcttttgcaaaacctcccggccttccaataaggtttgcatctttccctataatttttataacttttcccaccaccctgactgatctcctacatctcctccttccttttctgctttttacatcaggttttgttaattgaagagtacagatgtgtgcagcagcagatttgttaggcatagtggttataactcgttttccagctttgcatcctagaattagtaaatagcataagacaaacatgagtataatcagtaacattcttttccaacaagaattgacccccaggagtgggggtctatccaggagagatgttatctcacatccttccatatggctgtttgttgggcgtgtagatctacggtgtttagggattctagaattttagttttaagttgtcttaagtctgctgttaaattatcatataaggttccccaggggtgttgtttcacctcatcccaactatgtattggttgattccaaggtagggaggtgacacagatacacttatgctcccagtcacagtttaagtgctgtcggaatgccagcgcatcttgctgctcccctgtatattctaaggcagcctcaggggcttgcaggcgtgcaagaatcttttgatctgtaccctgctctaagagaagttcattagacacatttttggccaagttacctacaaaggtagctgtttttacagattcagtaatagaggccacagcaatactagcagttgctaagatgactatggctgagactataaaggttttataagtgtgcctatgaatcttttgggtctgacctgggacggggcatgttctcaggtggcaagagcagaggaaccttgccaatcacgtgtcaaattggtgggaatgcttcagattgtctccttaataccatgatactagtaatatttaaattagatataattagtgacgcatgaggcaaaccaaacctgtccctgcactcgggtcacaaacgtggagttttggggtgtaatggaaatattggttcccataaggaaaacatatggatgggtagtgcaaatcaggcactgatctgtgtgattatgaataaaggtcacagtatagttgttactggaattatggtatgtcccataccaggtgtaaagggagatgctaagatgtcccaggcaccataaagtgtcttggggtggcatggactctccttgggatctgggatatcccgtccctccatcggcccaaattgtacgggaatgagacgtggctgcaaaactgtgattgatgccacgatggatgaggacatcagtatggttgctctgcaagtgtcagtgggggctctagtctaagatgttataatagcctaaatggagtctacgggcttgtcctccatgacagacctcccagccaaagtggaatccattactttcctggctatgttctttagcacaggaaggaatgttggggaaagtggcgttggttgcattgcccggtttgaggctatctgcaaccaagaatgttaaggcatttcctttgccatgatatagccatacttgagtttgggcaggtacacagtaaggattggaacttttataactaatgcacagtgggaggatagtggagtgatatatagtgttacctggcatcttaatccaatgtgtgccattaatgagggaccccactgggggtaagtcaatccctcctagccaagcagttatgttattagaggttgggaagggggtgtctgcccaagtaacagggcaaaagaaaagcagatctaagccaagcaattatgttattagaggttgggaagcgggtgtctgctcaagtaacagggcaaaagaaaagcagatctaagagatgagcccaatagagagtagcaggtgcaggttgcaggcagagtgagagattaagaagggttaataccctatgagagttgcagtgtacaacagaaggcatagcaaggaacaaattatgtggagtgaatggtgtctgtgtctggagcaggattcgctcagcctcctgagttgtcttcttcagcatcccccaggtaaagtccggggcttgtgtcatcctaggaagccgcgtcgtccggggctgctggtcctgcagggacatttccttcatttctggtaccaggttgggtcctagccacaccatggtatgatttgatgtatcgtgctagaatccagagaggacctgagggggtgtgaacacaagcatatcctctttcccatgtaagcaaatcatttggaccacaccatacattactatttacatttttccattaaactgcaggttttatgtcttgagaggttttagcaaagtgcttttctatggctgaaatttatcatctaaattttaaaaattaagggtaaataaggcttgtgccagtagtgttgccaggttcttacccatattcccccttttttgtttttttgagcatatttttaagagtggaatgggtatgttctactgtccttgggggttatacgagatgcctgtggaatgttggatgttccacgtgtgacaaaattgttgaaattgtgagctggcataagccagaccattatcagttttaatttttgtgggccgccctataaatgcaaaagttaagagtagatgtttaataatatattgggtggactctccaggaaaagtatgtgcactaattaactgagaattggcatcaatggatacatgtacatatctttgttttctaaatttaggatgtgagtaacatctgtttgccataactgattaggttctagtcctctagggttaacacctgttggaggggcggtgccgtcctctagggttaacacgtgttgaaggaggggaggtgcctgtgagctggcaatctgggcattgcaggataatttctttagctagcctttgggtgagtttaaattgtttagttaaattactccaattttggtggaaaaattgatgcaattgggtggcttggtcaagcagtgacgtcataacttgcatatctgcttgttcattgccataagccaatgggccaggcagtgagctgtgggctccaatatgtgtgattagaaataggatgtgtacgttgatccagcaattgctgaagtcaaagaaaaagtgcacacagggtgggctcgagaatggacttgagggctgtttcaaggttctgcaataaataaacagagtaagcagggtcactaacaatattgatgggctgagcagaaaaagtttccagtgccagtattaaggctccagccttagctgtctgagtgctagtaaatccagaatgagtaagggaattatgtggtttctaccaaattgccacttttccatttttaccagaaccgtcagtaaaaagcattaaagcgttgggtatgggggagtgaactacttttataggcacaactacagaagtatgagataagaactgaattaagtttgtcagcaggaagggcatgctctatatggcctgtataatcagaaagtgctatttgcaggtctagagataagggcaatactgctttgaattgctttttacttgaaggaattctatgacatcagggtcataacctagtgactgattgcattgtctgcagcttgtatagttgactttattaactagctggatatagggagatagtgttttagtccaggtatgtgagcaaaaaatccattccaggaagcgtagccctggggccatttgtcctattaaccctgtcgggagtgtttagtaggaaaaacaaacaattgaactgaataatttgggtctatgcgatttagttgcctctgagaaatagcttgctctatttcctcaattcccctttttgctgcaggagttaaatacctgggagagtctggggctgtattgccctttaggatggaaaacaggttttgcagcttatcagtagtcatgcccaaggtgggacgaagccaattaatattgcccaataatttttgataatcatttaaggtgtataagttgctagtatttaatttaaccttttgaagtcttattgaccaggaaattagcatgtatccaagatatttccaaggagaggacatttgcacatttttaggtgctatgtttaaacctcttagctgtgtattctttatgacagaggcatataaacttaaatgcctttgttggggctgctagtaaatatcatccataaaatgaataatcttgcaagtaggaacttcttttctactggggagcaaagcttgattgacatgatactgacacatggtaggactatttagcatcccttgaggaaacactttccaatgaaatcagctagctgacctttcattattgatagctggtatggtaaatgcaaatttttctctgtcctgttctgcaaggggaatagtataaaagcggtcttttaagtcaataacggctaaaggccaatcttgaggaatcgctgcgggggaagggaggccctgttgaggccccatgggttgcaaattagcattaatagcctgtaagtcatgcagaagtctccatttgccagaccttttgggaatgacgaaaatgggtgaattccgagggctgtttgacaattctatatggccagcttttaattgctcctcaactaattcatgggctctttgtaatttctttccctttaaaggccactgttctacccaagttggatcttgagagagccatgttaagggtaggggaggaataataacagtggccattattagaaagaggtctgcagagtgacctcaaacctcttgtaaatgggctagcggctccgttctttctaatgctttttcttatctctttataagctttaaaataaatgggttcatgtacctgattgccttgttgatcttgcattaccaggcaggctaagagctccccttctaatgctgcttgcctaagacagaatcccatagctgtaggatatcccttgtcttttttccaatttattggaggaggggactcaggcaaaacctccatttcctttttgttatttttttctgttaatggcggggctgagggagatggagtcggtaaggtaggtgatggttcctcttccctaccctttttaggcacttctgtgtatagcaggaccaaagcagccctgactaaggcccataacattagagatgttactgggacccattgcccttctgcatgatgttgtttaagatttctcccaactggtttccagagctctatgtctaatgtaccttcttcggggaaccacgggttatgggaaacaactgttacatataaagtttcggtgccacaaaagaaatagcacttgaatataaaattttctttttaattctcagcaaggcaagttacttctatagaagggtgcgcccttacagatggagcagtggtgagcgcacacttggacaagggaggggaaagcgttcttatccctgatgcacgtggcccctgctgctgtgtcatttccctattggctagggttagaccgcacaggctaaactaattctgattggctaacttaaagagaatgacggggtgagcgctttggcgggagtcagggcagagcaggtagcaggtaattggaatgagttagggtggagcagatgatcggaatgagtcagggtggagtaggaaatcgaaaaaggttgctttatgaggaagttaagtttaaaagtagaaggcaaagaattgaacatactgacatattctttgaaaacaaatttagaactcatatctaacaatccctccccttgtatttccttacagctttcttttcaaacttttttacaagtcttggcttagttgttttgcttgattttccaaaagaagaagcttctctggataagatggaggatagttggtggaggttttagtaagtgctgtttttatgagcctctgcatcaacttacagatgcatggtatgacacagcacccaacaagaataattacctattacggcagtgagggaaataagaattgaggctattattcctttccatttactgaactacttttctagccatcctgtaaaggggtcatttacccttgagttgctggctaactcattggatagagcagtcagaccttgcagtgcctttgttatacttccattaggaacagtgttgtttgggataaaggtgcaacattgagttttaatcatgacacaaactcctgctctttctgctaataaataagatagcctaaggctatcttattttcccaagccatctgactagtagcccctaattgttcagctattcctttaacagcatctctagtgtagttaataaatcgctgctggttgtaatagatgtagtttatacagtctacatttttattgtcacccaccaaaatattgactcaaatcctgcagctatttgattttgggttttaaattgatctagtattccctgtgggactctaattgtgtctaaatagacgtgagagtcgaaagacccatagggggcttctcttgctttacagtgtcttatttttccttcctctggttgatgaaatgccagggtgaaagggatagccaattggactaaagcacaagtgcactccagttatttggcagagtgtccagcaaaggtccaccacaataccaccacacatctgcttggggatgaacaagggctgactgattgataacctgttgaaaattcttaagctcactgcatcccttcaggtctccaaggaatgctaagtttcctccctgtcgtgagagacatgaattgaacttagtgttgggagacggaagctggatggccctcgggggctgacccgcagggtgccggactgctttcttctgctagcaaagcagttgccactacagattaaatgcatttgggccatccacgggttactgggttaaggatttttgataggaaagctacaggttgtaagtggcttcagtgctttctggctacacccttgtttacactgacaacaaggtggtattggagtgttatagggtcacggagaagaccttcaattatcaattataggtttttaatttatcctggcttttaaaggaatagggtacactgttttctctttactacttctatctctctctctctttgagtttctgttctctctctttctctgtctctgactccctctttgtctctctgtctctttctctctctctctgtctctttctctctctctctgtctctatctctctgactccctctttttctgtctcttcttctctttctctctctgcctctctttcccctttctcttctctctctctctctctctctcccctctctgctgttctttccctgcctctgccagccacttatgctgctgttctcccctctccttccacttcctctaggggagggaccagcgggagtagagcttctctttcttcctctgaaaagaggatgcccaagatggacattaactcgacccaagtatacaactgaggtcctaagaattggtcaatttggtctgccattccgtaaaggtcatccagtagcagtttaagcacctttttaaaattctggatttctgaactggttaggggagcatttacaaagccaatggcccccccttccttgtggtacctctttcaaaggaaagaaagtcggggctgatctcttaggtacagagggaaatgggaaattctgaatatcttttttacattgttctacttcacactggagtccttttagagaggggtatttaggttgggagggaacaggctgatgggatggtaattcctaagagtcagggttataacgaggaaggataacgttgagtagagagggaatttggaatgggatctgaggcagcagtggctgtctgagcggaaagattggggacactgaacggggttagatagtctaagggatcccatgcgctggaatttttaggcatgagagctggctcctctgacttttcattttgaggtaccagattgggttcttccctatttgtttttaaaggaaaaaggagggcaggtctttgcctccaataaagggcatagcctagttcttcctgagacactggacttttaccattaacatatcggattagaagctgacacgttacatcctcattcgacccaaagtttggtcagaagattgagggtttgaaggtgggtccctgagtccaaataaaacagcaatattgttatcatttgttgctttttcctaagtttagtcctttcgttatccttccagtgttttagcatgagacctagggagatatccagggggatgtctttgttaccatctttatctcccttgctccctgtcttgcttggggtatttcccatcttgatggttttggggtaaggttcaaggttcaatttcccttactggaaatttctcaccttttggggtgaggctcaatttccccactggaaatgtcttgccttttggggtgtgaggctcagtttccccactggaaatctctgccttttctgctactggaggtttgtgtgaggttcaatcccccgaaatggggatggctcgcctctttttaacctctaagccaccccgaccaaggagtagttcactgcccccctcccccttgcggctttcttaccttggtcctgaccaccaaggaaatactttaccggctcccacggcttctccttccttggtctgtgcacagagtcatcgctgcagtatgtgaagatcctttaagctaggttgctggccagttttttattttttatttttttctgcgttgctgagagctcgggttattcctcgcactgggtgggtcttgatttctcacccctgaggccaccacaagggggcagggcaagcctcctcacgagagagaaccagagaccatcccgggaggggaatgcaatcatgggcgagcccccaaattgttacatataaagtttcgatgctacaaaaggaataccactcaaatataaaatttttttttaattctcagcaaggcaagttacttctatagaagagtgtgcccttaaagatggtgcaatggtgaacacacacttggacaagggaggggaaggggttcttatccctgacgcacatggcccctgctgctgtgtcattcccctgttggcaagggttagacgcacaggctaaactaattctgattggctaatttaaagagaatgatggggtgagtgctttggcaggagtcagggcagagcaggtagcaggtaattggaatgagttagggtggaccaggtgatcagaatgagttagggtggagcaggtcattggaatgagtcagcatggagcaggtaattggaatgagttagggtggagtaggtaatcaaaaaaggttcctttatgaggaagttaagtttaaaagtagaaggcaaagaattgaacatactgacatattaattatttggaaagaaatttagaactcatatctaacacaacagtttgcattaggtcccttaattgagcctgcaaaaccaaggctccgctagctttaagcagctgtttcaatacttttatatactgttgccattgagctgataactgttgtcccatgatgaaaccctagcctgaacaatcccctcgaacttggaaatccacagtgggcaccaatgacttactgactgcgcagtttcttcaccttcattttcgagggttccctcgcaatctgttgcagcgttcctcacgcgggggcaccacctgccgagtctgtcctgcagattctggccaagcaatggatgaaagaagttctcagacatggatatccagtgaaagagcaggctagggggttgccggcactaggggctgaagagagttagccaccccgataaaccagagatgcttgcatttgtttagcacagatttaatgagaaaggcttggagcaaacacaatttgtgggtaattaacattgttcacccccaagtagagagcagtcctgcacacgagtgatcaaaggttagtgtctggagacaggaataaacaaatttatctagataagttcctttacattcccttgttatctaacccttgctcttaagagaatttaactgcctttagctaaatcctcttttgaagcttttgcaaaacctcccggccttccagaaaggtttgcatctttccctataatttttataacttttcccaccaccctgaccggtctcctacaatcacttccaagattaggctgtagaaaaaaattaatgaaaagaaacatagttgaaattacaacaaagaattgggaatatttagtaaagttagttgatagagtagcagcagagttaagagaggattgactacacttttgaaagaaattctgttgtgggtagaatagcatcaaacagcatcttatgctacagagaaatcttttgtgaaaggaaaagctaatgtggcagacttcattgtcttgtttaaagaaattgccacacccaccccagctttcagcaaccaccaccctgatcagtcagaagccaccaacatcaggagaagacattctaccagcataaagatgaatatgcactgagggctcagatggtcggtggcactttttagctataaaggttgttgggttgtttgttttttaaatacagagggtcttcctctgctgcccaggctggagtgcagtggtgtgatcattgctcagaggcaaacctgagcttatggagcttgggttgaggcaaaactgtagaatagcagagactacaggcactcaccaccatgcctggctaattttggtttgtttgttttgcaaagacagtgtctcactgtgttgcccaggctcatcttgacctctggccttaggagatcctcctgtttccacctcccaaagtgctgggattacaggcatgagccacccattgggtctggctatgttttttaactgaggtatatacatttttttggacataatgatgttgcacacttaataggctatagtatagtgtaaacataacttttatatgccctgggaaaccaaaaagttcgtgtgactcactttactgctatactctctttattgtagtagtctagaaccaaacccacaataccttgaggtattttattaaagaataaagttaaaatacagttgacccttgaacaatacgggagttagcatcactgaccccacaactcttacactgtcgaaaattcacgtataacttttgactcccccaaaacttagctactcatagcctattattgatcagaagccttatggataacatacatagtcaattaacatataatttttatgttatatgtattatatactatattcttacagtaaggtaagctagagaaaagaaaatgttattaagaaaatcataaggaagagaaaacactcgtcttcactatgaagtgcaagcggatcatcagaaaggtctttaccccattgtcctcacattgggttggtggaggaggaagaggagaggttggtcttgctgtctcagtggtggaagaggtggaggaggtagaaggggaggcagaagaagtaggtacactcagtgtaatttttagtgaaaaaaaaattgcatattagtgggcccacacagttcaagcccatattgttcaaggctcactgttatatggatactgcctgttatagcttatttgttatatttgttatatttgttatagcttatttattatatttgttatagcttatttgttatgaaattacacagtaagttgctaaagtgcatgttagatgagtcatacgtcttatgtccttttaaactttagaagagattttctaccccaggttccctgggagtgaatctttgttataaaaattgtatgcaaatccaacacataatttcttgaacatccattatgaactaggtacagagtcttctccataatatcccagataggaagtcatccatctacaaactgtaaaatatttttttcctatcgtggatggaaatgttgaataaaacagaacaaaacacagacccatatagcatggtatttcttcttacaccagttttcttgaatatgattgttaatcaaatactggtcttcactgtgttatcctctaactctcattttgccaactttttcataaagactctagacaattttcacaaaatccttatgacataatatttacccaagtctactagtctggcacctctaaacgggttatgtgacttattgggcctgattgtttcttaagttacacttttcatagaagtgtccagtgttcttcgaggcctcttctgagatctggcaaaacctatgtgtattaagctattctgcattttgtcaaaagatctgccacagactccacactttgaacttcttgaaccctatctcttcttttctcttttaaaatattggaatacttcatcatttacattctttttgtactttgcagttttctgtttttcttccaaaatttggtttcataattacatacacaaatttgttctatttctaggaggtgattcatttagctttgtgactggaactcatctaaggcaactagactctttatctgttttgtgtttgatcagtctttctgtctaaaaattattctccttgagagaaaagatggaagcaaaataaaatttaattacttctatttccttcctgttatcttagcatatcatgtagccaagctgtgaccctaacctttccctattcttgctgtagagattagacacaattaaaaaatgagaaaatggtctgtcatggccatccagagtgggttctttgtgtgaattatcagagaactagataattttagtatggaaagtatattcttccaggtatacccttagtatctcttgggttgtgtaaagcatcctactcatgtttgactcttaagttgttttgtttcctgtcagttaatgttttgtattgtcagtgactttatattttataacaatataaatcagtggcttggtgtttatattctgccacataggaagttgacggtcatttaaaactgtttttcttccatttttaatctgatggtgctttgctctctagttaacaaaattcatgtctgcccttttatttcctgtagctaacacaggttaagttcccagtttcagcagcagatgtctcccgtgagctgcttaggttttgctgagttttccactacatagtatagtcaaataagttatttatgtgcttgctacttctaagggaccattcttggttctcttttcataaaacgaatctttaagaagtgggaactggaaaaattttgtctaaaatttattttataaatgaaaattaaatataattgacctgtttaaagagctggagttaaaaatcctctctatgttctctaagttttagtttactgccatttccctagagtgagaattttttaaagtagaagaaaccagtattcacattttttttaaagataaggaaattgaattccaaaatgtttaataaatttccccactgtcataaagctaaatactgagattctaaacaggcttcatgatagaccagtgctttctccaccttgctttcagtcagagcaccatctttttgagtggctgtgataaaacagctttattcttaattttccttattaactttaatatttgagaagtgtctgtcctatatcctaagactggtacatgttttctgaagtgacatcatttactgtcgtagcatgctctccatcttttttcccccctttagatttcccttttaaaatgaatttgtggacatttggtcttataccatgttttaagagtttatttcttcataatttttaaaaacttcttttcaagtatacttattggatatgaatactaaaaacatgttagtaaacacatatttgtagttcaacaactaagataaaattgtctttgtgtaaaattcttatgtatattatctcctttattcttaggatagtccagggtgttacagtattttatttcttccttctgatatttgtagattgttatttgttcataatgcttgtaaataaaagtaaaaaattaatttgataactattcttgcttaattgaaatgaacatagtacattaatttttatctaaataaatgttctctagtggaacatctaataaataagtgattgttgggcccattgttagtactttcaaaggcagattttattattataacaacttatgcagtactgttcatgtcattgacttctgaaaactcatttggaagtgagtagaatctgaattattttaacttgacactggaaaggaaaatgaagaaagtcaaaagaattggtctttgtatatctgttgatattaagtttctataatgaacaaattgataatctgatatggacatttcttaaaatcagacagtcttggtggtcccttgcagggtgctatgacttaggctgttataatatggcattaaatgtttctcagtgtataaattcataagcttttagatacggatcttgcaagatgaacaacagattctttgtgcaactgttttttagaccacacaaagtgattccttgaatataaaaatgttacatcatcattgatcctcataatttgaagaaaccctcatagtgaaccagttaccactaacactaacactaacttcatgatcatctttacatctccattcacaattctatatcaatttgatacatattctctgtatactgttctctgtttttgccccagtatctttgtgtttctgtctgggtgcttgacttttccttactttttgtcattttcattttttttttctacatctttgttttcttctctccattaattggcagtaacatggaataaaaaggtttttttttttttttcaaaattattctaaatagttataatctgttccttttcttctaagataagactattaactggagttcttttgttacgtaagggtgtttaactgctgagatttgctttcaaattatacatctctttaaagtattcataaaatggaaataccagttctgcatcgaagtggtaagagtttgtggcttggttgtacttttcagaaatagtcaatagtggagttatgtttcactttctagaatattctggaaatagtagaaaggtctctcattaactatagaaagatctctgggttaattgtaagcaagagctagacatggtgactcacacctgtaatcccagcactttgggaggccaaggcaggcagatagcttggggccaggagtggagaccaggctgaccaacacagcgaaaccccatctgtactgaaaatacaaaagttagccaggtgtgggggcgggcacctgtaatgccagctactcaggaggctgaggcatgagaatcacttgaagtcaggaggcggaggttgcagtgagccaagattgcgccactgcactccagcctgggtaacagagtgagaatctgtctcaaaaaaagaaaaaaaaaattgtaagcaaggaaatttttcttaagggtttgacatgaaacagtttataggtgttgtggctaattctgtaggtgtgcgtatatttaagcacacaaatttggaggcagtacaaagcatgtgagaagatagttcttttgatctagattgttatctatgggtagagttttggcaatgtgattgcctgccaactctggtgtatagatttcctgaaacaattatgtatgccttcagatgcataaaatacagaatttggaatactgtcatagtgataactgaaaacttaatctcaacataccttggcaagaatataaatcttaacatatgccaaatccatcatattagagaccagaaccaaaaaccaaaatagagaatgatttttttttaaggaatgtaaattattttgcctcttatgtgagataaccatccctaatgctgctgaaaaatcttagactagtagtagggaaacatacctaaagctttgatgatttaggaattaaatgtgtatgatatactcttcccagcagattatatatagccagtaaggaatcataacagatcaggatttatgtattagagccgcattctagcaaaggattctgccactgtgaaaatatatgccttgttcacttatacactgagattctccgtagccaatacatttcttaaggcaattatcctaaactgagttgcctgcagaaggacagcaatagagtcataggtcgagggacaaatatgggtgaacctgaaaaggaaaagctaaggtatgagttatcttcactgcagacccccttagtctaaatttgcacttataacaggagcattaaaatatatatcaaaagtagattgaattgtctaccatttacttagtgccttctatgtactcatcctcataagaattgtataaaatgcagatgagaatactggggcttgaagaaattaagtatttttcctaaatttaatcagctgtctggtaagtggcacaggttggactcattctgagatctaacagtgcaaaataatatactgaaaggatgaataaaaaattttgtgctggaagttcacttgagtcactggacaagcatacataggcaggcatgatctcacttaaagtttgtatccctgattaagatcccatgcttgtgcacgttaattaatatctctaagaaacctaatgtggttcaggtacccaagagcgattttatttgctttttcctccttctccaatagacctacctgtgctgagtagaagctcaatatcagtcatttaacaaacaggtctagttccaagttcttgttattttgtgtgatatccagctactatcctccctatcccttccatcaaaacagtttcctgatcagaggaaaattatgactgcattcaactaaatcagactataaatggcaatcttaactcacctccagatgtgatcactgttttgtgcacttatttttagctctgtgttccttttgttctgtatcatgccttatgcttttaagacctggaaggcaaggctaatgtttgttttgttttatttcattcttagcacaactttgcatataattagaaaccaaataaattttatgatgacagtggttctttttaaagcctgaaatttattgatttgactttatttcattcgaataccttaaaatttaaccagagtgctggattgttttcatttgtagctatataaaattattttcctcatggaataatcttgtccaaattaggaaaattagatattcttaatacttacatcttaggttaaagagatgatttgatatatgacataaaattctttatataatatattcttggcacatttacatctcattcatcatcttactcatcattatgtttgatgacaactgccagttctgctatacataactaacttgctcttcagttttgtcaccttcattttcagtgaggagaagcgtatctagtagaatgattgatgaagactgaatggttgaacttcggagcctcattggactctggtacatggcagggttaatcccatttcgaattccatgtttcttgaaaaacttagagttctctgccattggattccggaagtagatcttactggagcgttttctgagagtttttactgactttgtggcccggtaattgcaggtgatatatcggccaaatgcatcccgaaatgtcttattgaagagggtgtagaccaaaggattcactcctgaggaaacatagcctatccacacaaatatctccaggagcatttggagagtagtttggttacaggaatcacataaaactaaagttatatttgtaataaagaagggacaccacataagcaaaaagaggaaaaacacaatccctaggacctttgaggctctctgttcgttggaaatggtctgcactgactttttcccaattgtggatgttcttcgcataagtgtttcatcacctgagttgggcagagccttgtcctttcgagaaccatccagcattgccaccttttccggtgacgagcaaggtgtttcatccctttggaaaactgtagacacagtcaaccatgttaggcgttgaggtggcttgtttttgactaagtaagccttcttctgtaaagcatggatagtgagaaagtaggtgacaatcataattgcaagaggtgtgaagaaggcagccagtgagccaaagagcatgaaatcgccaaaacgttcctttgtcagcacacaagtgatattgtttgggttgtccacatcagtctctatccctttaatagggactggaatggcaatgcctaaggaagaggaaaacaagataaattgagtcattttatgacctgtaactcttcgattagatccttttggattgtatccttataactttatgcttgttggtgcattataattcctgggacccacaatgcaggatttgtcgaagcattcatcagtgaagatttgacaaacagaacctaagtgagcaaatctgtttttaaacggagattggttagtaatttcagatttataatgaaagctcccctaaagctatagtatatccatgatacagtggagaatgtcttcatttattctacatttctcataatctatttttgttttttaagctatctcagattaaggaagagaaattcagaagagaacctgcttttttcttattatccagtgtagttgatctagaggcacttcagagtacatttattcaatatctttactcagttttgtctttgaggttacagtttcatttaacagtttttccttttgatatgtgtgaatgtcttttaatcctttccatctaacttcttagggaaaactaaagttcattaaaaagtgctacttaaaatttgagtgtgtgtgaatcatgatgttgaaagattatgagttcttaatctttcttcttctgtagaagcctgggcacagtggcgctcatgcctgtaattccagcactttgggaggccaagtgggggtggattacttgaggtcaggagtttgagacaagcctggccaacatggcgaaaccccatctctactaaaaatatgaaaattagccaggcatggtggcacgcgcctgtactcccagctactcaggaggctaaggtgggagaatcacttgaacccaggaggccgaggttgcagtgagccgagatcacaccactgccctccacgctcagcgacaaagtaagactctgtctcaaaaaaaaagttcttttatgacctgggaaagaaatatacctcatgttagttttctgatctttaaataccatgaagtatttaaatatgatgtttcttagtgaagtagcttattagaaagacaaataatacaggggttaacctgaatctttttcctttgaaacagcagatattttttaaatgtctgaattaattgatctttagaaacctctggaatccttgtgttgttttgtgaatccaagagcacccctcatctacacaccctttttatggtagctaaagagccattgacaagaatatgttcctcaaaccctttctaacagaggtcattactttctctacttttcctcatgtacaccaccagaaagaggattctgtatacttgttctacaccaggggtcattatactacagtttgaggaccattggcccacattctatttttgtaaaagttttattggcatactgccactcccatttgttagtaacatattgtctgtggctgcttttgttctactgcagcagaatggaggagctgtgacagaaaccatatacgccctgcaagcccaaaatatttgctgtcttaccctttatagaaaaagtttgctgacccctgctttaccctgttactttcagatcaccattccactgtttatttctcccccaaaacacttgccttttgaagtttattttatctacttaatactttcttctccatcttgcttttctgttaacctccatgacatttgttcatcttcatcaatggcttcagtacctgctatagtcttctctccactgttccagtgccagcattttctacttcatcccattcgtgacccttctaagaccttaattttatatttcttgaactctttgactctaattattattatttgcactaaagccatctacaagtctacttagaacaatccctaagattatgaactctaatacttcccttccttgtcctgctacccctcactcctagagaacttctgtttcctgttatttttatctctagttcattcattcatctcagttttcacattctattaactcattctattaatgagacttcattcatctcagtttttacattctgttaatatcaggactcacactactttcctatccagcttgttggtcaataactgtaaaagttttcactggtactttttatgcccttaccctgttatattattatactttctgttgccaggtattacctagaataactgtaaatccaaaagaagagagtgagctctcttcagcattttgtagaatttcagaactgagcttattgtcatctgcattttcattttttcaaagttattaatttgtgatcggttctacaagacaaagtgcaatgaagtgaaagagcgttgattttggccttggtgctgaaaagctgtaagagttcttaagccaactgattaaaacctctaggtttcttttttcttacctacaaaaggaagaagtggatttctaaatctatatatcatgagtcttccttttaatcttttttctcctgcatcactcatcactttgtgttagtgtaatttgtttatatgtccgcctttcttgaatgcaaagattctttttcttgatcatctgtgtattcttagtacctagcacattataaacactcaataaaaatgtggtcaatttataaattgatggtatccagccttaatctagatgccatttataccagcaggctgcttaccttattagcttgatcacatttcacagtttcaaatattttaattattcttaaggatccatttcttcaactttttttccctttctctgtccaactctcccaccccaccccaatatacacatacctcacactctcccttgccctctccctcattgcagtgagcttaccaaatgtgagtcatctggcataaatgactttattatagttttcctcctctgcacttcaaattttaattttcacccattgtctcccattccctttctgtagctgcttttggggggctggttctgctctgtcggcatctgccccctcatctagccttttctcactgtttttaaatctcttcattctgaatagactttttcttgaccctgttttcttcccataccagaggagtaacacagcttgcttttacctccaaactttttcaaagagatcaagcccttatatcatcatttcaggaatatgaaggtcaatctcattgttttgctttcttgctgtttttgccccagtgcccctactcagattagggaggagtaatttaagtattccaggtctcttaattttttgcctctttgaaatatttttacaaggaagaagagaatctgctggtcaaaccattgtaatttttgcaaatctatttgtttttctgatactaacatataagagttttgaatgatttacgcatacttcatgataagaagtatagctttgagtattatagatgagtacagggccgtaagacgatttagaagaaaaaggatttcttttatacataatttctgaacatcggtatgttttctttgcatctctcttaaaactttgaattaaacatactcaaaacacttaagtgcagtgactcacgcctgtaatcccagcactttgggaggctggggcagggggatcgccagagctcaagagtttgagaccagcctgggcaacatgacaaaaccccacctctaccaaaaatacaaaaattagccaggcatggggggtgtgtctgtagtcccagctacctgggaggctgaggtgggaggatcgcttgagcccgggaagtcgaggcagcagtgaaccatgattgtgccattgcactctagcctgggtgacagagcaagaccctgtctccaaaaaagaaaaaacaaaccaaaaaaacccactgaagcagacacttaactgcctttaatctgtacacatatgtacagaaatgttggcttccaagatgaatttgtgttctttgatacctgcccacaaaatgtttgagttgttatttttgttttttctcttattaatcttttaaaatgtgatttaaggtgcatttcttgttattttaatgtaattacaggattccaaatgctagctagaccataattatctgttgggaaatatgaagactgttctcaaacttaacctttctgcatatagaaatctaagcagaaagaaatctcaataaacactgtgcagatggttctttctgaggacatgagttttgttacttgtcacactttttaccaacagtatgttttagaaggcgtatgataaatgcagtgacataaggagcttatgttaatgtatcagtaggctggcttgacctctcatgctgagtttcattgcctaccagacctggtattctcctagccaagtggaaccaaagattttgtataccacccacactctggcattctctacatacctattgaaattaaccacaccactgtaatcttgatgaatgctgtagcccgtgagttatattgattggcctggattggctttttgatggctatgtaacgatccactgaaatggcacagagatgcatgatggatgcggttgaaaagagaacgtcaagaaataaccaggcaggacatagaacaagtgggaggggccacatagcctctgaaagaaacaaaaacaagacaaacattttattctataaaatggcaactttcagtctacagtttttcaggtgatacatcttttgtcttttttgttactcatctgaaattttataactttaacaacataatgtttaacttcagataatggagacaacattaaattcaatatttctgtggatggtaacttttaaatacattttctattttgcataataattgtgccttttttctaagtcagcagcagtttaactttttagcattattatgacctttgctcttttgtcgattccatttgtgatctttttaaaatttatgtagtattgtgactggaacttaaccttggtatttaaataaaatttatttttaagtagctgttgtataaaaagaaaacattttaccatgtagaggaaacagtatgacaaaaagcgtattagaatgggagtctctgtgacacctgggttttgggctcacttctagcaataactagcagcaagatccttgtttatagcatactctagtttggtgaaatagtggagtgatttttttgacagaaatagttctcaaataaagattgcaaaaggaatggcttcagattatccggaagaaaagtagattgtttccccttctatatttcatcattcactccaaaaactggagataaaataattagtacagacttttgatttgaaaagaaaatctcagggttagacgtagtacttaatttatttaacaaactcttataaaacactgcatacttcatatagtcttaagcactttagaaatattaaccttaaaaaaattttaggtgtggatgtgatattgaatattctgcatagttttctaataaatttacttacacagatgttcatacatatgtgaatttaatatattatgcattatatattacacccaccacttaacatgtttacagtttcaaaacaactaaaattttagaattccccctagaatatttccattagaatccagtttaactcctgtagagaacagatgtcatgcatgtgagattatctaagtctcttttaggatttgattgttatatgtccactgataaaatgtaatctacttttcttctggctattgcaggtatatctgactttgacaggtataaagtgattgtcataattgaaggaaaaccagaataatcatctcaggattacagaacaacaagagactcttctattgttaactgtttaaaatttaaggagcctgggggtggagagagattaaaatctcagaccaaaaaaaaaaaaagcataatttaggggcagagtttttagatagatttggctgttattttcaagcatcaagtaggagatttttttaaagtcaggtaggatttcagtgaaaaatatctgggcacttgacaaagtatccagaaggtagcaaggctgacacatctactttttggtgccttctgtttccagagttggtatgtggcattctgaataagaatattaaaatatttcttcctaggaacaaaataacaaaatcagcacaaacttttactcagaaagaataaatgattgggacttagttctatgttcagcagcttcttaaaaagggattaaagcatcaagtggaaagggtcattcatacttttcagtgtattactgtaaataaactttgcctgcttgttgaattgggggtaggaagggatagaggtggtaaattttagatttattgagctggaaggaaccttagagattaccattgatcttgcagatgagtaaattcaggtataattaagtctgaatatagaggtaaggaggggaggcatttatttattgaaatgtaaatgttatctgaaagtgttatttagaactgccactcagagtttgctcttaagatggagagtgaggatcggcatcacctgggtacttagatatgcaggctcttgggtctcatctcagacctactgtatcagactctgcagttaaataaggtttccaggtgattcgtatgcaaattaacatttgagaagcagtgctttggaagactttctggtaaggtttgtgtctgagtcttaaaagatgcacctaagtttcctgttgtagggttggttataggcacttggaatgtctcatggaaaggaactaatgggaggcctctcagaataaattaagtcagagaaactggtgtttggagaaaatctaatcaattggattttctcactcttagccatagcattcagattttttgtcatttagtggaaaaggaccttggacacaggcagcttcaaagcgaactaacagtctaagtatagtgaaaagaatcattttagagtttgcagtggaaactactaaaaatgagggtacatcttgagctgaagttctagatttaggactgtaagtagggtggtaggaaaatactcgtctagagctataatcagagatattgattgcagttaaggatttaaaaggcaggtaattattgtgttatatcttagatttccttccttgaagtccttactctctctgtaacatcttttaaaatagtttgccaactatttaaacctgtctatttagctattctagttatggattatacttctgaagattaaggtttggaaaattctagtcataaatctagttgccataagcaggaagccataagaaaattcatataaaaagtacgtgtctttggaatttgaccatctgatccacatactcctaattgtgggctaagaaggaaagttttttagtgctgatttaagtaaccctatgaagccctgttagcctcactttaaacagaatttataaactcattcccacttaaaattcactagaattttcttattacagttagtgctttattgttaacagaaatattgagatgtgatacagaattttctttaagaaagaatgagactgaaatttataagagagatgaatctttacaattccaagcctttctcatttcaagtttcgtgaaacactggtggatagttttaatgaaactaatataaaagaaaaagataactgcattaaattaatagaaaccttatatacaacacaaaaaagaaaaagaggcttttttaaatgcctaatatatttgggtaatctaagaatttatagaaattaaaaacagttctagacacacttgttttataaaggggcttttcctagtctagagactttcattctaaaatcattttttagttagtattaatttagctcaaagtcagaaaagtttatttctgtttagaataactaaattaaaggttaagttggtatggtgaaatactttatttcaaaacgtttattttaggagttttggttttaagaatttctaattacattatttgttataatgtattctgtccaatatacttccacaaagacttaagacattgaaaatttgaaataatgaagtgaaacagttacatacttaaatggaaagaaagaaatgtgtatctaagggtcagtctgagggaaacaagttactaggttcttcaactaaattactgttattctggggctctaaattagactctttcattaaaattaagaaagaataatagcatttctgtcaatgcctgaaataattacagactgaatattaaagcaacaaaacaagtcctagatgggtcttgtcttatagacaattgtttaattatctaaagaatatcagtagcacaaatattttattgtttaaaatgaagactgctttaaattctgccatgcatgagggatggtaggagttgtcattcagttatataaatttttatttgtctcccagacaaggttcaacaacttcataggtatgggcctaggtctaataccttccacagaaaagagatcttgcagtcatctgaaggatttgtacaagtataggttgacgcacaagtattcttttccacttaatatgaaatataactttaactgaaaagaatactgagttctaacttgtccctaggggggaaaaaattctgtgatcctctgaacagttacatggggttatttaaggtataaatgttggttctgtatgccaaatatgacagttttggctggtcagatttctcattgacatttgagaaagcggaataataaaggttaagagtgtgaattctagaatcagtcctcctgggtttaaatcatgtctctgccacttactttgtaatcttgaacagattacttatccctctgcttctctgtcctctgtaaagtggggataatagtacctgttttataggatttctttaatagagtttatatggatgatgattaaatacatgtgaagtgtttagaacagttcctggcataaagaaaacactcaataaatgttagtgcttattactattgtttaacagaaactagccaactaactcaaccatgaaaacactcctacatagaaacaagccaaatcatcagtatgaaataagagtgtttgtctttctacctgctgtagcaaaagtgcatgcatctgattcagcttaaaactttaagctgtactttccgggggtgagggaggatgggctgagaacagttaactctgtttaactttcaattgaatttgtcataaaagtatgttttttactaacgttgaattttaactgctgtttattttatatacggtacaggaaaataacctgtatgcattgcatgcctgggttttttgttggtttgggtatttttttgtttgtttttgctttcttttgaattagtacaaaaacctgaggagttttactagaaaccccgtatcttgatgaggcagacttattttatctgaaacctgcttaacctttgggcagctttttagtttgggaagtcaggttacactatttgtccggaaaataattagcatcagtccataaatctgggacataaaatgtttccctttggaggatgtaaaagactatttttaaaggcattccaagtgggctgttcctatagtttacagaggtactcagttcatgaacttattgcagcaggacaaatcataaatacttcttatgtccaaaaagaacataattttcaaatatacatttatctcagaaattctaatgcttctgtctttatcttccagaaaagaaagacatagttcagttcaaattattgtttaaaagtttctgttttgttttttacttttttcactacatttgagcatatgagttatcctggggttcagtgtctaatatgatagtgttttaaatgttttaagcattttaatgcttacagaattttttcctggtttttaaaatttccactttacaaaaagaagtgcctttaattcattgcttttctcctccatttcagaattgggtaggctaacattttactgcataaatgaataactgccatttttctcttactgctatacatttgtttcatctctgattagacttgcatctcaactaaatcatatttaatttgcatgcagtactctaccagttactattagtgcttataagatgctgggccctgcttgacaaggtgattgagctctgaaataataagtgattgaactctgaaataataagtgacttgcctgatccaacacgggagaaccaggattcagaccctgggatgtcttgcttcaaacagccatctttcagccattttatatactctttcagctataccacggatactgtttgaacttatagatcatgaggcatcaattgaaacttaagttatagccaggtttggtggctcatgtctgtaatcccaacactttgggaggccgaggcaggtggatcacctgaggtcaggagttcaagaccagcctggccaaagtggcaaaaccccatctctactaaaaatacaaaacttagccaggtgtggtggcctgcgcctgtagtcccagctactcgggaggctgaggcaggagaatcgtttgaacctgtgggtggaggttgcagtgaactgagatcatgccactgccctgcagtctgggcaacagaacgagactccgtctcaaaaaaaaaaaaaaaaaaaaaacttataaataaaccaataacacccaatggatggccagatgccatatcttcccgtgttacttttttttttttttttccctgagacagagcctcaccccgtcacccaggctggagtgcagtggcaccatctcggctcactgcaactctgtcttccgggttcaagctattctcctgcctcagtctcccgagtagctgggactacaggcgcgtaccaccatgcccagctaatttttgtatttttagtagggacagggtttcgccatcttggccaggctggtctcgaactcctgacctcaggtgatccatccgtttcagcctcctaaagtgctggggttacaggcatgagccaccgtgcccagcctcccctgttactttttaaatcacttataaaatgaaacaaagattcagagaagctcttaaatggtgaacatcctgtcttttttatatcagcataaggtgttgttttcttgctcaagtatttctaacgtaggtattttcaagccttgtgttataagctgttgatttgtgatcatggattttaggaattatggacaagacaataaaaaactacaactgtaaagatcaagtccagtgctcccagataggaagaagtggcagaaaaattgacctagcacaactcatttgaaagacaatgttgtgcctgagttgtcataatcttgggaaaatatgaattcaaaccgtatattgttaaatattatacagatcagtggttgaataaaatatctctcagtataaggacagaaggtccacttttatattttactgctcttatttttaaaatttcattttattagactacgagctagtatagtttttgtgttactttcattgaattcccctgcgatagctaaaattattgctcatagtgatagttaatcttttatcatagaaccaagaacgcttgtttgtacaaacgttagaagtcctaaagattaacactacaataagagtgtaaagtctaattctgccttttaaagttatcagaagttcttataaatgcattagtttagaaaaatctttgtgtttattaacttgcaaaaggttataaaaatatcttggtatttgaagtcaggtttccatttgtaatacatgcagttcccaatttatgaattcatcctttgaagtttgttagagggcaacatgtgtttttttcctacattttttcatagaaattgaattatgctttaaataatgcaataatgtattagatagtagttcacagatttgttcattttttaaaaatctacaaaccccactatacaacttatttctgatagtaaaagtgtttggggctataaaatattttattttgtaattagaaattaacaaacatgagccaggcatggtggaatgtgcctgtaatcctagctacttaagaggctgaaggcagaggatcacttgaacccaggagtttgaggccagcccaggcaacattgccagactccatctctattaaaataaataaataaaaataaatttaaagttaataaacatttggaagaatgaaataatattaaaatgtctatcaattatttaagacataaatatgaagacatttcacatattttatgttaacatatgttgggttttctgctaacttgtattgctaaggatatgttgggtaccagcattttaaatatacacttaaagttttcagctgctggatacctatttttctatagaatacatggaatctattaaacaggtaaatctttgttacctgtttttgtattttgtttgttagctcactttaattctatggtactttgccttttaagattccttaactatttagctgataatttaagtatctaccatggtactttgcatataatagatgtttgatatttatggactcaaagattttaaagctaaaattcacttctgcataattctttcaatatcatgtattgaatgacgtattaaattttatggtagtctgaaataagcattttgacattttctgtgtgcctagcaaagcacagtttgaagagtatgattttacatcttaagctactattatgcacatggagatgagagctagaatcatatgcctgtacagtatttatcaaatatgcatatatatttctacataatactttcttttaagctttattcagaattagggttatgttctctattatagtaagatttcttaattatttttcatggtttcatgcagcattagattatttaaaagattacaaatttataaaacagggagatagaaagactgttaattattagaaagtctaattaaagcagtagaactttactcattactgcttgtcctgccacataattttcttgatttattttaaagcccaggtaaatgttgatttaaaatggaaggtgtaaacctgttactatctgataatagttttagatatctttctgttattacttataaaattgtaatgtgtaaaacctgggtataatagttggaatagcaggggttttttaccttctaatatggattctagtttaataaattttacttctgtaacttaaaatatttttatcttcatataagtaaatataattctaagaaactatatctgccacaagtaatcattttgcttaggcagtttatgaatggaatatcagtttataccaagcattgaataagttaaatatccttttaatgctgattccaagggtctaggagccctcataattcatcagcagaattatttgtgtttatccaaattttataactagagatgatatgcagaaatctggaactacttatatcttttttttattatagcaaactaagatttcagtgtcaaactataccttttattatcgcaataactaggttttaatccacttaccaacttagaggcctatcaggaacacagatgcccatatatcataaaaaaattgaatcgatagatcatctctttggacactctgagccaaaccatttccttcagcaactaaacataatttttcttaacatgacacatatgtaggaattgtgttcaagtttataatatacaaactattaagagctataataagaatttttggacagttccaattttaaactggggtttagtgatttaaattgggatttagtaattcaaagaccttatcgttaacccagcgcatatctgtcccggaagtgtcctagttattgctttgaggaaaaaaagtatcagtgtagaaaagttaaagtataggcctatttactataatttatagataatatattcagaatctataaatatcactaacttgaatgactttttaaatgattttattagatagcttaggagggagaaaaatagtttacaaaaaatattttttgctctttaaaactgctgatcaaccatagagaatgatataaaacaagggactgtttacttgccgtatctttaaatagtccaagttcatcttttatttcaagaaaagtaaagattaaatgagtgtccattctctaatagtatatcatagttctgtggtttgatggcacaaacaaagtgaaatacttaccaaacattattgtcaagagggcaattggcatcacaaacaatccaaccagcaaatcagccaccgccaaggacattagaaagtaattagtagcatactgcagcttcttctccagtgaaacagccagaataacaagggtatttccaccaattgtgggtattatcaccatgagtatcagaagagctgcccagtgcagtttatttccctgttcctcaacaatctgtttcatttcctctggtattgattctgtctgtaatccagaccagttagaagagataacgtgaacaaaggtgctctgcaaaatgtgctcaggaattgtgctttgaagttcagacactctgtaagagagagccatttgctgtttttctgtgattcaatcccgttccgaacagtggtcagcatggttagtagctaagctgctcatctgtttttttaaggcattgtaaccatgccaaacactcaaaagccaaagttgacaccttcctttaaaaaaaaaaattcaagttctctaaaatgagcgcatacacacatctgtccatgtttgtaggtaagatatccaagtatttattattttctagaggcttaaatttaggaaagctcagtgaaagaaactgatagctgtgaaaaaaataggatatatatatatttttagtttctctctctctctttttctgccgtagttgtagagtcgtgtttgaacttgcatgccagagagttccccctagatacaaaatacatagactgcattattttattcatttctgaaagtggtaaaaacacttgaacttcatagcccttcccttcttagtaagtctgttgtgcatttgtgacaatgcagccaattctccaaatatactgtatttctgatgttgctcagttaatgaaacagaagacacattaattttttcaatggttataataaaaagttaggtgtttcctgacccttgaatgtctttttacctttacttacagaagaatagaaaagtcgaaacacaatagttcagaatagaacttttagtatgcgctggccacccacctagaaacactcaaagcccaacaagggtctaaataaatgttttaccagctagggatccttatatgtaattagctttgtcttatcaggtttgtgagtactgatataaatgtcattttagatttcctttagtttgagagaaggaaaaaaaaaggtattactaggatccaaataattgtgtttagtaatttcatctctcatggtatgtctttgcaacaattgtgttctaaatttaatcactaaatttgccaaattcaaaccagttctttttttgttttaagtagtgtttatttttttaaccttcccagttgccttgagaagaaagggaaaccaaaaggaagattagaccatttatttgttcatcaaatgtacaaatcacgtttttaaaaactctcctttagcattagtaaatttttcattttgatttttaaaccgctgaatagaaatgaaagattatgatagcagaattcttgaagattaaaaaaaaaaacctttagattaattccatatgtgtttattaaatgcttacctctggtttcgttgttattttgctgagcatgtcatcttatctgttcactagacttgcttgctgctgtgactgaaatcctcctcccattgacttattctgagcctccagcacaggcggttgaaagcagtgaaacaaatacgttgtatagctgcaagcatgccaaggaggttatttcctctttgatacattcatttttagagagtagcagcattcattgtaattcataaaaccactgttaagcatgttgaaccagttcatggcccttattcaagttatatttttaagagctctctttaatatttggggggactgtaataaacttgatcattttagcttcagatagttttgtttggggttaagcctgagctgtttttcacatttgagaaaaaataagatataatctagctattttagaggtttcattctttgaagattctgccgttttaaaagcctatagtgatttctacagttctgatttctagcagtgaaacaagattcttatctagcttttgtgcctttgctgtggaacaccattaatttgctctggttgcaaccttatatagaagagcacagaaaggcctgaattctacatgtatacataggttttagcagaaacttttttactgcttatttttaaacagatgatctctgggtttaggagtggttcacagctttttttccccatagactttacgttggagaaaatacaagtaatgaaaatacgtttttgccttatttcagaaaattggtgtttaaatcttaatagttatgctatttaagttttctgtaaccataagactagcttagtattagaacctcagcattctcaaggtttccttttaaaagatcattatagatgcatattttaaaattaattacttataaatcagtgatgacatttgtgcccttttcttgtttcaaatttgtattcctttgctcatgttgaatgttattggaaaatacttagttcattttagctctgctgagcacttcagattttattcagtatttgctgcttttttaaaaactcaaaatttactatattagaaaaaatacttgtgaagaattctagatgaaataatattcaagagaaatcagatgttttttaatgtaccagaatttctattcaggaatatgaaaatattttaaggcaaggtgcggtggctcattcctgtaattccagcactttggtagaccaagacaggtggattgcttgagtctagaagagaccagcttgggcaacatggcaaaaccccatctctacaaaaaaaaccacataaattagccaagggtggtggttcacacccgtagtcccagctactgggcggcggcggaggggttgagggttaggggtcaggggagacctgaggcaggaggattgcatgaacctgggggaggtcgaggctgcagtgagctgagatcacaccactgcgctccagcttggggtgacagaatgagatcttgtctccaagattaaaaaaaaaagaggaaaagaaattatttttaaatactgcttagttgtgagttacactttgacatctgtgcttatgaaggcaggtagggatctgcaaaacaagtaatgtcagattgaaaatagcagcaccattttatatccagtgaaaagacttgtatgaaataagcctttattgatttgtttatagataaaattttttaaatattaagtatattataaaaatgcagtcattgttgtattttgcctgtattaatcctttcactcacattcactcattttttgcctcaacttataaaaagtaagattggtactctgattttttttatttttgcttttttaagtctgtttaatgtctaaggaacgtaactagttagaacagctacttatttggcaatctcaagttatgggaagcatagctgagaatcaagaaaaaagcaaaataataataaataaataattatataaaaggatagttgagtctcagcaaataactaaacctgtgctctaaaaccctaagcactttaagtagaaagtagcctctaagtccccactccatatctttttactctttacacacatacacgcacacacacgcacagacgtatacacacacacaaaactttgcctctcccccttctttagtgaaaataacatttgtacatggtggtagatgtagatagtacaaaagaatgttgagtgataaattcatgtgagacaattttaataaacatgtttccctgcctactccagatttgagtaacaagttaaaaggtggacaagcactttgataatagcaaatagggtcaactgaaacagcaacaacaacaacaaaaaaaaaaaaaacaagaatttaaatgtataaacatgtaggtctactcaaagtagagacttgtacctttttttgtgtttgtttttgttttgttttttgagacagagccttcctctgtcacccaggctggagtgcagtggcacaatctcagctcactgcaacctctgcctcccaggttcaagcaattctcctgtctcagcctcccaagtagctgggattacaggcgcctgccaccacgcctggctaatttttgtatttttagcagagacggggtttcgccatgttgaccaggatggtctcgaactcttgacctcaagtgatcgcctgcctcagcctcccaaagtgctgggattacgggcatgagccaccgcaccccacgccctttgacaacattttatgtggcataatgatggatagcacagtgatgacttctgtgtacttaagaaaaggctagatcatgttcattcagcaaataaatgtgaaatgaatttattaaatatttctatgcaaataataagaaatataaaagtatgattcttaatggtagagtgaagtttttaatatctggaagcttcatttgtgtagaatatttcctttcccaaaagcttcagataaagtaactcttactaaagtaacttcaaggtcagactcagcctctaatccagtaataaccaaaaaaacctaattggcacatttttttctaagacaattgaattttctccctgatgtctttttaatttattgagcagattctgtctttgaccgaaaagggcagtctaatattctttataggtctaggaagacagcttaaatatcagccaagaacacttttttacctctcagtcataatacctattaaacagtaaccataaaggaatgtttaacatgacagggattgtatctgctacatattcatttgtgaagtatttactaagtgccatatgctcatggagatatattaatgaataaggtaaacattttctgtcctcatgtaatttataattttatggaggatgcaaacaagtatattggtaactatagtacagataaggtagaactaagactagctcacttcaacaggacctacagtggagttcaaatatttctcagctttctttttattcattcctctcatgttcattctctttgacaagatcagtgaaagagctgaaactataagaatagctatttcaaacttaatctgttctcgttagactccttcattctcttctgactgcctgttattttaacgaaagactttgacaaatcaaaaacaagcttccttcactgtcttctcaaaatgtctttcttttcatccatcctatccttctttgggatcatgttatcattcctttccacaattgacttctacttaggttcttgatcccatctcatatgtatatgaagtctgtgttgcttcctctggcattaacagcctataccaggagtgtgataggctgccatctctactgtcacagctagtctaggagtgggggtgtggtaggcagacagtttaagatgccacagtgctgtcttaccacaatacagcaccttcttctttaagccctccccaggttaagttttttactggattcctgtgtaaaagttgatctagacaatttttgccaggttattgccagaacaaaagaataagatttttttttgtcatcgaaactctagagtacaacctgatgtcataaaatggtgttgtcctttaatcaaaagactgctatacctggaattatagttgatgatcataacccaaatatcttttggagtagatatgctcaactctgcatgtcctcagtaatcacagtaatcagctattagaaatagacttttatcattagaatacttgtttaaatatcagaagtgattaaaactttttgagaatcaaagtacatttatgttgattactataaaaatcaaagaaatatcaatacagttctcaatgaatagcagtaagttgatggcagctcactcatactgcaagacttttcttagtttgctgattagaaatgaaaacaagtgtgctaataatgctgcaactttgaatattacagatttctgtaggtccaggaatgcaatctgagatttttaagagctctatttattatggtgacacagcaatttctttgtataaggcttgtgactcttcttacatctttaaaattccctccctcgcccattttagcagcacctgaaaagtattagtctttttggaaatgtaccaaaagcttgcctaaaagtatactaatttttagttttctgaagtccaggaagatgacaacaaataaattctctttcactgaatttgtaacatttatggcacagtctgtgtggttttgttttttgcttttccttgtggtaagttatatgtattcactatatactaaactgataagagttaaaagctacaaatagcagtagcttagaatatggaggtacgaagaacaaaagtatgtttgggaaagaaaattgttttctttctcagctttttccctgaaaatgttttatgccacaaaattcaaaaaagcataatatatttcccctacttttttgttttttacctgtaatggcactgtttgtttgttttcgagacggagtctcactctgtcacccaggctggagtgcagtggcactgtgtcagctcactgcaacctctgtctcccgggtttaaacagttctcctgcctcagcctcccaagcagctgggattacaggcgcccaccagcacgcccagctaatttttatatttttagtagagacgggcttcactgtgttggccaggctggtctcaaactcctgacctcaggtgagccaccacacccggccaatggcactgttgtttcttttattattattacaagttgtatgaactagccaaagaataaaataaaggagaacaagaaaagttcctcagattcccacaacatgtagctctgtcgttgagtacacatgcagctggcaaatttataattgtctaagtaaatatacttttttctgtaaatatacttttaaataacatatcaaaacatgtgaaagagctaagttataggtaacacattctatgctaataaaattgtctaccaagtattgatttctttcctctccactgcccttccctaaaataaagtccagtgtttttcctgtgacttgaccatttctcaacatttagttttctaaatacgttgttttgttttgttttgttttttgagacaaggcatcactctgttgcccaggctgtagtgcagtggtgtgatctcagctcactgcagacttgacttcctgggctcaagtgatcctcccaagtagctgagactacaggcatgcacctccatccccggctaatttttgtattttttgtagagatggggtttcgcgggaatgccaaggctggtcttgaactccagggttcatgcaatcagtcctcctgcctcgacttcccagaatgctgggattacaggcatgagttactgtgcttggccagtttttctaaatatgtttatggagacatagaaataagctttattgctgattaaggattagtcatttaaatactttgttataaatgctgatccaaggtattataagaaactggaggaattatttcgtgatgttatctagaaggcaaatgtttatactgaagaaagatttagggagtgtcagaattattgaaaataactgaaagaaagcctagtggattgttactaatgatttaatgtattttcttttaacctgtaggttctctcttcatctcttgccttgccctctttttctttgttttcttcctccttgcagtttatttgttgaagaaaccagttatctctgttttgtttcccatggtatgaattttgctgagtgcatctttacatgtagtttaatgtgttgtttggtccttcacatttcctgtaaattgacagttgaatctacaagcttgatcacattcacattttttttagggtggtggggctggcggtacacacagttatttccattttcatgatgttagcagtcgttgataatcatgctgcgatctattcattatatgttacaaaatggtgatataattttatcatttattaactgttcctttaaaagtttatatcatatatctctgtgtgtatatataaagattaatgtgcaggagttttgctttcagtgaatgtttgcattccaatcattgcttagaaagtttttttgcccttgccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgaggtcccgccactgcactccagcctgggcgacagagcgagactccgtctcaaaaaaaaaaaaaaaaaaaaaaaaaagaaagtttttttgcccttttagagttgcctgctgaaacattgaaataaacatataagaatattatggttttactgtactcttgaaaagattgaatgtctaaactaatttaataaagaatttctcatttcttgtcttaacacttgttttttctaaagaatgtgtcagagttggaactgttgttagattgagacactgtcaggttttttatatgcttttgagtttatagccttcacagcctatttcagtctttattgcaattaactaggtaaagttctgcattaggctcctggtatttatgttctcaggcaaaattttttctaaacctcatggaattgttagtgccttttgggaagcaaaacttaagtctaacttctatcccctttcagaaaacttttctactaaagaaaagaacttgagttttgtggttggtttaagaatagtatatatgttatattttatttactcttttataacaagtaaaaatgacaaaataaatgaaatgttgacagattttaggataagctctttcctgtgagtcagttttccctggaatatcctgcccttgcagccaaggggtaacttgataagtatcctgcatgccattagttccctaacaagttgatgacgaaattctggaggtctgaaccctaaatataaccagctttctaggtttaatattcagcttgttttatattttgataaacctttggacatcaaatgttagtagccaaagttctggttctgatccaaagccagtttctggttatgcatctagatttcagtgatggtagtatggtattttcctctaccactccaccgactctccccagcatacataaggaggagcaggtattgttttatggataaggcaattaaggctcagagaaatttagtgattgtcaccctgctaataaatggcagcactagaattggaatccaggtctttctgattctaagcctctgttctgtctaccacaacaaatggaagagaggtcaagaaaagagatcctttaaggaatcactatgttatttccagtgagaggtgataggaactgaaacaaggcaattggaaacagaagtaagatttaaggggttctcttgacttggcggcagattatatgtggagagtgagggaacagaatgattaaagatacgagtttcctaggtatgtcaatgaattgtcatggtgggaagagaagcaacttggagagggatgcccttttttattcctttctttgtgggtttttaaatgttgattgaggtttgtggtatacttggttaaagatttccaataggcacttagaatttcagattactactcagattatttggaatctgttgttagagagtacaagggaattaaatagagacagatatattctttttttgagacagtgtctcactctgtcgcccagcctcctgagtagctgagaccacagatgcgcgccaccacacccggctaatttttgtagtttttgtagagacggggtttcaccatgttagccaggctagtcacgaaatcctggactcaagcaacgggggcagatatattcttaattgctgtgtattgagttaatcctctaacactgtggcacttacctaatgagaattataaattcataattctgctaagggactatcctgaggcttaaagcctgaaaaattccctctgaattcttacctagcattataggcacatggccacaaaggtggttttcccagggcacagtttgtccattgcactttggatgagctgaccccttgatgtgtctaaatgtggaaaatttgattgcataatttatggtattgggggatgggggactgctttcaggtagttccctggggtcaggggggaagaattccctctgtgatagccccatttagaatagtgtttctgcctatctatgtatattgctgtttttcctcctttagtaaagatggattagagggggaaaagaaagacaccatattcttgaaagcatcttgatttattagtgatttaatgttgaggttgcacaaaatattcataaagaaatagtatttaaaagccagtgtgttgaaagaaaggaattcatatgtgcagtttatggtccaatgatatggcagtgacttatgcatatgcccttgcacaattcctgctctgtggaaggcttgtacaaatagtaacattggcaagatgactgttagttacaaaccaagaaattttattgaaacaacaaattagaatgtagttagcttattttggtgtgcgtttcattttttaaagcagaaaattacaactttttttcattaaaaattgaattacatacttaggattaaagcaaagtttttacttactgctgcctattatattataccttatgatgaaccagaagtatagtaatactaaagagcaacaaagttgtttttcattttctttacatgataattgtataaactaggttttaaagccttgggatacattccctcatgttacatttaaagattcgactcccaaaattctgtgttatctgtgtgtttagaggggcaggaggaaggagactctgatccaaaaaagatttagaaccgctgtatcagacaattggcagatagtcacataactaagtcccgagcgagcctaaaccaagacccagtttttccaaatgtttgttattgtctaaacctactgtgtcgtgtataataatcactcaataaatatgactgactagacccagccaccaggtcttaagaaagatagagagggttcttcagaaagctctgattcctgccatgcacccaagtggttattatgctagtagtcctgattttttatttctagtgttatcttcattattcctctacacaaaatcaatatggtttttctacctacttttcctcaagcttgtttctcacattccagtgttcattcctttccaacaacatttatccctctgctatcagaattgtgcccattcaagactcaattagccttagaaagaaatactcacaggtatgtcagttttccctggttttgattatctagctgaattataaatttaagggagaaagcaaaagtggaacaggaaagagcttggtgtatttcctagtgcttaaccattaggccttgaacttagtagaaaatacttgctgtctaagtctctaaatgtaaatttagtttaactctctttgtctcttattaagtaataaaaattattttacctatagtacctggcactgtgctaacaaattatgggagacagaaaatatagtctcagcccttgtgcagtctagagtggttttattggtaattaattaggtggcaaaacacttgagtgagtttgttagatgatttgggtatcaaattacggaaagagctttaagttcttagccttataggagtgaaaatagaagttaaatggtagtttcaactacaagttttagaataacttttcaatagcctctttggtgtaatatcattttaaattttatttttatttcattggaatgttactcattgaagaaaagttgtcctataataataggcattgatttaaacctataataattggttcatttttaaatgctgtagaattgtaaagttggaacagacttacagaacttctagtcccattcttcctcttttcagatgaggaaaggaccctggaatgtttggttgattgaacattgtctaaattggcccaactatttagagacaaaacaggaactagaacatgagttttagacttcatggttccctcttatataacttactgttatttttctcagtacataataactgatagcatatatgttattactatattttcagttacttgctcatctggtttttgttattcctggaaaacagtcaagaaaatctatctctaattataaaggagaaaacccaagtgatttgtctaatgtcacataactaacaaatttagcaaaactagaactaggacctagatctttagttttctaatatattgcttttttcacaccaccatactgtttttcccatactgtttctaataatactagtgacaattagtattatttccaaattattcatacaaggaagtttaggcaaactgagaacattctcaagaaagagtgatggactctattgtagggaaaaataatctaacctttccttactgcaaaatttcattttaacagttacagttttcataaacttcgttctactcctttgaaatttgaattcaccactgtctggagtttgaggctggaggacagttccaacatagaattatagatttgagttggtttgtggtaattgttttcattcataacaggatagtctttttttaaaatgcctttttaataaataaatgttttaattaaatgtctgaaaaccctaaaatgtcaattaattaaatgcaagtcaacttctatacagttacatataaattatattcagtgtaggatttcggttcactttagtatttttaaaagaaagtagggcaggacctccaaactcagtgcctgggccctaggaactatgaaggtcttgaaacagcctttctggagaagttggaaattcgggttttaatgtgaaatattcccatcttaaatggtgacaacttattttgaatttttttaaagtatgtaggccaaataaaatctgctacgggccagattgggcccttgggccaatagtttatgaattttattttattggtttgaattactgaaatagttttcttgctggtttttccaccttcatgcttttaacctgtcttgttcacaggtatctccttaatctttctaaatcatcattccatttatctgcaaaataaaatgcaaattgctaaacctgacattcaagacactgtatcattttgctcttaattgcctttccacttttattttttattacatgtgctacaaaaacactgactgtgttcaaattagacaagccaggtgaattcccatctctagacctttgctgacttactttccttatcctgatgcctatattcctcttcatcatttgtccaattcttccaatactttcaaagtcactttatgtctgcattctctgtgaattcgtctcctgaccactgttacctctttctgtgatatttttttctccttagcattcatatcttaggtagtttatgccgctttgccacttttatatatataatatatattatatttacatatagtatatatatattatatatattatataattataatatataaataatatatattgtgttatatatttatgtaccatatataattatataatatataaatatatatatttttatgtataatatatatttatatattatattttatatattatatattttatttatttatttttttccttgagatggagtctcgctgtctcacccaggctggagtacagtggtgcaatcttgtctcactgcaacctctgcctcccgggttcaagggattctcctgcttcagcctcccgagtagcaagttgcagttgcccaccaccatgcctggctaatttttgtatttttagcagagaggaggtttcaccatgttggccatctggtctcaaactcctgacctcaagtgatctgtccacctcagcctcccaaagtgctgggattacaggcatgagccactgtgcccgcctttaatacacattcttatgtgtgttggttttgtctcagtaaatgtttggcgatggtgaaaaatctagagctgtatatgcagcttcaaagtctaggaaagagcctagtttcttttttttctttcttttttttgtaatttcaacttttatcttagattctgggggtacatgtgcaggtttgttatgtgtgtatatagtgtgatgctaaagtttgtgggacggtagatcccgtcacccaagtattatgcatagtacccaatagtttttcaacccagcacccttccctcctccctccagttcccagtgttcattgttgccttctttatgtccatgaatacccagtgtttagctctcacttataagtgagaacatgcagtatttggttttctgttcctgccttaattcacttaggataatggcctccatctgcatccatgttgctgcaaaaaacatgatttcattcttcatggctgcaaaaaaatctttttattgaagtttaatatacattcaaaaacatgcacaaaatcattagcccacagcttgatgaattttcacaactgcatacacctgtgtaaccagtacccaattcaagatcataacattaccagccttccagaagctcttcttacattctcttctagttattaccctagtcctgctgctcttcaaggatagccactgtgccagccaggatcatcttttaaaagatggggtcaggtataccattagtcaagtttgtcctattttttatcttgttgcaaatatggagagaatgaaaaataatttctcttcttaccaacacaaaaataattgctaaagcaaaaatgcagaagtcagaatttcttcattatcaaggcttctttatcagtttattattcaactaaagtgatactgggggatttaaatctttcatgtaacttaggaaatgtccaggaattactataaatgacttttgtcttctggaacaaaatgcaaagtaaccaagaaataggaaaatagatgtagagcagtgtgctacccccaacatggctgttcctgccatggaggaggtaccagagaataactggaatccagacctatggctgaggactcacttatactgagaaaggagtcccctttctgtacatatattctctgaatattgaagatcagatttcttctatcaataattagaactctatgaaagatttttaattctgcaatttatgttttaaatgctcattgtttcctataactttttcaaaaacaacttggttaaaactcttctgtcttaacttaaaatagattacctataacagtggcttcgctttctgtttcttatcagaacccctgaacagtgcccaagtgttgtctctttgttgtcagagagttacaaccctcatgtgcgctacggagctgcaatggccttggggatatgctgtgctggtacaggaaacaaggtaaagcccacagccaatggggtcagttctttcttggcgccagactgttttccctcgccgcagaatttatgtaacagctgtaaaaatacaagtgcaatgtgatctgtaagagtaaacttgccatacaaagcttcccagtactccctcattctgcgatgctggattgcccaaagctgcttaagaataaatcgtcacattacatggatagctgtaactgaaacagtgcttttgaatttctttttgaaatcattgatttctgggttttttgtttttgttttttttgtttgtttatttgttttgaaacggaatttcactctttcatccaggctggagtgcagtggcgcagtctcaccatgttggccaggctggtctcgaactcctgacctcaggtgatccacccgccttggcctcccacagtgctgggattacaggcatgagccaccgcaccaggctttttttctttctttttttttttttttttttttttcttttgagtcttgctctgttgcttgggctgaagtgcagtggcaggaacactgcccactgccaacacactcagctaatttttttattttttgtggagaaggggtctcactatgttgcccaggctggtctcacattcctgggatcaagtgatcctcctgcctcagcctcccacagtgctgagattacaggcatgagccactgtgcctggcccattgatttcttaaaaaaaaaaaaaaaaagaagaagaagaagaagaaaataaaatagtttttgttgttgttaaataactactcaggttattttatatgattatgttacatgtttaatttgtataattagtattctggaaaacaaggttctcatccgaagccaccaaaatcggctgatttgataacatttctgttttaagcaaatcaccgatgtgctatttacctgttttctcatatctaaccttaataggtaacctggtatttgttaagccctcaaaagttataaaaaaagagttgaatggggtaaggtgatgatttgaaaacataattcatcatgagattcataaagaaatgtgctattgcataaataacaagtattcataattcacagcagtgacataatcatgacactttgactctcatagcacatatgcacaaaccttggccacctcccagaagtgaaccttttaacaaagtgtgtatgtataagactgagagcaaggctttgctcccagtgcctttgcatcagagagaaaggagtcactttttttatcatctgttgtccaaactcaaaacaaaacatagttgtaagtttatggactgattccaggaatctaaaaattttagattccttgaatttttttccaataaagaatattggtattgtgggccaggcactgtggctcacacctgtaatcccagcactttgggaggctgaggtgggcagatcacgaggtcaggagtttgagatcagcctgaccatcatggtgtgaaaccccatctctactaaaaatacaaaaattagacaggcatggtggcacacgcctgtaaccccagccactcaggaggctgaggcaggagaattgcttgaacccaggaggcagaagttgcagtgagccaaaatcccgctattgcacttcagcctgggtgacagagcaagactccatctcaaaaaaaaaaaaaaaaaaaagagtgttggtattgtgtacaaataagtttttctagtcacatgaaagattattgaggctgggaataaaaatagctatttttggccaggtgcagtggctcacacctgtaatcacagcactttgggaggcccaggcggttggataacctgaggtcaggagttcaagaccagcctgggcaacatggcaaaaccccaactctactaaaaatacaaaaattagccaggcgtggtggcatgcacctgtaatgccagctactcaggcagctgaggcaggagaattgcttgaacccaggaggtggaggttccagtaagccaagatcatgcccttgcactttagcctgggggacaagggtgaaactccatctcaaaaaaaaggccaggtgtggtggcttacacctgtaatcccagcactttgggcaaccaaggcgggtggatcacctgagatcaggagtttgagaccagcctgggtaacttggtgaaaccccttctctactaaaaatacaaaaattaacctgctgggcgcggtggctcacacctgtaatcccagcacttcgggatgccgaggcgggcggatcacctgaagtcaggagttcaagaccagcctgcctaacatggcaagagcctgtctctactaaaaatacaaaaaattagtgtggtggcaggtgcctgtaatcccagatactcgggaggctgaggcagaattgcttgaacccaggaggcagaggttgcagtgagtggagatggtccactgcactccagcctgggcgacaagagtgggactctgtctcaaaagaaaaaaaaaaaaaagctatttttcactacacatggcaacaattgtgtaaaaatttgtaaagagacatccctcctttccagtatttcatcctattctgtctgcttaccctgctatactttttttttttttttttttgagacagtgtctcactcttgtcactgtcacccaggctggagtacaatggggctatgatagctcactgcagcctcaatctcccagtcttaagcaagcctcccaattagctgggactgcaaacgcataccaccatgccaggctaatttttttttttttttaatagagactaggtcttgctgtgttgcctgggctttatttttcttcacagcacttaccaccacctgatatattttacacttatttattgtttgtctttgccgaaatgtaagatcactgagaatataatgttcactgctggaacctaaaattaaagctttgtttgttgcatgaatgatggatggcaagatcattaaaggatgtgatggtgaccaagttggacatcatctctgtcattacagagttttgttttttatttttgtttttatttatttatttgtttgtttatttatttatttattttgagatggagtctcactctgtcacccaggctggactgcagtggtgcaatctcggctcactgcaacctccgcctcctgggttcaaacgattctcctgcctcagcttcctgagtagctgggattacaggcatgtgccaccacacccggctaatttttatatttttagtagaggcggggtttcaccatgttggccaggctggtctcgaactcctgacctcaggttgtccacccgcctcagcttcccaaagtgctgggattataggcatgagccactgtgcccggccagtttttttatttttaattaatttacttatgttttaatttatttggggggagaatttcttacatgagaatgtatcttcagttttactagagatgtcattgggtatatcgaatgtagttatagaaattggccttattttttttctacaacacatctgttctgtaaacaaaggaagaatatagttgtatgttttactaagtatttcccccctcgagtcttaagttgacatttatgtcaggcctcataagttaaatgtaaattagattcttttttcttttcagattattctgaacttaatatgatatctaggagcaaatgttctttgaaacacagcatctgacaagttaattgaatgaaaagtttttttattactcatactaaacaagcctttatttctagataatttatgtgatctaggtatcagtacctatgtaactagtttgggacttttttttaattatttcttaaaaacctgaaacatctgtttattctaaaatataccattggggttgtattatgtacctcaaaggccgagttactgtcttttaccttctaaaatggaaatttggttatatttttatcatgactacttcataaagaatattgacaatatgtttgaaaaacatactccctgtgcacagtgtcattacatgtttcagtaatgtagggagaaaggatacccatatctgctgtgtgtattatctgttaatagctctaattttaatatatatatgttaagtttacatgtagaggaatccaaagtcactttccaacaaaggattcagttcattcttttccttggtcttggaatgaaggatacttgagaaacatcctaccaaattaagaaatatctgataatcttacaagcctattactcttttcgtcccagatttatacctacctaaggaccttgtaagggatgttgtggggttttttgttgtttttcttgttgttttgtattttttttttaactctaatctcaatgacagattaaaggaacgttgtgggtttggtttggtttggtttggtttggtttggtttggtttggtttggtttggtttggtttaagacagagtcttgctctgttgcccaggctagagtgcagtggcgctatctcggctcactggaacctccacctcctgggttcaagtgattctcctgcctcagcctccccagtagctgggattacaggtgcccaccaccacgcccagctaatttttgtatctttagtagagacggggtttcaccatgttggtcaggctggtctcggactcctgacctcgtgatccacctgcctcggcctcccaaagtgctgggattataggcgtgagccaccgtgcccggccagggacattgtgttttaaagtggctcttcccaaaagtcctgcagagtgtgaatagaagttatacggggcaaaagagtttttgatcaaatacattggacaaatgctggtataaacaacagttgagtggtttataataaggcatcctagaacttttgttatgatatgtatattcctagaacctttgatacagtgtatacatatattttgtatctgcaagaggagatgatatatatacagtatgcctgaactcccaaacttatttattaaaggacttcttttttcatagaactgatattctgaagaataggatattggggaaatactgataaatattttggaaaatttcatcacttgtggtcttaggaagtgcaaccatgaaatcaattctagtctatgatttcatttgttttgctattctactagctagtaaaatattttgtttggaaaattttgggttttttgtttgtttatttttttgtcttgatttaacttttaaaattaggtcttataaaatcatctgagatgttaccttactctaatatttgtttattactatttttcttttttcttttttatattagagacagggtcaactatgttgcgcaggctagtcttgaactcttgggatcaagtagtcatcccaccttgcctctcagagtgttgggattacaggcgtgagccatcgcacccaaccttacgctaatatttgaaagaggtttgtttcctttttttttttttttggagacagagtttcactcttgttgcccaggccggagtgcaatggcactatcctgcctcactgcaacctctgcctccttggttcaagcgattctccagcctcagcctcctgagtagccaggacttcaggcacccgccaccacgcccagctaattttttttttttttttttttttttttttttttgtatttttggtagagacagggtttcaccatgttggccatgctgatcacgatctcctgacctcagatgatccaccctccttggcctcccaaagtgctgggattacaggcatctgccaccacgcccagctaatttttgtatttttagtagagaaggggttttaccatgttggccaggctggtctcaaactcctggcctcaattaatccacccactttggcctcacaaagtgctgggattacaggcacaagccaccacgcccacccagcctgacagaggttgaattatacaaattttggattcagactggcctgggtttgctatcagtacttactcgactttgggcaagttatttaacctttctatctctcagtttctttgtttataaagattgttttgtgctggattttgtttgttttaggagtaagagggttatatagcataatacataaaatacctagtactgtgtctgaaaagtaataggtgtttatcaaatgttaatcccattttctcttaattttttatgacctcttacctcaagacgagagcgctcaggttctaaagcttccttttcacttaccctcagttatattgaaatttaagtaaagcatgaccagttctaaactattccattcacgtagttgttaattaacttcttactacactgttggatgaaattattgacttagagtgacagtagatatagttgtgcatcatttaagaacagggatgcgttctgagaaatggcagttccgtgaatgtacaaacatcatagagtatacttacacaaacatagatagttatggtctgttgcttccagaatacatacctgtacgtcatgttactgtactgactaggcagttatggtaaaaatacagtataaaagataaaaaatcatacaactatatagggcacttaaccctgaatggaacttgtaggactggaacttgctctgggtgagtcagtgagtgagtgttgagtgaatgtgagggcgtacgacactattgtcactataatagactttataaacactgtacactttggctactaaatgtatacattttttcttcaataattgatcttagcttatctttttttaataaatttttaattatttttaattttttgactcttgtaataacacttggtttaaaacacaaacctgggcggacacagtggctcacgcctataatcgcagcactttgggaggctgaggtgggtggatcacctgaggtcaggaggtggagaccagcctggccaacgtggtgaaacccatctctactaaaaatacaaaaattagccgggggtggtagcatgcacttgtaatcccagctactctggaggctgagtcaggagaatttcttaaacccaggaggcaggggttgcagtgagccaagatcgcgccattgcactccagtctgggtgacaagagttgaagctacatctcaaaaaaaaaaaaaaaaaaaaaaaaaaaattgtaccattgtacaaaaatattttttctttatgttctgtaaggttttttctgttttcaaaatgatttatttatattttttaaacttttttgtaaaaaactaagacacacatacattatactaggcctacacagggccagtatcatcaataagtcacttaggcaatagtaatttttcaactccattataatgggactaccatcatatatgcagtgtgtcacttcccagaatgtcgttacatggcatgtgactataaattgaaagttcagccatatcaactttatttaaaagttgtgtgtttttttaaattctttcaggaagccattaatttgctagaaccaatgacaaacgaccccgtgaactacgtgaggcaaggggcactcatagcttcagctctcatcatgatccagcagactgaaatcacttgtccaaaggtgagcaaacaaagaaattccctggaagagagatggtttggtcttttctttagtaacttatcgtcttttgaggacgttttttagttcaaatatggtaaacactgaaagtaaagtaaaagtaaagagagcattttagagtataagagaatggggaaactttaaatatgtaatgctctttaaatgtattttttagacttaatggtccctttgttaatttaagtatataaccatgcttgaaaaattagaactcttggggtgttaaaaccgtaaaatgaactctttttttgcctttcactgtccttttaaaatgtattcagtgggataactttttcctctgataatataggatgcaaacttaggcagtccatgccttttttgatctgtccttctaaagtaatttttaaaaagcctgcagtcactttgtatcgtacataccatcttagtttagaaatgagtacatccacattctcttttggaatgtcattgccctcctaggcgatctttttgggtggagttccaaatggctccaagacagctttcttttccacttgacccacatctgctccacagaaacactcttgtacattttgcccttctgcataggaatataataggatgtcagtgctagtacctcagctaatagctaatgtctcagtgcacagcagcccctgatcatattggacactccaagtggaccctctgaacccctattctgtaaacttggagtgagggggaaagactcacaacccagcttgccccaaagagatcctcttcacatatcctccacaatccacacccaccttgtgggtgactccataatagttttgagacacctgttttaaaattctctgatgagcccagcatggtggttcattcctataatcccagtactcccggaggctgaggtgggaggatcacttgagcccaggagttcaaggctagcctgggcaacatagggggaggccccatcactacaaagaattaaaaaggaattagctgggcatggtggcatgcgcctgtagtcccagctatttgggagctgaggtgggagaatcacttaagcccaggaggccaaggctgcagtgagctgtggttgtgccactgcactccagcctgggtgacagagcaagaccctgtctcaaaaaataaaataaaattatctcatgataatctctcagtcctcaggttgttagtgtttgatatctcatgtatcttgtcatttcagccaaaacttctcattctactaagaaacagaaaatgcatgtatcttatttttaatacatgtactaaaattagcattgatatactaaatagacacgtgtagcttacacaacaatttcagatcttctaattcttaaagctagggactttagtatccatgtattaattaatcctgctcatataatgggaagtagtcaaaaaattgacaacagaaaaaactgttggcattgtgtcttatgcctcatcgagcaaataatagcacaccaccctcattttcagcaaagtagatttgaggaggtagagaaaagaaaaatttccggaactcattgattattctaattttatggagctttgtttaaaaaagttcaagttctaaacagttgctgtcatctttgcttcatttatttagtgcttctatttctgtctcaaaatcattttcaggactttcaaaaattgtattattacaaagatagaatctgacttctcatcctgtttttataacgtattacttaatatactacatcttctagaacataaacatctttccaaacaccacatttctttttgtttttaaatatagcagctatcatatgagtagcttttacatattttatttctgcttttgatcttcaactgagcttttggaggttatccaactgagtagtgtcattaaagaaacaaattttggtcatggaatgcacctcctctaacagtaatacatagacattcactttgaccccacatgttgctttcatgttacttgtattgtcagcaagacaaatgttctgtcttcccatcctctgctgtaggatttcattgattttacaattataatctctgttccaaaaatggcagagtcctttaggagctggataatcattccaggaactgttattgaaccaagtcttacctggtgcagatacatggggcacactcccatcttcaggttgtatcggaatcttagacactgattaaaatgtcaaagtgaagtcacagctagtagcctttgccagtaatataaactgggtagataaatgtaagtgtatataccactgactaaaaaagcaaaattgacatgtgaaactcaaaaattctttcaggaaacactactctttagagcaaagttgttactcagcttaagaattcttaaagttaatttcattgttttctgttattaagcaagtgataaagaatttcatagactacagtttatatcatctttcctttatctgataattgccaacaagacaaaattgacattttggagatggtatacagcatgttgccaaaaagaaaaatctgttgagaaactctgaaggggagtagattctcaaggctacagagtcttaattgcaagattgcaaaaccagtccatgaaataaagtggaaatggctcaaaaataaagatcaaatgtgaatttcatcaagagttataaacccctctcaaaggaattcaaaagagaaatttctcaggtattttgtgaaattcacaatggaaattcccaaaggaaatgtcttatgtaaccattaatatatgtcacatccctaacacttagctccacacgttgccctcttagttgaagtatctccagtacatctttgctttgcttctctcagtttctcgctagctcatgctcacaaacataaacccaggaacatgcacacatccctggatcaaaggttcacatttaacaagggtaatgttcttttttaggtccttggagctattttgctctaaaaacccaactctcctctttattaaattatctatcttttgtttttcttgttaaatgaaatccaccattaagatgggcacagtggctgaggcaggagactcgcttgagcctgggagttcaaggccagcctgaacaacatcccaagaccctatctctaaaaaacaaacaaaaaaatcaccattaacagttactcgaacatgtacatattaagtatcatatataaactcacatcaaaatattacactgtaaatatagaatctggtgttcctattaccagtattacttggcctaaggcctggtacaggaaagcttctcctatcattgacaagtaccctctttggaagtagaattaagctcctgcagttctaaaataaatcactgtatatatgatttcacagcataacacatttgtaagtagtagtctattaccacactgtcattttaagatagggacttggactcttacagtgttagtggtaataaaaaagaaaaaggctacagaaactactctaagcaaattaatgctgataaaattgaggagggagctgaaaactcatttgggatcctgataatggggaagtcatgatagcatcaacaagaatattttgaaggaagaatacagataatattcatttcaggcatattgagtttgacatgacagcatgtcattggaaacaacatgggagcataggaaaaaaattagacgctaaatacggagatttgggaactagccataaaaaaaattatataggccaggcgcagtggctcacgcctataatcacagcactttgggaggccaaggcgggtggatcacgcggtcaggagttcaagaccagcatggacaacatagcgaaaccccgtctctactaaaaatacaaaaaaaattagctgagtgtggtggcaggcgcctgtagttccagctacttgggaggctgaggcaggagaatcacttgaacctgggaggcggaggttgcagtgagccgagatcacaccactgcactccagcttgggcgacacagtgaggctgtctcaaggaggggaaaaaaaaaaaagtatatatgtctatatagatatatacagatatatatacacatatatagacatatatatagagacatatagagacatatatatatgtgcgtatgtgtgtttatagccctttatctaccattacagaatccagaaagctctgaaaactcagaggtttgtttgtttttcaagactcatttggatgcaattattaattcattatcatttatcctacttagtataaatattcatatattgtgctacttcagaaataatttatttgattatgggatatcataatatatagagcagtactacactgggagtattgtataatatatggatatgtatcatgttagccttctaaattctgaattccaaaatacatctcacctcaaggatttcatggaaggaattacagacatatatttgaagtcataagcacaaatataatttcacagacaaaaaaaacacctccaaaactgatccttgatgtacagctacatttccataaccaggaagatagaaaaatagaaaggaggagtaacactcagatgataagtaccaacagaaacaacgctaaggaactttattgctttctccctgatatctaagagtgggcttttttccagcagtatagggtatacaagtaaaaacatgatgaatgtttaaaatgcagctttttgagaaggtagattttaaatactcctacatagtacaatgcatggatcacagcgttgcataaaattttaattgtctttttttgtgagattgttgtgatataaaatggaaagctaatatgatttttctcctggaaattctactttttgttttttttggtggggggagaccatactattcataacaatgaaattgagttagaaaatcttaatcctcaccctgattaccattaattgcttgtgatagcaagcaaaccaattgttttgcttgtctttttagtcttcatatctgtaactagatgtgaatagagggagtagaccagatggtctcaaagctgacttcgaaatttaatgtatgtcctaatctatcaaaataattctttaccaagaattacaataatgaaaattaagttactgatacataagaaataaaatgtgagaaaaaaatttaaaatgataaaaactagctttttaaagcattctatttaatattagttagataagcctattgtatagttggactgatttttttatccatttgtcagttttactgaatgcttttctattgttttgggtacaattttaaatttaaattttccctataatgtacattcagtgctttgttctatgtttctttttataactttgtgaaatacttcttaagcctttagcacataaaatttccatactgtataaggtaatgtaaatgttcatctaaaataagttcagaatcaaaggaacttgacttgtcgaaccagaataaaagcgtcaaacatgagaattttttttttttttttttttttttttgagatggagttttgctcttgtcgcccaggctggagtgcagtggcacgatctcggttcactgcaacctttgcctcctggattcaagcgattctcctgcctcagcctcctgagtagctgggattataggcgcctgccaccatgcccagctcattttttgtatttttagtagagacagggcttcgccatattgggcaggccggtctcaaactcctgacctcaggtgattcacctgcctcggtctcccccaaagtgctgggattacagtcatgacccacctcacccggccacgtgagaatttttttaagtagaggggaatttagtgatgatttaatcatgctaggttttatagttaaagaaatcctgagaagtaagtgacttaagtggttgtgtgctgggtagtggcagagttagttcattgtttccccactatattctgttgctgcctgtgaataaaaaatgagaaccatgttcaaggaatattattttgttagtagcatttagattgcagagataataggagggattggtaggattcttcccccatatggtgaaacagtcatgcttattgaactatgaaatgccctttatacattacacgacgtatatgttacctcatataatcctataatagccatgtaaggtaggtgctaacatccctgtagagatgaagatactgaggttcataaaaggtagtaacttacccaaacagcttataagaacagcttataagccagggttgtgtgattctattattctgccactgtatcacattgtggcctcccagaccaagacaaatgaaaagggggaaaagattctgaaagaatatgtaatgcagataaagtcattatattaggaaactcaaatttgatattttctgcttttggcagatttggggagctccatgattatgtgcttcttgaacaagccgacttcttcctgggtgcctaccatttgaaaagcactgttgggaaaacagagaagtgtaagacatagaagaagcataaaatagtttacttattgtcacccaaacagatttaaaggaatattaattattcatacagaatatattttataaatatatgttctaatcataaaaataatacatattaattttagaaaatgcagaaaggataaagaattaccagtaatcccaccttaagtgagtcagcacattttccattccgatactctccttttggtacgagtacacattctgacaagtcctcagaaaattaatgtgagtagataatggaaatctttactttatgtgaatatacttcatgcaaaagatacctcacacagctttggtgaagggtaatttactttaaggtggaactgaaggaccatgctttttaggaaacccgcaaggttggtggtaaacagaatagctataattcaaaatgcaatgaaagccttagtgtttgcttggactttttaggcctgctgactaacagtggtaatgtatgaaatcgcattcaacattcctttgaccttgaaacatccactgtggaatgaggattcaagacagagctggtgctcccacactaaaaagtcataacacccgtgattgcaaccacggaactgctctgccttcaagtctggtccatatccctctcttgagcattacgaaactcagaactaactcattatcattggagcaatattattccctgttctaaaatggtaccgcaaatgagtagacttagactataattctttctcttgctccttcaggtgaatcagttcagacagctgtattccaaagtcatcaatgataagcatgatgatgtcatggccaagtttggcgctattctggcccagggcatactggatgcaggtaaatgtttttaagtcttcaagatttatttatttaaactaaatctaataaaataactatctgctctaactatatgacataatggaaattgagtctgaggcaaattattcctggagaaaatttggagcctgcagttcacagagatcatgtacatttaagagtacaggccgggcgcaatggttcatgcctataatcccagcactttgggaggccgaggtgggtggatcacctgaggttgggagttcgagaccagcctgaccaacatggagaaaccccatctctactaaaaatataaaattagctgggcgtggtggcacatgcctgtaatcctagctacttgggaggctgaggcaggagtatcacttgaacccaggaagtggaggttgcagtgagtcgagatcgcgccattgcactccagccggggcaacaagagcaaaactcggtctccaaaaacaaaaaaaccaaaaaaaagtacaggctgttggccaggcacagtggctcatgtctgtaatcccagcactttgggaggccaaggcaggtggatcacctgaggtcaggagttcaagaccagcctggccaacaaggtgaaaccctgtctctactaaaaatacaaaaaaattagccaggagtggtggcatgcacctgtaatcccagctactcaggaggctgaggcaggagaatcacttgaacctgagaggctgaggttgcagtgaaccgagattgctccactgcactccagtctgggtgacagtgacagtggtgacagtgcctgtcacttagtaaagtgactgttggttggttttttgttatttttcttttaagacagagtctcactctgtcacccaagccggagtgcagtggcgcaagcatggcttgctgcagccttaacctcctgggctcaggcaatcatcttgcctcagcctcccaagtagctgagactacaagcatatgtcaccacacccaactaattgtttaaacttcttgtagagataggatctcactatgttgctcaggcttgtcttgaactcctggactcgagcagtgttcccacctcgaccttctgaagtgctgggattatagctgtgaaccactgtgcccagccaatttatttttcctttaattttcttagtattatatgaattttaaacaagttgacattgaatcatttttgaggaaaacatattttaaataaattctagcagccagatcacttataaaataaggtaagttgaatatttacctaataaatgcatacagagcacactgtgccatctggctccagaattctcaccatccaccataataccatagtctgtttcaaaagatagagtggtgggctttagttccttagacttggagttcatttgacatatgccttaacgttattattggtgacctctcaataggataagaggagaagagcagatacatacttcattcttcaactatgtgattctttttcttgatgtaccctatccatgtgaatataatcctttttatttttgctaatttgaaaggtgaggaataacatctcaaggtttttatagcagttctagtattaagggagcattttttttcacatttattagccattgaattctaagaaaaacactgttagccttatttgttgcagtcattgtttcctcagtcaactaggaatgtgtgtatatttgtagtgaaggagatgaggaaaagaagctgctattaatttgataactgtcataaatttttgtttttaatctttttgggttttctacttgctgagagtgttttaatcataccacagttttcagagtccttttataattttagataatctccctcatatggcctctttctttaaaaaaaaatccatatctcctttctaatttgattaatccttttttctttattaggtttgccagtaatttctctatttatgtactttgttctttttttgtaaattctttatttttgatcttatctttattatttgctgttttataactttggtgttcttttctaaatttttgaggcaaatgttcctctcttttaacttatttgtctaatggagttttttgtttggttggtttttgttttccaagaagttgagagttttctggttaaaattttaatattgaggcatagtttacttttctctttctttttaatttaaaaaatatttccttgcagctgtttatagataaaaaaattctataaatattttaggtaaagtaaaccgtttcaattctagatggtattgattccctcccatttacaagctacatatgtaggtttccatagtttctcccttctcactcttcactaccttccaatatttttatattatgtttatgttgtcaacagtttgtgatatttacattgtcttcagaaatcataattcttacaattgtacggtcttagtttcatatttaaatggattcagtgcccatttcttttattgcagctttttcattcttaggttatctgtactaagtctagacacttaattggctggattttatcagtaattaagttttattaattgggcttttaaaattttttagatttacagaaaaaattgaggaagaaatgcagagtttccatatgtcccctttgcccctccaatttcccctgttattggcatcttgtgttagtgtggtatatttgcttacaatcaatgagccaatattgacacattattattaactaaagtccctagtttacattagagttcactctttatgttgtacattttatgggttttgacagatctttaatgacatgtgtctaccataacagtatgatacaaaatagtttcactaccctaaaaattccctgtgcttaacctatttatccctccttgccctccccacaagtccctgacctttttactgtctctgtagttttattttgttttaatagataaagttttgaatttattgaaagtttttttataatatcctcttactttttcaatgtctgtggaatctgtagtgatatcccctttttcattctttttctttttaaaaaacttatttattttattaaggtatggttgataaatagaaattatacatacagtgtacatggtgctttgagatatatatatagtaaaatagttaaatcaagctaattaacatatctgtcaccttacatacttatcattttttgttatgagaaaatttaagatctccttaagtaattttcaaatatacagtacattattattagctgtagtcatcatgctgtactatagatctcctgaacttactacttatcctaattgaactctctccacagttttagttttgccttttccagattttcatatagtttgaataatacattatgtagccttttcagattacttcttttggtggtgagtatttaaaacaacatttagggataacattttactgctctgtaatcttttttttctcttttagctgccactttttaaagtgtatgattttagactacaccccttcacttgttcaccactaccacagttttttgctggtttttactatatttgggttacttgttaagaattgggggagactgctctgggcacactacctgtagggtagccctgctctgcaaggagcaatacaaaaaaagaaaaataaatttttaattaaaaatataaaattatatattaagaaaaaagaattaggggaggataattctatgtttcgcctcttctctgccagatttactacaagtcatctcactgtgttctcttccttcctctttcagcctctgtttgtcttttctttttctttttttttttttttatatcttctttttttgtttggggcttttttactttatctgtttgtctcgtggaccaatcaagttttggtgcttctttctgtttctctttatttataacaatttttgctttagacatttattacataaaagttcttttttttggggggggccaattctgtcacccagcctggagtgcagtggcatgatctcggctcactgcaacctccacctcccgggttcaagcaattctcctgcctcagtccctcctgtagctgggactacaggtgcacaccgccatgcccggcaaattttttgtattttagtggagactaggtttcaccgtgttgcctaggctggtcgcaaactcctaatctcaggcaatccacccacctcggcctcccaaagtgctgggattacaggtgtgagccaccacacctggccctacataaaagttctatactgtagtgttcactgttatgagcatagaattaatctcatgtcctttttcactttttaatatcctatcctcgtagaacactgtgctgcaactgcgttagaaaaatttgcagtcttgatcttctctcagtaaaattagtggtagtaggcctggcttagtggctaacacctgtaatcccagcattttgggaggccgaggtgggtggatcatttgaggtcaggagtttgagaccagcctgatcagcatggtgagaccctgtctctactaaaaatacaaaacttagctgggcgtggtggtgcatgcctgtattcccaggtattcaggaggctgaggcacgagaattgcttgagcctggaggtgaaggttgcagtgagctgagattgtgccaccgcactgcagcctggacgacagaatgagactccatctcaaaaaaagaaaaaagaaaattagtggtagtagagaaaaatctagagagggcaacttcaagggaaggaatgaagttgaagtttatgagaactcactcagtgattcagtctcttccgggagaaaagccgaagataaagaagttgattgaagtttgttaaactgcaaattatcaatatgataaactctaccttatttattaaatctcagaatgttagaacaaaaggctaatttagcttcgaagtccgaagaagatagatttcattgaactaaaaggaaattcagcttcaaagttagatcaaatagcacgttagctaggcatcgttttcctctcttctgcccctccccagtctccatcccaggttagttactatgtcttagtgaaatgttcccactagcacccaggtttatagctatcataatactttcatatcttattttaattatcaaattatctgtcttctttgtgagactggagtctccttaggatcttttccagtatgttattcacaatcctcaacatatagttagcattcagtgaatgggggttagcgtagggaagagtacaagtagacaataaatgtatataattcatttctattggaaaaacaagattaaagtatacctggcctttttttcagatgaaaaatttaaatacctatagtggagtattaagaaaatctagattatttggttgaacagtagaaccctgattcttataaaaattaaaatgctgcttggtttagtcaagtcaagtcagtgtttggttcttgactccaagcaaaatgtgaagatgcctataaaacactgagatcaagagaagagaaatgtaagcaacaggaatccacattggaattccaattaagaccctgattaggcacagacaagccccatttttataggatatattatttaaatgaagattcttgcatttcaaagttctgtgatccagcactaactctgttaccatctagcgcatgggccaaatctgataatggtgtattttgttttgcctgcctaacaaaatttgcaagattttggacaaaatccatagtctacttttaaaaacaaaatgacctagtgaccctggacctacactgtagtaagatgttccctttaaatagaacatgtgttttccagtttgcttcagttttaaaaacaaaatgacctagtaatcctggacctacacccccagtaacaagctccctttaaatagtacatgtactttacagtttgcttcagtccccactgctcccagcccacttattccttatttgtttacttgacttgttcctaaaggcatttgagttggtaatccctcatagcctcctagaatctcagccttacaagggctcaccagctctccccaactgatggcttggatcttagctctagttcactggctttcaaactttatctgcactctagaggaatagtctagggcagcagtccacaacctttttgacaccagggacaggtttcatggaagacaatttttttttctacgacgggggtggggtggtttcaggatgaaacttttccacctcagttcagtaggcattagattctcataaggaacgttcagcctagatccctcgcgtgcgcggttcacaataaggttcacattcctatgagaatctaatgccacagctgatttgacaggaggcagagctcaggtggtaatgctcacttgccctccgctcacctcctgctctgcagccaggttcctaacaggccatggacaggtctgcagccccaggatttggggacccctggttccaggccatatattctcccagcagtccaaacttctgattaaacagaagcagctctgatttcattcctttacatattgtgtttccttagaaaaatttcagttagggttagaggttaagttttcttttgtaagtggtagtgctctcgttcaagtgttcaaattcaacccctcattttgctaatgggagaaaaggaattagaaataaagtgttttgtccatggttacagggctagttaatgtcagagctcctcccaccaatttaagtggcttaataattcgtagggtaatgctcaatgctttcgtagatttttatatagctgcatataaatcttcataatttgtaagggatatttctcaaaattctaataatgtttatgctgcttagcacctaaaagaccaagagtcagaacatattctttactgttttatataaatttttataaatgtgtaagtatattataaatatgtatttgcatatgattgaagcggaaagagtaaaactaagcaaactatctatgcttgcctctgctatggtgtgcaaaaagtatatactaaaactttgctttttattaacacatgaaaagccaatatataatgcagattaatacttaatttagcatcacagttttgatacccttcaggcctagtttttgaaaaacgcctgcctatagagaaagtaagtctagatgtgtgctaaatccagttaaaagtacacttccaattttggagagcctggataactcactaattccaaggactgcatattagactgcacatatgaattgtgcttttaaaatcatcaccagatgtttccctactgcagcacttacaaatctttattattgcctgggtgtagtgcctcacatgcttgtaatcccaagactttgggaggctgagtcgggaggatcatatgaggctaggagtttgagactagcctgggcaacatagtgagaccctcgtctctacaaaaaatttaaaaatcagccaggtgtggcggcccgcacatgtagtcctagctactcgggaggctaaaagaggaggatcccttaaggccaggaggtcgaggctgcagtgagccatgatcgtgctgctgcacttgggtgcagtgtttcactctgtcacccgagcttgggtaacagtgagaccctatctctttaaaaaaaaaaaaaagaaagaaagaaagatatcgttattattgtcctactataataataggacaatactattattgttcatggtttctctctttttctacaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaaggtatgtctgtgagacctcagctttgtagtatttcctgttcaccgtatcttattcatatttaccgcccacttgcaaggatttccattaaattttaaagatgagttaacatcttataataacattttcccttcaagttgaatcgtcacctttttgaatggagtgtgtcattgaaagttttgaaaagcatatctccttactagctgtgtaacttcaagtaattagttgagaaagaatggtgagagagggggctaaatataaacatacgaagaggctttatataccactctgatgaattttatttaatactaaagcctgggaactgtcgaaggatttcaaatgataaatgaacatgagatttccatttagaaagatctttctggtatcagtggaaactcattacaatgctattgcagtagtctgggcaaggaagaatgcaaacctaaactaaatcttccagagttatctgatactcgagtggttgatggaagaaagaattattactaaagggaaaaagcaaaataggaggatgaccctttggtagaagcaggaaacaagaccaactgtgaggagctagggaatctgatggaatgtaactgctgacttaagtcagaaatttaaggcactgcgtgccctgtcatcacatttgtggtcatatttttttaatggagtttgtgtttaggtctttcttagtcctgtgacttgatgattcatcttcttgttctttaaaagtcaaaaggctttttgacctttaaataactcttacatctggtcatcactgttgaaatgttctactaaattttcagagtggaaaagttttaggcttaaaactgactggtaaaaatagaatatttctttgtattgatttttcagtatagctgtacagccagttatccttcgttaagtgtttcggtattaaaactgctcacatttgtaaatattgagcagctttattgtcagaacaagaatcccttggtttcccaatccccaacttttaacattgtaattaaacatcctgtataacctattttattctctgccaaacaattttatgactgctgtttttactctttgtgatgaaaatgggatggagaagataaggttctttgtccttatggtggtatttattatcatcctccatcaatgcagattgggtaaatagagaaaaattcaggccgggtgtggttgtgcacatctgtagtcccagctgcttgggaggctgaggcaggagaatcgcttgaacccaggagtcagaggttgcagtgagctgagattgcaccactgcactccagtctgagcaacagggtgaaactctgtctcaaaaaaaaaaaaaagaaagaaagaaagaaaggaagccgaggcgggtggatcacgaggtcaggagattgagaccatcctggctaacacagtgaaaccccgtctctactaaaaatacaaaaaaaattagccgggcatggtggcgggcacctgtagtcccagctactcgggaggctgaggcaggagaatggcctgaacccgggaggcagagcttgcagtgagctgagtttgcgccactgcactccagagcctgggcaacagagcaaaactccgtctcaaaaaaaaaaaaaagaaagaaaggaaaaattgagaccaaagaactttaaaactggtcactaggtaatgtgaagctgactttctattaggctcatgttacactcttacaaggcatgattatatatggtgtggaaattgtattcaggctagtgtaagttactagtctggtacaaagaagggaaatggcagtttgtatgcaggatagaccatcaaatgctttacaaaggagagaacagttgatctgatgctcacaccatgaataggacttacccattgaagcaggttggtttgttcataaagataaagggatgcccattcaaaggcacagagattaagaaaagtatagagaactgcaggtaattctgtaaagaacctaaaaactaaatcagtaaaagtagacatggctttcagagaggagtcataacatagttgaacatacagcctgcattaaaactttggtctccttttgtatccgtatgcctgtggagagcacagagtacttaaagccaatgttattttaatggaatttcttcagatgccgaaagttcagtataaatcgaactgtaaaccatccacatttgcatatcctgcccctctggaagtaccaaaagaaaaagaaaaggaaaaggtaggttctttgttccttttagcagcatttgtacttaaatataggagccactgagtattttactttttctttaactatcttttatgttttaaaagtaacacttcttatgctaacatttgacattacacaagaatatgaagtgaaagtcctttttgtctcttggtcatccaagtctcatgtcacaggagtcacaacttctgaatccctctgaaggttttctctgcacatgtcagtactttttataccacgaataaaattattctctacatacttttctgcatcttgttttcacattaactatatttttttttatttttaaaactttcaatgtatacagatctcattttttcccagagctgcaaaacaatgcctttactatgtgtagtactgtttgttttaccagttttttctttgatattcatttaaggttatttctcatttgttagccctacacaagtgagcctggaattgaaagtctttatacacatgtatttgtgcactgtgtgagtatatctgtaggttagaatcctggatgtcaggttacttgatcaaaagtaatgcacattatgttcatagttattaactaatttgcctttcaaaatggacataatcactttatactcctaccaactgtgtatgaggacactcctgtattaaagaataatacattaaagagttgtacttgcccataaagttttactcagtaaaattatactttttttgataccttatatataggaaagtggctctttctctcataattttcatattggccagttgttgattatttgctgtaaattttgtgtataagtaaggataattaaccaaatttgagggtagcagttaaggaatagccttgacagcatcttgtttcatcagctatgtttcagaccctcctttgggtctgaaacaaagtcagcttttacaccagtattgcccagcttttcacctttgttttcagcaagacccatgaaggagaataatataggctaaccactcacccactgtgtattagcattgtaagacatatagtccagagaggatatctacaaccagcgctgaaggaaattgttctattttccattgctttcctgtaaagcaaaaaggctatagcacccaaatctcaatcttggaagtacatgagagcaaattcatatccaaggtaggctacagatcaaaaaaaagggaagagttatattggacacaagcctccaagaactaaagattcacttgatgacaagagtagtaaattatttcagtaaatgtcctgcttagttttcccatttattctttgatttatatatatttatatatatatatatatatatatatatatatatatatatatatatatatatatatatgtaatacagctaggaaatagaatagtgttgtaggactgagttctctagggcttgcatgtttgtatgtcagtaagggattacaacagtttaccctgctcatttccccaggtttctactgctgtattatctataactgccaaggctaaaaagaaggaaaaagaaaaggaaaaaaaggaggaggagaaaatggaagtggtaggtataaattggtggtcatatggattgaagtatctctgtctctgtcatggtcgagattcttccttagttgaatattattctaccttgctcttggcttccttcaaacaattatcctgttgccagcatgtagaatcatcaaactgtacttgaaagagactcgaaaatatatccatttgtgggaagaatagaagggtacaaatcagtaaaaagttcctggagcaaatgacaactaaaataggttttgaagggcaaagtaggtttttcacagacaagatgatgaggtaggagaaagaaaaaccctttcaagcaaagggattatcacttgtttaggtagacctttttctgatctctgctggtagaaaaacctttttaatcctttaaaaccaagtcaaataccattctcattcctaagcagagttacttttccctcctctgagtctgatagcactttagttgtacttccattactaccgaccactacctcttgtaccttatagctgctcagtcaacttcagatgttactcagttctgtggaacagaaatgaacttctgttgaactttttttaaattttattttataggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccagtaagttaccagtgactcttagctgtatataccagtgggatattaatccataggacaatagaatattgatagagaatgataaatctccaaagcattggagcaagctcactagttctaagaaattatttaacaaaagagagaatgttcttttccatttcatatagatttgggagaatttttcttttccctgtgtaaccctacaaactcccgtcttctaccacagacatacgacgtaggagttcctaatacaacaatttgattaggaatatagactctacagccaagcatacaggatttgaatcttgagtatactgctcaggctaagtgaccttaggccaggtactaaatctctctctgcctcagttttctttattataaaacagagattaccatccctgactcagaaatgaggcacagattgaacaagcactgagaacaagacttgggactgctcaataagtattgattactatggtaattacaccgttgtcttttttttttttctatttcattacaccattgtcataaatgcattgcattttagttagaaaaggatcttcatggaatttaatttattccaagacagagtgcttcatgttaaaaacaaatgcttatcagaaatatgagtgtgatactgcctttatcttccaggttcttgtagataactagagcgccatcagtagacccatccaagacatccagatgctagatctgtctaaaatgtcagagattcgatttctagatccttatccttatacaagagtaaacttattcttatcaacctgatggtgggtcaaaggcaactcctatctataattgtgagtcggggtcttaacctgactaatttatcagctagaagagataaagccaagggatgcaagatagtgtatgtagtggtttagagctggaatttggcataactgggtttttatttctactgttagctgtgtgactaagacaagtcatttaatctttgtatttcagtttcctcatctgtaaaattgatatggtaatgctacctacctcctgttgatgttgtggagattaaataggttgttacatgtaaagcacctaaaacaatggtaaatgctaatctgtagcactgcctgatctgtagtagttgctgtgtagtgttaaatgaatggacagaatcatcaatggatacctttaatgcagtcactgtctgatctgcaacctggttcatctcggtggcggttttacagagaacgtattctaactgtgtctgtaaacttatcttaccagtagcatgggaatccagaacagatgtattaggacacaactagagcatactctaagcacgtgaaataactagtgtttttgataattatgaactaagacagtgaggcacgtgctcaatgccatgaggccatatgagcacactgtacaccacagtagaaaactaaatgattgctaagcctttgctcaaattaagtcagagatagctataacagttggtccacctatgaattaaaagactgcctatgtctgtgcaaggaagaaatgaggaatcctgttgaaggtatagccctacacacacacacacactccttcaaagagtgggagactttgtgttccaaagtgtttaaggaaattcctgtccagttgttagctgactactaagttaaatgagcattgactttagtggacacacaaatcagggaatacaaactttatagaataggagaaaatattttcaaatcatttatctgataagacagttacatctagaacatacgaaaagctcctccaactcaacaataaaaagacaacctaattttaaaacaggcaaatgatttgaatagacatttctccaaagaagatgtacagatgggcaaataagcacatgaaaagatgctcaacatcattactcattaggaaatgcaaatcaaaaccataacaggtgcagtggttcccacttacagtcccagctacatgggaggccaaggcaggaggattgcttgagcccagtagctcgaggctgtagtgcaatatgattgtgcctatgaacagccactggacaccagcttaggcaacatagcaagatcccatctcttaatttaaaaagaaacacaaaaccataagaagatatcacattctacccaccaggatggctgtaatcaaaaagaccgcacagacaagaatatgcagaaattggaaccctcatagagtaatagtgggaaagtaaagttacagccacagtggaaaaaaagaatttggcagttcctcaaaaagttaaatgtagtcttatcatatgacccggcaattccattccatacctaagagaagagaaaactgtgcccacacaaaagcttacacactaacgctcatatcagcatgattcataatagccataaaacggaaacaacttaaatgtcttatcaactgatgaatgaataatgtgagataataatggaatattatttgaccataaaaaggaaagacttactgatatatgctacagtgtgtgtgaaccttgaaaacattattttaagtaaaagaagccagacgtaaaagactgcatatggtctggttccctttatgtgaaacattcagaaaaggcaaatctatagagacgagttagattggtggctaccaaggacaggggaaggggagaatggagagtggctgctactgggcccacagtttctttaggttgatgcagatatttttgaattagatagcagaagtattaatagctgcacaagtttgtgaatgtactaaattgtacgctttgagagaatgaattttatgttaatatatctcattttaaaaaagaaaacactgcctctgtgtatgtgcagtgactcactcccctaccctcagtggcaaggtcatgggacccttcctcagacactgcatttgaaagaggcagctgtagttttggaaacaagtaacattcctaccctgcttcctgtccaccatgaggcaagaggaagtgtttcattgcctatatctacagttgtaattagcctccccagagaacagaaaatcgtatatcttatgcatagagggtgtgaactttcccaccaacatgtaaagcattaacaaacctagaccatgtatagctataaacagccctttccatgtgttgatttggattattagttttgggatttttttttgtgtgtgtgttactgttgtttttgtatgatgaggccttcctttgattaagttggattatttcattccagttaagcatgaaatagcataacctggatccacattttccaaaaaatagaaagtcctcatgtgaacgtggatattttcttctgtttggtaggagattcatctccatttggtccattaggttcaagtaaacttttaggctatggaggattaggacagtggccctatgctccattctgggagtattggcagtaagggcagggtccattcataaaatggatcctcttcaaggaaagcaaactttttaagggaaggggttgtagaaaaatgtatagatatgtgtgtgtcaggagaagggaaatagttcggagttcacgaagcacaccagttttatagcatggcagggcagagttctgatgagtaaaaattggattaggttgaactgcagagatgcttatacatacgtgaatcatttaactaatgtacttgtgcttcttttccttcccagtaatgtgctttggtagaaatatgctttttccagatgtgccctgccactgttgactgatttaattacatagagcagctttccatttcctttgacacaggcaagcaaatagaataagattagcacactagagaggggtgaatagtttagtgtttgaatttaccttctgtaatatgtttgggagagggcttaatagaattgctgctacagtctacttcccttttgtttcccatgtattttttcatcggcttgcatcacgtggatttatagattaaagtgaaaaacccgggatatctgtgttattctctccatcattctgaaattgctggagaaaaaattggcttttaatttatacactctcgtgttcaaaatgattatcatctcacaaatcatacagtgtgcattagactgcttctcaaacttcagtgtgcatcagattgactgggatcttgttagaatgcagattctgcagatctagggtggggccagcttttctgcatttttaacaagctccagatgataatgatgcttctggcccaggaccatatcttgagtaggaaggaattaggatactatatttggacagtaaacattcttcctgcagtgagactgaggctggtagtcaaggccatggctgggaaataactattcttaaattgggatgcatcatccaagtagaacagcatcacatgttataccatctagagctactgggttaagtttgcaaatacttcgtatagatcacagttatctttatcccagtaaagttctactccagtttttcacttccaaatcatttaagtagttttaaagtaccatttaacaagtatttactctagattgtggagcacgcttgaaatatgagtgtacgcttctgcacgcccctgtgtttccagctctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggtgcgtgtgcaacaaaattatgaagggaaacttctttgtcaatacttcacaaatgttttttgcaaggacatcatctcacgtttttccttccttttgtgtttaatccttatttacctaaacagtattaaaacttccccgtttcaacctttttctgcatatataaccacaaattcctttttctttcctctttgactcgtactctactcacgttattcaaagtggctggtctgcaaactatttttataggtccataaggagataggaagcttactccagaatctgtctgctcaacgcttctttcatcaagaaagtcttccccaaaacatcagctgaactgcagtttgcttagtgatagagctgatttacattctgatgtaagcttcttgttgtggatcagttatagttgtggactggcactggcccataggtgacacttttgagtagcacaaatataggcttctcactgatttttctctctccccatctccttcgacagtatttttggcatagaagccttaacattcattcattctatgatggtgctattgaatatctactgtgtataagacatagtgcttatagggactttgaggtcagttagactaaccacaaggctgtgtccattgacaaagatcatttactatatcagtgtcttaacagtgttgaaaggggtctttagatgggaaagtttggagtaatctaatttcatgaaattgtcgttcttcatttccccattttcttttgagtgttcatcacatatttgaagacattgtgagacataatcaaggtttcctaattccacccaagcacaaacacgttttcagacaatttttttttttttttttttttttgagacggagtttcgctcttgttgctcttggctggagtgcaatggcgcaaacttggctcaccgcaacctccgcctcctgggttcaagcgattctcctgcctcagcctttcgagtagctgggattacaggcatgcgccaccacacccggctgattttgtatttttagtagtgacagggtttctccatgttggtcaggccggtctcaagttctggacctcagctgatccgcgaacctcggcctcccaaagtgctgggattacaggtgtgagccaccacgcccggccaattcattctactctttaaaaaaaataaggacagtatcatttgttatatttaaaggtctggttgcaaatctagcatgctgtgtgttagatactgactagcaatttaggaaagatttgcagaaatctcagataaatattaaggtagaaacctgccattagtaggaaaatatatttatacctcaggaagactattagtttgggccttagagaaaggcagatttatactaaccttcctattttctaaacttacttttgaaaattatctttcagccttgatagtttcctaagctttacccaacttgcacagtacagcgtaggctatcatgatcactcagtctgtctgagaattgaggtgactcacgttagctcccatcaagcctttggcaatacctcatggaaaacccttgattacagctttcaaggcagttaattacaaaatgacttagaggtttatagctggaaactggaatcttgttagttttcaaaggggtaaaatattcagtccattaggagtttggaaactataatctgtcgtggcacaaactggtatattaggactgcagaggcagggttggggcctagttttagatttcaacagttaatagtaaagaggaaaaaaaagaatgtcttgaaattaagaatgaccctagctactactgttctttcttccctttcccaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagatggacaag

SEQ ID NO: 35808 - DNA, 12804 bp, Homo sapiens
ggcggggcctgggcgcgccgagctccggctgggtccctgcaggtcttggggcccgggactcttcctggagacaccgccatggccgggctatcccgcgggtccgcgcgcgcactgctcgccgccctgctggcgtcgacgctgttggcgctgctcgtgtcgcccgcgcggggtcgcggcggccgggaccacggggactgggacgaggcctcccggctgccgccgctaccaccccgcgaggacgcggcgcgcgtggcccgcttcgtgacgcacgtctccgactggggcgctctggccaccatctccacgctggaggcggtgcgcggccggcccttcgccgacgtcctctcgctcagcgacgggcccccgggcgcgggcagcggcgtgccctatttctacctgagcccgctgcagctctccgtgagcaacctgcaggtgagctggggcccgcggcttccccaggcgggctgtgggcggggcggccacagagcgagccttcactctccccagaattcttcccgggaagtggagcgtggctcgaacggctgttgcttctctgccgcgcaggcaggtaggtgggcgttgcagcgtcccagatgttgggcagctgggtaccaggaatttcccacaagcctccgccactgggccacgcacctggggtaaattctctgccagcagcccgaggacttctcatccgtgagtggttctcagtcgtcttggggcccagtgtctctattaactgtgctcctattctctttttttttttttttccctttgagacagaatctcactttgtggcccaggctggagtgcagtggcgctatctcagcttactgcaacctctgcctcccaggttcaagcgattctcgtgcctcagcctaccgagtagctgggattacaggtgcgtgccaccacacccggctaatttttgtatttttagtagaggcggggtttcaccatgttggccaggctggtctcaaactcctgacctcacgtgatccacccatctcagcctcccaaagtgctgggattacaggcgtgaaccaccgcgccctgcctgggctcctattcttaaaggttttacagggcatagagattgttaggtacttaagcactttaatatgtgacttcagggtttctcactctcttacccttcctgaattaagcttttccctcctgcagcaagacgctaacgtacaatatcatggacgattacaatgattactgcagtctttaggcctccacaggcatagtggctcctcagtaagatgcagagctgattgaaggtgtatctcttcctcgccctttgcccaccttctggtgcagggccacacttacaactctgatggatctctgctgtctcagggatggggtcacagacacccagcttgggaggccggagacacacagagtccaggaatggagcctgatttgatggagggtctttttgacaaagctctcacatttgagttcaactctgaaagtacaacattgttgataaagacaggatgcaagaaactgatgcttgattaatcacttttccatttgccttccattcgttgtctcttctattaattctttgaagtaggtattatataccccattctgcagatgaagaacttgaggcctacctaggttaagtaacttgtttaaagccagcgggcaaacccctagtttcatctcaggttcatctttcttcaaaccacctatcacaggctggtggcccatcagctgaatatgtcccacagaccggtttggcctacacaaagttctgttttgtttttaataaatttgaatttgttaccaacattttaaaatttagattttactttaaaatgtaaatctctaacttttcttgaaaaatgggaagatccagtgacactgtgggcctgcactctttgagcaaaaacagaagcagtgccctcttttagctaaggcagatacaccccagttcaccattttcttattcccagcccattccacacctttaggcgtttgctcaaaacaaactcactccactccatcagtggtgctcaactttgactgcaaatcatagtcacctaagaaggctttaaaaatgggatgccaaggtattttattgaaagcacattttattttaagacaacaccccttcccgcctccccacaaaccactccctgatgattctaatgggggaggagggagattgaccaatacataatcatatttaaatttgtgaggtgactagggagttgctggtattattgtccccatttaggaagtgaggaaacacagactcagaggtgcagggacttaccctgtgaccagtcagctaatggctgtcaggtaggacattagcccaggtctttcatgtttctagaaatagacagggcagtggcaaggaacctacccagggctttaggtttccatgatggcagtgaaaagaagtggccacattagaatttgtctgacttgattccatcaattagcaggtcaaagtttctgcttttttcttttcctcctcctgacctccagggtgctctgcatttcttctcattgacagggggtgaaatcgttcagaaggaacaaaaagacctaggtttgggaccatttctcatgtgtaaaatacctgtcctctgtaacttagagatatgttgtgagcttcaaacgtacttaccactgggctgtttcttttgtatgtctctttctttgtggcatttttgtatagtaaatgtctgtaggacagtgttgctgatgttagcttatagtgggaccgtgtttggctgcagagccagtgagtctgaagggaaatcttggggtttgattatttgcaccaagacctcttactattagcctcccttccattttggcattcttttcttgtgatgtgcccctttctgttctggtcactcttggttttttttctctgacccactaaaataagtatccctcaaagtcagtttcctactcttttgttccctgcagcgatcctcagaagattgtatacactctcgttgtatacattctcttctagtccttactaggactcacttccagatgtgtgtccatttctgacctcttcaaagttctctatatttctgcttgctgttcatttttgcttcgttactttgccaccacttcaaattcaacatgtttaaatccagtccttcttcctcctgaaacaagctgcttttgatcttctgcatttctgttagtggaattattgttttctcagtaaacccagttggttctcactgcctccccaaatccctcagttcccaagtcctgacagttttttgttgccttctttacctctgtccttgccccttcctcttcattcctgccacctcatccttaagcttatcatctcatgcctaaaagtactagaacagctcttacatagtcttcctgtctgccccatccaccttgcctacccaaatagattaacaaaaatacctgtcacagcattgccctctggccagaaacctttaacaatacccagctgcctatagctgcgtaagagctacctgggatgtttgtttaaaatgcatatagaggcgggtgcggaggctccagcctgtaatcccagcactttgggaggtcgaggtgagcggatcacctgaggtcaggagtttgagaccagcctggccaatatggtgaaacccacctctactaaaaatacaaaaattaactgggtatggtggtgtacgaccgtagtcccagctatttgggaggctgagttgagagcatcagttgagcctgggaggcagaggttgcagtgagctgagatcacgccattgcactccagcctgggtgacagagcttgattctgtttctaaataataaaatgcagatagaggacagcttggtggctcatgcctgtaatcccaacactttggaaggccgaggtgggaggatcacttgagtctaggattttgagaccagccagggcaacacagtgaaactccatgtctacaaaaaataaaaaaatattagccgggtgtggtgatgcacatctatagttccagctactcaggaggatgagatgggaggatcacatgagccctggaggttgaggccacaatgagccatgattgtgccactgcactgggtggctgcctgggtgacagagtgagacactgtcttaaaaaaaatattgcaggccaggtgcggtgtctcacgcctgtaatcccagcactttgggaggccgaggtgggtggatcacaaggtcaggagttcaagaccagcttggccaacatgatgaaacccagtctctactaaaaatacaaaaatcagctgggcgtggtggcacacaccagtaatcccagctactcgggaggctgaggcaagagaatcgcttgaacttgggagttggaggttgcagtgagctgagatcgcaccactgcactccagcctgggtgacagagcaagactccgtctcaaaaaaaaaaaacaaaaaaaaattgcagttatttgggttgggagtgaagcctgtttcaacattttaacccaaatcagcattttatcaagctctccaggcaggtggttcttagaaaacagtgcctaaggttggcccacaaattacaatctagactccttaacttaggttggagccctctccactcccaaccccaggctcctcccgtaggaaagcccttctttccagcaaatcaggtttcttggtactgttcatcaagtcttaggctcacccagttctgtgttttttgcagtcagtgtctcctctccctttaatatgtcctcccaccttctatcctggttttgaatatattataaagctccttacagttcctctatcactctggtctatgctggacatacacatttgtttatgtctgccttttcaaccagattataaactcacggagggagagagtttacctgagtgtccccctccccttctttggtctcctgtggtgccttgcctaatagtttctagacagtgactatttggctaaatgatttcaaagaaatctctttatgactctttgttttgatgggtcagtgtgaaatggcaaaattctccacacaaggcacttagagcttaaagagctaaatagtctaaaatgcgatgtgtgaattttgctataatctgtcaacagtgccttttatgaagttgatttctgaataagaaagcattaagaattttacttgtgttactttttgaatgtgggataaaactcattgttactaaagcaggaatgaacaacttctccagttttgaaatcacatgacagtttctgctaatgtaagataaccaagtagcatgattcagctactttcttgcttaaatcgcgtagttagccaattgagcaactgtggtgtttttagcaatggttttgtatagagtttaaccctttaaatctttcagtgaagcctatagaacagccttgaatttgggtgtcactataattataattcttctgatgaatatggaataaattcagggtttcagaaaaagaatattgaaataatttttaccaagtcagttcattttaaatatgaacccccgcaccccctttggggagtggtcaggatactttccaagtattattttcccctgagtggaaggtgatgttttatgattcattgtttcgtggaagaccagtcaagctctagggacatcatgtatgcaacttttgaaatttattacctctccagaaaccatatttcacatgagaggatcttcattttctctctataggagaatccatatgctacactgaccatgactttggcacagaccaacttctgcaagaaacatggatttgatccacaaagtcccctttgtgttcacataatgctgtcaggaactgtgaccaaggtaagtagttatcctacaggaagggagatggtttcagaacaccatcgtattcacaatgaaagaatagatcatttttcttttgagacagagtctcactctgtctcccaggctggagtgcagtggtgtgatctcggcttactgcaacctctgcctcctgggttcaagcgagtcttgtgcctcagcctccctagtagctgggattacaggcacgcaccaccacacccagctaatttttgtatttttagtagagatggggtttcaccatgttggccaggctggtcttgaactcctgacctcaagtgatccacccacctcgacctcccaaagtgctgagattacaggcgtgagccactatgcctggcagaatagatcttttcagaatgaaatgcagttgatttgtgattgccatgcccagtcagaacatgttctattctaataggtgaagtaattccatgaaaaccaaacgttttaataagttgctttcatataggtgttaaataagatatgacaaaaatgaatgattttctgaagccaagcagatgtaacaactatgaagctcctgtatataaagttattcttactaaagagcatctggttgaccaaagccctctactctccattacattttacattggtataatgtttttccatgtctgggctccttgtctccatattttaacagtggcttaaagcagagaaaacatattaagtaggccaaccagaggactatccattactgaaaactggaagtgaatttagtttggatcacctgctgaagggaagaggtcaaatacaatctcaggaagagcagtgggcatggtgtcaggagtgctgatctgattacccagccagcagatttgctttttgaccgtgtcaatcattaatgcctcagacaagtgttatttatggtctgtaaattctttgtggatgcatctctgtagttgagtgtccttcactggcaggaaaaagatggaggagcagcacatgcttttgagttctgttatgtggtttctaaacatttttatccttcagtacattcatctgtatgtttaacatgtccatgttatgggataaatatgctaaacattacatgtcttaggcaccagtaatgttacagtacttagtgctagttattctaatagctcaaaatgcctttttaccaatgaaagttggtattatacttacagtggtttcccacttcgtggtatctgttattaccaacaattgaaatctttattctctgcattctttacatttcctttattttctcttgattccttaaggttaagatcaagatttacaagtaagtaaactcttaggatttatagaatgctagagtcacacattcttttttttttttgagatggagtcttgctctgtcatgcaggctggagtgcagtggcacgatctcggctcaccgcaagctccgcctcccgggttcatgccattttcctgcctcagcctcctgagtagctgggactacaggtgcccaccaccacatctggctaatttttttttttttagtagagatggggtttcaccgtgttagccaagatggtctgagtctcctgacctcgtgatccgcccgccttggccttccaaagtgctgggattacaggcgtgaaccactgcacccggcctaatcacacattcttaacaaatgagaagataaagtgttactgccataagaatgtttatttcatatatgtcctttaggtgaatgaaacagaaatggatattgcaaagcattcgttattcattcgacaccctgagatgaaaacctggccttccagccataattggttctttgctaagttgaatataaccaatatctgggtcctggactactttggtggaccaaaaatcgtgacaccagaagaatattataatgtcacagttcagtaagtacttacacatctttcacctaagattgccgcccttacagccatcctcagccttctaaggcaaggggggtttaaccgtttcatgtgccctggacaccctgggcagtctggtaaagccgctgaccccttctcagaataatgttttaaacacataaaatacagaggattaagaagaaaatcaactataatgaaatacatttatgaaaatatttgtaaatgtgtggtataatcgttttattaatatattaaatataagatctagtaataagtctattactttttctttttttttcaagacagagtcttactctgtcacccaggctgagtgcagtggcaccatctcagctcattgcagcctccacctactgggttcaaacgattcttatgcctcaagcctcccaagcagctgggaatacaggcatagaccaccacacccagctgattttttgtattttcataaagagggtggtgtcgaactcctgagctcaggcagtctgcctgcctcagcctcccaaagtgctaggattacaggcatgagcgaccatgcctggccttttctgtgcttttaaagtagtgaggattgaagacaatattttaagacatctgcaacacctgtgacatgatatgaacgtatctgtgatttctctatttctgttggagacagtcacagataggctgtcaccctgtggtttattccctacattcattattgaaggaaatgatacattcagttagagcctaatgaaaatgaaaaaaaaatttttttgagccaagttcgcagacccctgaactctgtctacaggcctggacaccaggttgagactccattttaaggctgtgcttattgggccctgaacagagcccagttatgacccacgatggcattttctcatgaggcttagactcaggtgctcctggactgtgaatgcccttcatctgagtctgagcaagtaaccccatcccatcagccccagtactacaaatgcctatggggatgtgtggtttatcccactaagaagtgcatggaagggaggaggctgagataaaagaggccatgggagaaaataaagcccaggacctgaagacagaaagggaaaggaaagaagagtgtaactggagtctttggagttagctaagggttcaaatgagggaatacaagggactggtgcttctcccaggtgacacagggaattctggcatatctggggaggtgataagaacagtaacaataacagctagtgtccattgtttattactggctgggtgctatactggctacttttcatgtattaactcattcagttctcaccacatccctttcttgcgcaaccttccaccgcaacaggtaggtgctgtttttccacatgtgtgaaatggaaagctgatgcacagagaacaaactggcctaaactgtttgttcttgcagccaggaagtggtggtgctgggactcaaacccaggcattcttgctccagagccatcacctgacttctatccatgatgctgtacttctcctctggctgcctcactggtagctggccaggctcctagctcagtgtaatttataatgcactttctgcttgtaatgattgactgctgtttcaggagattacggtgatgataactaaggtagacttgtaggttgtaggtcatttgagggcttaaattcttagcatttatttaatctctgtctttttcaattgtagaacaattccgtgttgaactattgactccctaccatgattggaaatctcagttttgttttgtttctaattttttttaattccaagcagggcctaggacagtgtgtgtcatagagcaggtgtttaggaatgattgtctggctcattacttgagacaaacactctcacactctgttggaataaagaatcccacagtcctggcgcttgttttgctgctgtgcatgcaggagaggcacgggccactggtcgtcttctgggctggcaaagccatctgacttcataggaatatagaggtagcaattacaactttattccctggcaacaaattatcaggatgactgttaagaagggcctgctcttcgaagttaaagtttactttcacaggacataatctctaaagcgcagttatctttatataaataacatgcccaaaggcagtgcctggtttaataacaaaataaaactgttttcccataagtctccacactgaataagtgagtaaaacagatacttttgaggttcccactttattatgctgacaaaggagcacttctctgcagcacagagatagaacatttttcccttgtcctgagaggcggcccaaaggctagagcagatgtgactcttctgaggcagtgcaccagaacccgagggatgggcagggcctgaaagctgcccgctctgaccgggtgcctctggctaggaattgtccatctccgagtctaggagtgcccccactaatcccacccgccaggtttgccaccagagctgtttaatagtccggggagtgtacagtgatatctgtgaggaccagggcccccatcttcttggagaaccacccacaggggcctcacaggcgttctggagcttccccacattggcagccaccttgcttggcttgcccagatcggttttggaaggtattattcctccaaataccacgaagccctctgcatctgaaatctgtttcacacagatggagactgccacttgtgagagctgatacggagcttaactgaatgtggtttgcctcattggactgttgggtgaagcccccatgagcatgtttgcatgatcagtggaaggcttaaatgtctacacgaagcatttgctggcaccctggaataagcagttcttttttttttttttgagatggagtctcactctgttgctcaggctggagtgtggtggtgcgatctcagctcactgtaagctctgcctcctgggttcatgccattctcctgcctcagcctcctgagcagctgggaccacaggcacctgccaccacgcctggctaattttttgtatttttagtagaggcagggtttcatcatgtcagccaggatggtctcaatctcctgacctcgtgatctgcccgcctcggcctcccaaaatgctgggattataggtgtgagccaccgcgcccgcccaacaagcagttcttataagcataagcattgcttttgaccactgttaagtctgggcagcagcatgtttgtgctaagcctcattttatctcctctggcgcacatccggatatttcctagcaaacacacaggtaacaaaaggtcatggattacagacttgcccagtcttgatacctagagatggattccctggttggtggcagcagaaagggggaaagttcacctcccagctgtggtcactatcactgggcaatggctaatcactgctcttctgccctgatgttcaggaccccttctgttctcaactatttttgtcttttaagccttcagatactcttaaatgagataacaacagcagccacggcagtggcctgcttcttgctacatcctagtagcgtttatcagtgtgtcagaatcatacttggagaggagggttattgctaaaatgaggattcctaggccccaccctcaacctattgaaaccgaaactcaggagtctgcattttaacaaacccaagtggttatttagtatattctagtggttgaaatgaactgaaaatcttaatttagatcagaaattttatctagtccttccctagaatgaattaatttttaagatttgttaacccagtttaacaaaataattcttctctgttcccctttctaggtgaagcagactgtggtgaatttagcaacacttatgaagtttcttaaagtggctcatacacacttaaaaggcttaatgtttctctggaaagcgtcccagaatattagccagttttctgtcacatgctggtttgtttgcttgcttgtttacttgcttgtttaccaatagagttgacctgttattggatttcctggaagatgtggtagctacttttttcctattttgaagccattttcgtagagaaatatccttcactataatcaaataagttttgtcccatcaattccaaagatgtttccagtggtgctcttgaagaggaatgagtaccagttttaaattgcccattggcatttgaaggtagttgagtatgtgttctttattcctagaagccactgtgcttggtagagtgcatcactcaccacagctgcctcctgagctgcctgagcctggtgcaaaaggattggcccccattatggtgcttctgaataaatcttgccaagatagacaaacaatgatgaaactcagatggagcttcctactcacgttgatttatgtctcacaatcctgggtattgttaattcaacatagggtgaaactatttctgataaagaacttttgaaaaactttttatactctaaagtgatactcagaacaaaagaaagtcataaaactcctgaatttaatttccccacctaagtcgaaacagtattatcaaaacacatgtgcacacagattattttttggctccaaaactggattgcaaaagaaagaggagaagaatattttgtgtgttcctggtattcttttataagtaaagtttacccaggcatggaccagcttcagccagggacaaaatcccctcccaaaccactctccacagctttttaaaaatacttctactcttaacaattacctaaggcttcctcaactgccccaaatctcttaatagcttctagtgctgctacaatctaagtcaggtcaccagagggaagagaacatggcattaaaagaatcacatcttcagaagagaagacactaatattattacccatatacatgatttcagaagatgacataagattcctcttaaagaggaaatgtcaggaatcaagccactgaatccttaaagagaaaagttgaatatgagtcattgtgtctgaaaactgcaaagtgaacttaactgagatccagcaaacaggttctgtttaagaaaaataatttatactaaatttagtaaaatggacttcttattcaaagcatcaataattaaaagaattattttaatg

SEQ ID NO: 35809 - DNA, 2428 bp, Homo sapiens
ccccttggttccgcccgcgcgtcacgtgaccccagcgcctacttgggctgaggagccgccgcgtcccctcgccgagtcccctcgccagattccctccgtcgccgccaagatgatgtgcggggcgccctccgccacgcagccggccaccgccgagacccagcacatcgccgaccaggtgggtgggccgcggggacggggccggcccggagtcctgccttagcctcagggcgcggccgcggctcctggagcgaaagaagccgctttggccccgctgcgcacccctgggctggcccgggctgtggccgtgagaggcctccctccgctcgggcgctgcgcgcgagtgagcagcggggggccgcgcctggggcgccgctggggagacattgggctccgctgaatacagcaagggcgagtgggaattgatagcccggagcagggtgcggtccctgcatggacagtctctgagaggaaaccccagggatgaggcgcttctggtttcaggcaggcagggtgatcgggcgtcgccggcgatggcgcaggtgagcagccggctccgatctccacggtgatccgatagcaagcgggtgggaagggtctggctaaactgacttagccaggcttcttgctaaaagtggattttacaaggaagtgcgcaggtggcctaggcgcttcaggagcccgactacagtttggccaagcaagaatctttgtcaatatcctcatctagttcgggaaaaaaatcatgagagagagtgcaagaggtccccagtgataaggcacatgggttaaaaacttaagtgtatctgcataaaaggtccacaggtttctttacatgcttccgattctagcactgtttcaaactgtaagtctaaataaaaagttaaaacacagaaaaacaagataaaaaccgggctgggttgcagatggcaaccttccctgtgtctcggtttcctcgtctgtaaaatggacgtcctgttgctctgcgcctgccagaagattctggaggggctgaaatgagcaggtcatctgtgcaagaagccccctccggtggagcacaggccaggcccgcctcgctgtcatggttggtgaccgacgggatgccccaagcaagaacaggtccaggcgatgctgaggcctgtgttttttttttttgtttttgagactcagtctcactcttgcccagggtggagtgcagtggcacaatctcggcccactgcaacctccgcttcccaggttcaagggattctcctgccttagcctcccgagtagctgggattgcaggtgctcgccaccacgcccagctaatttttgtatttttagtagaaacggggttttgccatttggctaggctggtctcaaactcctgacctcaagtgatccgcccacctcagcctcccaaagttctgggattacatccttgagccaccgtacccagctggaactgtttttttctactttattattaggctgacagtttaaatgtcccttcagttgtaagagacaattgtgtgaagagccagtgtcagaatcgtgtgtgtgctcacatgcgtgcaagttactctagcaggagggaatccaagaagccactgagacatcctcattctgtcccttctgtctaggtgaggtcccagcttgaagagaaagaaaacaagaagttccctgtgtttaaggccgtgtcattcaagagccaggtggtcgcggggacaaactacttcatcaaggtagagtgtgggcctcaggagggcctgccccgaacgggtgctggtaggaaaccgcctgtgcaggcccgggctgtgtggtcttaggtgctggggcgccctgtggctgccccctgagataagcatcctactgtgtgtgtccatcggcctttcaggaggactagggcttctggggagctaagaaccccaaggaaacaagtgtgggatgtgaggcatcccctgcacatgcaggagaagacaagattgtcttcagctggctgctaatgacctggaggggcgcagcaaggtgacttgggatcagaggcttcgctcactccgctctcttcccaggtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgggctgtgccccttggggtggaaggggcaggattctgcagctgcttttgcatttctcttcctaaatttcattgtgttgatttctttccttcccaataggtgatcttaattactttcagaatattttcaaaatagatatatttttaaaatcctt

SEQ ID NO: 35810 - DNA, 31074 bp, Homo sapiens
ctttccccttactccgctcccctcttttccctccctctcctccccttccctctgttctctcctcctcttcccctcccctcccccgtccggagcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcaggtgagccgcaagaaccccaccgggctggctgctgcgtgaattcctcccctgacctaacctggctaatggcgcagcgctaaccggcacccttacttttcattttctgggtgccccgggctggcgggtgtgagtgccccggggctatagagggataggaatgttggttggggctgtcgcccgggcccggtctcggcccgctgtattgtccccgggacgagcacaatggcggcttttgtgtgtgcgtgcgcaggcgggcggagggggaggaagtgcgcgcgctctcgcggggacgcgcatgcgcgaatcccgactgattagtgacctgggggggtttgcgggagtgcgcagcgcggcgggacgcgactggaggcccttttggcttggagggcttcggccttcacggctggcgcagcctggattcccgtccggaggacctggcggcacccggtgtttgcgtgcctgcgagcaaggggtagaacgcggcccaggaatgtgggagggggcggccttcgctcggggtaatggcggcggcctcttttgtgtggtgctgggcggcgctgtggctcacctccgggagacggcgggtctcgggcgggcgaaggcctggaaaggaggatggaatgggtttcttgttttttcccgggttccttccgctggctttttcgcttcagcccaggttccgcagggtccgggggccctgcgccgcagccggggaggctgcgtttccggagtggaaagttttgtgacgcagaagattggggaggagtgggggaggggtgggggcggggaggggaggcaggaattggccgctgcgcgctgggccctggagatagaggttggacgtggcggggaggttagggagccagcgaggccctttctcctccttgcttgccccagattgtccctgtgtggtatgttagccgggagtcccgcgttgtttttctggggtggaggggtcatcgcgggttgtggtagtgtcttcgtgttagtgactgtgatccaggaatccgccattggaaaaacacccggcttaggggggaagtaaacagttttgttgttgacttgttgctatctgtggagtagaatcttgcaatgggtcccaggcccccgggttttttctcttagccagaatcccctcttctaagggtttaggggcagaggagagaaagatgtgtgatttgagaggagaaggttatggactttggtggcaggaagtctgcatcccaccgcaacagtggcaccaggcttcagataagctcttgtgtgggttatgcggagcttttaaataaactactgtctactgtgattaggggagcgttgatttcacaaactccggaataatcctgagacgaagtttagtggcacaaattaattgaatacatagtttaatgtagtcatatgtaatattttttaggaattgatctgttcctttggaagcattttctacccgttaatgaaccaattatattaaatcctctaattgctgacacatgttgaattgaacagacactttaacaacctaccagcagcacagagtattcccagttttaccattttccatttagctatagtgtccttttaaggattctaggcaacagtgaaccttatttaaaaagcaaaattgtgctataacaagtgcaaaaggaaagtttgtgttcctaccgtgctttaaagtattgatggtagcaagagaaagcgcagtggtgtttttgctcatagaaattctggaaattaggtgcctgaagtcttacactcattttttaaaagtatagcatctgcttccagttttcagtgactccattgatgatgcatgcggtttggccgtatcatactgagctttaaacacaagatttataaacatggtatgtagtgcatcttttgcaaacaggttggcagcggtactgtgtgacttggtcttttgtggcttttttgagaaaaatgaaacactttgcatgtatagttttttctcccaactacttgtgagtagttcctggttataaaacgttatgaaggtagcacataacccttttctagaatgaagaggcttttgagctaccagtgtaaggggataggtagaaatagagatgaaaggcactaagatgtcctactctttaagagcattgaacgccagttgtgccatttattcaaagtcatctttgaacttatgttaaaatggggtaaaaacaggtaactacttcaggccgggctcatgcttgtaatcccagtgctttgggaggccaaggcaggtggttcacctgacctgaggtcaggagaccagcctgggcaacatggcgaaaccccatctctactaaaagtacaaaaagtagcctagcgtggtggcgcacccctgtaatcccagctactcggggaggtggaggttgcagtgagccgagatcacatgactgaattccagcctggatgacagagggagactctgtctcaaaaaaaataaaaataaaaacaaacgaaacagtcaaactacttaagagttgtgcttaacatagtgttctgtaagtggtaggtatattgctatttttttgttgttcttaagagtactacccgactaaaaatacttgggcaatatttagggatgaagtatctaactaaaagaacggccacttcgaaatttgtcctgacatttttcaggtgtgcattttaggtttaaaatatcaagtattacggaaagttggcattggaaactttcataaccggcactaaaacgaatcctttatctatttgacattgaggaataattttgagattcagtgtaagctttagtttggtgattagggagcctgtgctatggaacatgttagtgaaaatttattttgaatgcatgaattaaatttggacagtttctactgaacagcacaagcatcttggtgtgccgccttctgtagtatatacaatagtaatattgcatttgcttagagcattgcagacttgaaaacattcttagtcacattctcattaagggttggtattagccctgtgaggtggactgggcaactacttgaatgcagtactagcaaatgctagagggcaggactagttttctcttaatgtagtatttgagcacatggggtgctaaccatctcactctcttctagtttgctggcctagacctgaactcttcagataatcagagtggaggaagtacagccagcagtaagtacaacatcttgtgggtttattgaatattagagcttaacatcttaagatttcattgggcttatgtaaaatttaagaaatttgcctttcaattttttactgcttaaagaattatgtagtctttgtgttatagaattatgtagtacttagtgatcaatctaaagcatcgttgccttttttttttttttttggttgagatggagctttgctcttgttgcccaggttggagtgcaatggtgtgatctcggctcaccgcagtctctgcctccgggttcaagcgattctcctgcctcagcctcccgaatagctgtgcctttctgataataaaacatcaatgactagctggctctcttgagtaaaagcagctaatcattggaaagaaccttattatatcaaattatctctagaagagtttttgtccattataaatcctgagcccagtttagaggtgatgggaatgtgtccctgttaactgactatatttattaaattgaattaagggaatatgcatttcattggttatagctactcctttctcctgaagaacagaagactatactgaattttggattggtggttaggttaggttttcaaatgtgtcatttcttttaaaaaggcattagaaaagttgctttttttcttctaaggggggttatttagagacttgttagaggttagtgttaagataggggatcttggtggtttattataagggcaatagacccttatttttagctcagatctcttcctacttattaaaacaaaagtgagtatgggctatgatgtgtcctcatttttaggcaagaacagcttcactgggaacaaaacttggtgtttgctttaactttcaccttatttgtcatgctaagaatcttttaggaactgattgtcctagtagagatttttaaaaatatttaattcagtctagaagtgaaaaagaaaaatgacacgtttactagttataaagcaaatttatttggctttatgttgttttttttgcttatccatattctaggctgtactcctgctcgcatacagagcaactgtcaactttccttaaactcagcaagccccaaattaaaacctgcaattccttgaaattaactcccctttgcagcttttccttgtttatttattgtatgttttgcaacttactggcatagaaacaaaagattgtgagatatgttacatgagtaatcttaaattgttacagtaatacttaatgcttttgttgacagttttgatgacagttctcttaaatctagcaggcctttaaaaaaatcacattaaatgaccactggtggctaaatgtgctcaatttgtggatttcaactattaggttccaaatcagcttttttttatcaaactcctttcagagttctccttatgaagcagtaacccatttaaaattagattcttatttttcccccctctcagtgtccaggtaagtaatcagattggaaggctggagattttaatttcccagaaccattttttagtaacagaaatttaaatgggaaggttttttggcatttaattaattttatatatatatatatttttttagaagggcgctatattcctcctcatttaaggaaccgagaagctactaaaggtaggtcctcacaagtaacttcgtaggtctattttttgcctcctttagaagttagtaaagcctaaggaaaaccaggcatttgggggaggtctaaacatggtgttgtttttctatgcttctgtcagccttggttcaaatactagagcttaataattttggaagaactcatctaatgttacgcagtgggaaattcggcattcctatgtcaaactgttctgacgccaagggcatggttttgtacagtttcactagtgttgtgctgaatctgtttgtaatcattcacagcatggttttagtttggaagaggtgggtgccctactgtgtaaaccaagctgtataatgataacaacctggttatttctgtcttggcaaagttgctagaaatgaagatgggcttattgtagaacagttaacaagttacagcgttggaagtgattctctggtttcatctccttgccttgctgcttttgaaaggttttgtccaaaatgtattacaatatctggtgtcttttcccattgtaattgtaacgtagtgatagatgacagctagtatatgtttcatattatgagacagctgttcgggtgctttatattctgtaaaatagaccatccaaaatttggaggaaaagggaaagtcaggaaaaccaaagattaggagggaagatactgtataaagaaggcagataggaagagtggagagtccacaggggagcacatggtttgctgctgttcctccatctccatatgtagtctgtattaccttcactgtcctggcaatgcatggatataaaatctgtattatttctaccagaagatcactttggctttttttttttttttttttttttgagacggagccttgctctgctgcggaggctggagtgcagtagcgcgggctcactgcaacctccgcctcctgggttcaagtgattctcctgcctcagcctcccaagtagctgggatcacaggcatgtgccaccatgcccggctaatttttgtatatttagtagagacggggttttgccttgttgcctaggctggtctcgaactcctgacctcaagtgatccacccgcctcagcctcccaaagtgctgggattacaggcgtgagccaccatgcctggctggcattatattctttttaggggaggttactttggaatttgtctttatcatcatggatgttctcaatattcctagtatactagctagaattgaccctcgtgtatatggcagtatcatagaggttttagagctggtagagatctggcaatctaacttaactctttcttgctagcaaaggctgttggtcacctgactggcctaacggtaggaggtagaaggcagaaggaaagtaactgaattgagaagctgtttctgtttaataaggtgttgctgaagctagttaaaccctctacctgtctttaaaccctctacctgtctttgggttaatttacatgtttgtcatccccttacctggatatttatagctgtacccaggaaccttgtctatactgagaatatatagtgatgagggtttttctttttcccaggtattcctgattgtcatcaagcttatagtagatgaaccactaaaataatactacaatttgacattagtgttcttgtactttatactattgaaactgaaaaatactgtattaaaccaagtaatctgacagtctatgaatgttctaaatgaataccacctccaagaaacatggaaacaatggtaactgtttttcctagtaaactcattcacacctataaaatgaatggaaattaaattgttatggtcacacaacgtcataatgcgttacaggcaaagctgttgaccacttagaggtagtattcattgagaaacattcttagactgtcagattgcttgatttagtgtaaagtaatttttttttttttgagacaagggtgtttcactcttgtttcccgtgctggagtgcagtggcgcaatcttggctcactgcaacctcagcctcccgggttcaagtgattctcctgcctcagcctcctgagtagctgggattacagacgtgggccaccacgcctggctaatattgtatatgtagtagagacggggtttctccatgttggtcaggctagtctcgaactcctgacctcaggtgacctgcccgccttggcctcccaaagtgctgggattacaggcgtgagccaccatgcctggccagtggacagtattttctagtggggagaattaaagaaaaactttgtccgggtgtaaaccagctttaaatcttggttctcttacagtgccatggtagggatagtcagtggaggctttcaaattcagaaagattgataataccttaacatggttcctatttctaattaataataaaatgtatttgtgcttttttaatcaaaggtttctacgataaagacagttcagggtggagttctagcaaagataaggatgcgtatagcagttttggatctcgtagtgattcaagagggaagtctagcttcttcagtgatcgtggaagtggatcaaggggaaggtaagtgatttcttaatcaccttacgtgtatgtataataacagtttaataagtcgttatcctgaccacctgtttggatgttaagcattatgtctgtttggtcattgtattttcttagccgtaagaggcttttactaaattgaacctgttacttagaaattagatgaaaataggaatatgctcattggcataatgaaatgagttattctatttctcgagttttatatgttctacttaaaagagtaagttcatctagtgaatggcctaatttggttgggatttttgtggactctataacaatttctaaacaccttgtatttttgattacacaagtgtggtgaactgaccccacgtgcctaatagctgtggttagtcctgtgtcctgatttttcgcaaacaggcctaaaactcttaaaaacatcttagttcaggtaaggattattttctaccttttatccaaagtctgtcacacaggtgaattgtcctttaagtgacatcctagtataactaggacgattgatatttggtgtgctattttcttgttttccctaccattaaatatatttggatgagcactttaaatgaaggttgtgagctgtgtgccgatttcaaataaaatccttattcttaattttggcatctgtgaggccttttaggctatacaactttatagaaatgtaaagattactgattttagaaaacgaggttatgtaaatgatgctggttagagagccttatttgtcaagtaactcagaattggattgttgacatccttatggttagccataacttaagtctccagatacagttctagagtagggataagaatctgataatggttaaatgatatgattctgattaattgcttgtgctgttcaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacagtaagtttttgaagtgtatgttacttgtgatgaagccttactagctagtataacaaatgaacttatccattttttgatttgagggaactcttttctggaggcaacactgggattaattttgagaaatacgatgacattccagttgaggcaacaggcaacaactgtcctccacatattgaaagtgtgagtatttttgcttgactttttaagacacagagaggttaaatgttttcatgttacattagaatgtgagatgggcttcataaagtcatgtagaccagaggcttcatagatttgtggaaaaggagaagttgagttcagtgtcaccattatgaataatttattacctaaaatagaaaatgggtcaaacataggaacaacccaaagtcttctccaatgtgcagtaagcctgggggttggtttttctcaaagtataatgtgataattttacttaaactataaactgagttaccaatcagctgttggttggttgtttccattattagtataaaacagaaatagctctagatagcattcctaaccccattgaatttcttaacagttcagtgatgttgagatgggagaaattatcatgggaaacattgagcttactcgttatactcgcccaactccagtgcaaaagcatgctattcctattatcaaagagaaaagagacttgatggcttgtgcccaaacaggtaagctcaactcataagagtaaaacatcatatttcttctgtaaaggactagacaataaaatattttattttttatgggtcatgcagttttgcagctgctctgcgctgctattggactgtgaaagaagccatagatgatacataaattattggttacggctgtattccgtaagagctttatttataaaaataacaggctttatttacaaaatagtctcagtttgctgactcctcttagaggtggagcagagaagccactttttggaaaacttaagcataaactaaaagtactaattattagtaatagggtagttaaaaaacactgtcatctaccaatgtctgtttaaaagtaatgagcaggatttgtttgtttgtttttgaacagggtctggaaaaactgcagcatttctgttgcccatcttgagtcagatttattcagatggtccaggcgaggctttgagggccatgaaggtagatgtttctttataaaatgggaaattgtagaactttgtaggtggccattgagagggctttctaaatgatgctaagacttaagtagaatgaaaaccagttttcaagtgtaatctgtaatctataaattacaaaagggaattatgttgtgatgaacttttcaaacagggtaggtagagttaacttaaaaattaacttatttcttaggaaaatggaaggtatgggcgccgcaaacaatacccaatctccttggtattagcaccaacgagagagttggcagtacagatctacgaggaagccagaaaagtaagtatgagttccagtgattattagctttttcattgattctaattaaatgttttatgaacatgtaaaaattttgaccttgaagttcataacattttttttgcttatagttttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaagtatgttttattttgtttttgtttttttgttttgttttgttttgttcttttgtttttggcagagttgcgctcttgttgcccaggctggagtgccatggcgcgatctcggctcaccacaacctctgcctcccgggttcaagcgattctcctgcctcagcctcccaggtagctgggattacaggcatgtgccaccacgctgggctaatttttgtatttttagtagaggcggggtttctccatgttggtcaggctggtctcgaactcctgacctcaggtgatccgcctgccttggcctcccaaagtgctgggattacaggtgtgagccatcgcacccggccaagtatgttaatttttaaatgtatgggatgcagtattaaagttactgcccattagttttgtggtgatgttaacattgtctaaatgttaaggctgagaagtgatgtatttcagacatctaactttcacaaaaagcttgttcatggtaattttaatgttgaaaaatcagtaacatcttggttgagacttacaacaatgatcagctcgtgggacagtcaactaggatgggctaatttgactgtgtaatcttgaatgacttatgtagtggcaagaatcctgtgctgtgtctgtaaaattatgcagtgtgaggcaccatcttaatgaatatataattgtaataacctatacaattgtatttgtaattatactaacagccatactaaaaccatgttgatttctcctcaaattctaaactcaggcttgttttttttcatgacatgacagatacttggtgttagatgaagctgatcggatgttggatatggggtttgagcctcagattcgtagaatagtcgaacaagatactatgcctccaaagggtgtccgccacactatgatgtttagtgctacttttcctaaggaaatacaggtactgtttgatgttgcaaattttatttatttagaaatttgtttatctcaggtaataataaaaattttttttctttcagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggtaacattatgaattttttattttattagacatgggggtttctctttgttgcccaggctggagtgcaggggttattcacaggtgtgatctcattactgatcagcatgggagtatttgacctgctctgtttctgacctgggcctgttcacccctccttaggcaacctggtgctcccttgcttccgggaggttaccatgttgatgccaaacttagtgtggacacctgataggcatagtacactacagcccagaactcctagacttagacaatcctcctgcctcagtctccagagtagctgggactacaggcactcaccactgcacccagctaaaattatgaataatttaattgctctggtaataacccatttgggctgggtgcagtggtacagtgcatgtagtcccagctacttggcaggctgaggctgtagtatgccatgattgcacctgcgaatggccagtgcactctcagcctgggcaatttagtgagacccccatctcttaaatgtatttggattacctttattacttttcctcctcaattcaaaacatgctgtgttgaaagcccgtttttaagaagatatatatgtattttaattgacacattaaaattgtgcatacataagtgcaaagagaactaagccatgttagtgacaaaaacctataatttttcaacgacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtatgtataaacatctttcttttattcaaattgagcatgttcaagtatttgttttcttttaagtgggccatatctcataaaagttattttccaggtagcagcaagaggactggacatttcaaatgtgaaacatgttatcaattttgacttgccaagtgatattgaagaatatgtacatcgtattggtcgtacgggacgtgtaggaaaccttggtaagtatttgattacttgatggtttcattgttttttgctgtgatgtgtgcaggaaagaacttgctaggatctaaaatacatttttaacaatgaaagtgacaaagattttgctcaaagcacttgtttaaatattacgtggtaatattttaaatatttctacgtaggaaagtaagaatagtagcaagttactttatggaagacctttgtttatatacttttttgggaactcttttaggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagaggtgaggtataaatagtatataatgaggggaatgggtgttcacttacagttcatagtgtttcctctgcatgcataacgtccaaggttaactgtacagtatttaaaaagcttaatcatcttaggcttcctagattctttggtaaggggttgtattagaatgggtgacactctgttggggaaaatatggctggatggggaattgtttgaatggaaaaattagaaattggtcattaggaaagagttaggttactttagtggaatttcatcttcatgtgaaccaacataatttttttcttatagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtagtgttaatctgtaacttcatagctttgggaagggtttttttccttttagtcatctttttcaaagcctaattaaacaatttaagttcagcactatagaaacttgatggcaaattacgtaagggaaggattgtatttaatgatggataacttcattaatttctctctctttttaaatctctcattaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttgttaatgtactgtgcctttaactttagacaactttttattttgatgtcctgttggctcagtaatgctcaagatatcaattgttttgacaaaataaatttactgaacttgggctaaaatcaaaccttggcacacaggtgtgatacaacttaacaggaatcatcgattcatccataaataatataaggaaaaacttatgcggtagcctgcattagggctttttgatacttgcagattgggggaaaacaacaaatgtcttgaagcatattaatggaattagtttctaatgtggcaaactgtattaagttaaagttctgatttgctcactctatcctggataggtatttagaacctgatagtctttaagccattccagtcatgatgaggtgatgtatgaatacatgcatacattcaaagcactgttttcaaagttaatgcaagtaaatacagcaattcctctttcaacgtttaggcagatcattaattatgagctagccaaatgtgggcatactattacagggaaagtttaaaggtctgataacttgaaataggtttttaggagaattcatctacttagactttttaaatgcctgccataaatgaaattgaaatggtagaatggctgaccacagcaatgaccagccctcattagggccctggatgatttttggtctaataacgcatgctagtgttgatgttttttggtcaagagggtatgaacaggaagaattaaatgcagcaggctttattttaaatgccgattcacattactctgttcaagctgcgttgagatgttaaactggcttactatagacttcgtaaaaatggctccagaagagtaacaaactgaaatctttgagatcacacaggttggaaatatgtacataactgcacaaggtgtcaattctgctctacagtgcagttttagtcagttttagttgcataggtttccattgtatttatagtctgtttatgctaaatctggccaaagatgagcattgtccaccactaaaatgcctctgccactttgaattctgtgctaattttgtggccagaatgcggtgatcaaaacgctccatctttttacagtggcataggaagacggcaaaaatttcctaaagtgcaatagattttcaagtgtattgtgccttgttctaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgtcttgtgtgcgtgtccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagtttaaagaaacttgaccaaaagacagtacaaaaacactggcacttgaatgttgaatgtcaccgtatgcgtgaaattatatatttcggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggattttgtttagttgtgtgtttttttttttttttcagtgaatgtctggcacattgcaatcctcaaacatgtggttatctttgttgtattggcataatcagtgacttgtacattcagcaatagcatttgagcaagttttatcagcaagcaatattttcagttaataaggtttcaaaaatcatgtaaggatttaaacttgctgaatgtaaagattgaacctcaagtcactgtagctttagtaattgcttattgtattagtttagatgctagcactgcatgtgctgtgcatattctgattttattaaaataaaaagttgaactgcacagtctcctttgttgttgtcaattgtggtttattttcagaggtgtaaataaagtgctcttgcctgaaaaattgtaaaatgttattttttgcttgtcatccagtgctattttttgagatgcctcttggatacagaatgactcataccataagtatttgcaatgaaagatgaagatagtattagtttgaaatacagtgaaacaggatttttgtaatagacggaaatctaaaaggcccttactgataatacagcatgtattagaaattggcttatactttgaacaatttgacatgggtgggagtctctttgttctttgaagtatctattatgaaggatggttgaacagtggaagaatgagcaggataaaagtcaagtgtgtcagtagtccaacaagtgatggtaagtatatacttagggaaggaatcaagactatttgggccaggtgtgatgattacatagtcctatagtgctagtttacttggaagctgaggggcaggaagattgcttgagcccacgagttcaagtccagcctgggcaacgtatagcaagaccttatctctgaaaacaggtaataagacatctatgcttactgtacacactgctgcaataggctgctaccacaagtgtataggtgcttggttagattgagccatactagcggtttgatacgtttcaatctaacaaatacgtattcagcttttgtttcagtaagttgaaggtttgcagtatgattaagaattttttgcattgtaaggaagtatggttctggataatctttccagtcatgaactcaaaataagcataagtttttagggcagaattttgacacatggccatatgtattttgaagatagaaaagatgatggtacttgagtctcgatttagtcaaaataagcatggaaaggtttgggattgctagattggatagtcaatggctgaaagtgactcatggagtgaaacgatgctaaggagagttcagtttccactttatgtgaatgatgagtgaacatgacaatctgctctggaggaactgccaaaatttgaggttatttctagtctagcatggttaggattatggtgacataaatttagtatgtttacatactacattaatgtggtttaattttaattacacttaaatgcagttgtcactcttgggcactgttgatgtgtttcctggattcttggctgaatttcaagatttttaaaatggctttataggagctgtgtctaaccttcatgcttaaaatgtttcctttgctcctatgctctacgtgacctgcttgagtggccacaggcttgctctttagagcacagtgactttgttgatagggcctcactactcccacaatgcagagatacctacttattgtaggtacagggcattgaaagttataagactatctttgggttttgctttcttgtgttccattctatttttaatacaattctgagtatatttaaacctgctttgcttcatgtcctcatttcagtttatgatctatttttcagcatgtttagtgtcattgtttctaatgtggctgtcctctataatgactactcttcaatttcttcattttttttttcctcttagttttctctacatacacttgactgggtttttaggataattctgagaaaggacttttttttgacaaagcactgtttaattatattatgaaaggatattttgtgacttggaaagatgtttattatgggagaaaacaaaacggaccaatacgatttaagagcaggaaataggtgtctcaaaacaagataaagtcagcaattccactcctaggaggattctacccaggagaaatgaaaatgctaagtatgtgaatgttttgtagcattattcatcgtaaccaaaaagtggaaacaaaaatgtccctcaactgacaaatggataaactaaatatatacataaaatgagatactatctcctctaggtgaacagccacatccccaatttcctcccccctcttcaaagggtcattaggtaggcctatcagtactgtgacatatctatattctaaggctttctgtagatgtatatccagttttagtccttattttactgtgtgaagcagatacaatcatggtttattggatatttactgtcttccttgttacattgaagatgtttcatttttcgagagaagtacctcctatctttcgctggagatcctccattcacttccttttccactcattctattcccaacagcccatctcatttacctaacagtcaacattagtggtatgcagaatggtccctgaacctcttctccagacctcaatcacctgatgggatctttcagtgcaaggcgagggttgacttagggtgcaatcaaaacctgatttggtgtctgcttgagtattggcactgggagatgtagtgattaatttagattagtctttcctttcttggaacctagccattttccttttgtgtttctccaacttggtgttgcaacagaaagtacctgggaaatgattctagggcaactctcctaacaggatcctccacctctgaggttctctcagaaatctgtggttttggttttggtttttgcttgtgtttttattcctaaagctccccaggcaattctgatacagcaggcttaggtgtggagtccactgttcactccccttctttttgtcatttgtttcagacttagcattgccatgatcatgcttctggttcttcattgtggaagcatctctgtattccaaattaaaacagatattgcaaacaaagtaatggcattctattacgtggcccctatggcgtggttctaatctaccattgcagctttaacttgcctcccagaccttatcctgtagctgaatgtcatgctactgtctatgcaaatcctgtgctttcttctgcctttgccttagtttttgctcaccatgttccttctaactagaattggagctaaactaatgttttaaaatattgggctgggcgcagtggctcacgcctgtaatcccagcactttgggaggccgaggcaggcagatcacgaggtcaggagatcgagaccatcctggctaacacggtgaaaccctgtctctactaaaaatacaaaaaaaaaaaaaaaaaaaaattagccgggcaaggtggcaggcacctgtagtcccagctacttaggaggctgaggcaggagaatggtgtcagcccaggaggcagagcttgcagtgagctgagattgtgccactgcactccagcctgggtgatagagcaagactccatctcaaaaaatatatatatattgtattcagaatattaaggtgctggcccggcacagtggctcacacctgtgatcccagcactttgggaggtgggtggagttcaagaccagcctggccaacatggtgaaactccgtctctactaaaaaaaaaaaaaaaattagctgggcgtggtggcaagcgcttatagtctcagctacttgggaagctgaggcaggagaatcacttgaacctgggaggtggaggttgtagtgagccaagtttgtgccactgtactccactgtgggcaacagagtgaggttccatctcaaaaaaaaaaaatctctctctctatacacacgcatacacacacacacacacacacacaataaagctgccattgacaattactagtgacatagagaaaataacttgttccagtgggtagagaaaaaagtaggttacatctcagtgtgcagaatgatcttaagtattttgaaaatacatagaagaccagaaggaaacctgctaaaatattaatagtttttgctactggttgaaattataaagattttctgctgctttatcctttcctgagcagattttatacggttaaaatgtattttctaataaaactgtatagattcacaggaagttgcaaaaacaagagaggttccactgtatccttcacgcagtttcccccaatggtaacatctggcatactgcagtacaaaaccaggaaattgccattggtacaatccacacaccctgttccaatttcaccagttttactcatttgtatgcagtcatgtgtgtagttctgtgcagttttatatgtgtagatttgtgtaaccccctccacagaacagttccatcatcacaatgatctcccttgtgctacctctttttttttttttttttgagacagggttgcgcaggctggtgtgaccatagctcgcagtagccttgacctcccaggctcaagcaatcctcccacctcagcctcctgagtagctgggactacaggcgtgtgccaccacacctagctaatttttaaattatttgtagagatgggatcccactatgttgcccaggctggtcttgaactgaactcctcaagtgatcctcctgcctcagcctcccaaaatgctgggattacatgcatgagccacagtgctcagcttgctacctctttttaaatcgtatctgtccccttcctgcttccctaacctgtccccaacccctgacaactacttgtctgtttaacatctctaaaatgtaattttaaaattgttacataaatgcagtatgtgaccttttgagactaggttattttgactcagtataatgtctctgatcaatccaagttgttgtaaatagttttgttgttgttgttgttgttgttgttttgagatggagtctcactctgttgcccaggctggagtgcagtggtgcgatctcggctcactgcaacctctacctccagggttcaagcaattctccccaagtagctgggattacaggtgcatgacaccacacccagctaatttttgtatttttagtagaggcggggtttcaccatgttggccaggctggtctcgaagtcctgacctcgggtgatccgcccgcctcggcctcctaaggtgctgggattataggtgtgagccaccgtgcccggccagtttgttcttttttattgctgaatagtatagatattctgtagtttatccgttcagccgttgaaggatatttgtcttgtttccggtttgtgacttacaaataaagctgccatgaacattcagctacatatgaacctatatacaggttttcgtgtagacataagttttcatttatgtggcataaatgcccaggagtacaattgctggctcctgtgttaagtatgtgttagtttaaaacactgccataccatttttcagagtggctgtaccattttacattcctaccagcaatgcaggacagatccaatttctctgcatcctcaccagcatttggtattgttattattcttactattattattttttgagacagggtcccactctgtcacccaggctggagtgcagtggccctatcatggctcactgcagccttgagctcccaagctcaagccatcctcccacctcagcctcctgagtaattgggaccacgggtgtgtaccaccatgctcggctaattttctttttctttttttttttttttttgagatgtggtctcactatgttgcccaggccagtcttgaatttctgggctcaagtgatcctcccatctagcccagcactctcaaagtgctaggattacaggcatgagccaccacaccaggcatgtcattatttttaaattttggctgctctaattggtgtaaagtagtatcttattgtcttaatttgcatttctctaatggctggtgatgttgaacatcttttcgtgttcttatttgccatccctgtatcctctttggtaaaatatatgtctgtgtcttttgctcatttttaaattgatagttttttactgttgagttttgagagttctttattctaagtacaagtctttttgacagcttgcaaatattttctctcaatcaaagtcgtcttttcatcttaaaaaggtcttttgcagagcaaatgcttttaattgttcttaaacatttaaaagtttgatgtagtccaatttgtcagcttttttttttttttttttttgagacagtgtctcactctgttgcccaggctgaagtgcagtggtgtgatcttggctcactgcaacctccgcctcccaggttcaagccattctcgtgcctcagcctcccaagtatctgggattacaggtgcccaccaacatgcctggctaatggctaatttttgtatttttagtagagacggggtttcaccatattgaccaagttagtctcaaactcctgacttcaggtgatccacctgccttggcctcccaaagtgctggggttacaggcatgagccacctcgcctggccagtatttctttttttttttttttttttttttgagacggagtctcactctgttgccaggctggagtgcagtggtacgatctcggctcactgcaacctctgcctcctgggttgaagtgattcccctgcctcagcctcctgagtagctgggactacaggcgcacaccaccacacctggctaatttttattttattttattttaatagagatggggtttcaccgtgttggtcagggtggtcttgatctcccaccttgtgatctgcccgcctcggcctctcaaagtgttgggattacgggcgtgagccaccgtgcccggccggcatcattcgtcaaaaagaatgttctttctccattgaattgcttttgtacctttgtcaaaaatcagttggctgtccttttgtgaatctatttctaggttcacaattccgtttcattaatctatatgcctatccttccaccattcctgcagaatatcacactaattcttttttttttttttttttttttgagacggagtcttgctctgtcacccaggctggagtgtagtggcatgatctcagctcactgcaacctgtacctcctgggttcaagcgattctcctgcctcagcctcccaagtagcttggattacaggtgtgcgccaccacacccagataatttttgtatttttagtagagacaggttttcaccatgttggccaggctggtcttgaacccctgacctcaggtgatctatccacctcggcttcccaaattgctgggattacaagcgtgagccactgcgtgtggcctcaattatttttatctatataataagtcttaacgttgggtaggagtgattcctctcactttattatagttttgcaaaagtaatttagctcttctagttcctttgcctttccacataaattttagaataagctttttttctatctacaaaagaatcttgctgggattctgatggtaatgctgctaaacctatagatcagttttgaggagaatcgacatctttactatgttgggtccaaaacttttttatttttatttttttgagacagggtccagtcttgctctgtcactgggctcaagcaatcctcctgcattagcctcctgaatagctgggactacaggcacacaccaccacacctggctaatttttgtatttttatttttagtagagacaaggtcttgctatgttgcccaggctagtctccaatgcctgagctcaggcgatcctaccacctcagcctcccaaagtgctgggattacaggcgtgagccactgcgtgcagcctaaatttatttttatgttgtgaacttggaatatccaaccaacagtaaagattacctagtacttcctaacatgggattctcctatttgttcatcctaggatcatgctcctctgtggagcaagtgcctccatgaaatgccatattttgtgaagaaagtgcatgcaggaatattcaggagtccagcatgtagtcatggcagccttaggtatttgagaccgaccaaccctcctgatgaagacaaccataactcatgcaggcatgagtctgtaagcattcttagtctgtaagcaccttttggaaggtttcctatctgggacagagatagacactctttttttttttttttttttttttttttttgagatggagtttcgctattgttgcccaggctggagtgcaatggtgtgacctctgctcaccgcaacctccacctcctgggttcaagcaattctcctgcctcagcctcctgagtagctgggattacaggcatgcgccactatgccctgctaattttgtattttttagtagagacagagtttctccatgttggtcaggctggtctcgaacccccgacctcgtggtctgcccgcctcggcctcccaaagtgctgggattacaggtgtgagccaccgtgcctggtcgacgctttctaatagtcaattaagtaagttaataactgcctgggcagaaaatgcagtattcagctaatcccaaacttggaattttctaccttttcagtttcatcttcttaaaactcatcattttgagagtactttggagttacttgaatattaattctcagcatgcattcaacttaattaccttaatgtcccaggattttaataacccttaaaatttccatgtcaattttcatcagggaaccttgtccttgaatgctgctgctgtgacttcctgtagaagttctttaattggaacactcttggcagagccttccctttcatatggagcacaaaagcagctgccatgctcaatttgcagtcctctttattgtgcggggattttttttattttttattttttgagatggagtttcactcttgtcccctaggctggagtacaatggcgccatcttggctcactgcaacctccgcctcccgggttcaggcaattctcctgcctcagcctcccgagtagctgggattacaggtgcccaccaccactcctggctaatttttgtatttttagtagagacagggtttcaccatgttggccaggatggtctcgaactgacctcaagtaagacacccaccttggccttccaaagtgctaggatcacaggcgtgagccactgtgcctggcctgtacaggaattttgaagaaatctacagtgttaacagaacccgtggtataaatttatcccaagtatcagtgtcacaaatactctttgcgtctaagaaacatgctttcttggaagcaacactgggaaaactaagtgatttcacttttgcccaccacaggaatgaagtcttactgcatttattagcaatacccatggttgaatctcttttacttattttctatttcccaaccttttcattttcttgcatggacatctgaaagttgcctccaggccgggcatcgtggctcatgcctgtaatcccagcactttgggaggtgggcatatcacctgaggtcaggagcttgagaccagcctggccaacatggtagaagcctctactaaaaatacaaaaattagccaggcctggtggtgtgcacctgtaattccagctacttgggaggctgaggcaggagaattgcttgaacccaggaggcagaggttgcagtgagccaagatggtgccactgcacttcagcctgggcaacagagtaagattccatctcaaaaaaaaaaaaaaaaaaagttgcctccaaattttggagtgagataaggtataagtatatcaaatgaaacgttaaagctatttttaaaaaagtgggccaggtgtggtggctcatgcctgtaatcccagcactttgggaggccgaggcaggtggatcacgaggtcaggagatagagaccatggtgaaaccctgtctctactaaaaatacaaaaaaaaataaaaaataaaaataaaaattagccgggcgcggtggcgggtgcctgtagtcccagctactcgggaggctgaggcaggagaatggcgtgaacccgggaggtggagcttgcagtgagccgagatcgcgccactgcactccagcctgggcgacagagcgagactctgtctcaaaaaataataataataataaataaatacataaataaataaaaccccaagagaggaagtagtgtcactccagccatatgtgtgccttttcttcccttagaagctttcaatttccggctgggcatggtggctcatgcctgtaatcccaacactttgggaagcggaggtgggcggatcacctgaggtcaggagttcaagaccagcctggccaacatggtgaaaccccgtctctactgaaagtacaaaaattagctgggcgtggtggtgcgtgcctgtaatcccagctactcgggaggctgaggcaggagaatcgcttgaacccgggaggcagaagttgcggtgagctgagaccatgccattgtattccagcctgggcggcagagtaaaactctgtctcaaaaaaaaaaaaaagaagctttctgtttcctcctagtggaggaggtatggagtgctcttgtttgtttgtttgtttgtttatttgagacagggtcttaccctgtcgcccaggctggagtgcagtggcgtaatctcggctcaccgcaacctttgtctcccaggttcaagtgattctcctgctgcagcctcccaagtagctgggattataggcatgcgccaccacacttagctaatttttgtgtttttaatagagacggggttttaccatgttggccaggctggtcttgcactcctggcctcaagtgatccacccgccttggcctcccaaagtgctaggattacaggcatgagcaaccacacccagcctagtgcctctgtttaaggccaaatcttctatttgtttctcaggaacctagcgcttgtggttgtctctcatctattcatgcatcatctatatttcccactctcctggctcactcccttaatatcacccatctttgtttggggggggcacagttggggtatagggtctcactctgtcacccaggctggagtgcagtagcaccatcacggctcactgtagccttgacctcttgggctcaagcaatcctcccacctcagcctcccaaactgttggaattacaggcatgagccacggtgcttggcccaatatcacccatcaagccctcttgatcttatgtccctctgcagcttgccgctctgttttttttttttgtactgccccctgcttcctgcaagacctcaaatccactgtgtctacttcttgccttatttttattctactctaatcagcttttgtcatcccaacgaagtggctcctataagtcacagtcggccgggcatggtggctcatgcctgtaatcccagcactttgagaggccaaggcgggtgggtcatgaggtcaggagatcaagaacatcctggccaacatggtgaaaccctgtctgtactgaaaatacaaaaaattagccgggtgtggtggctggcacctgtaatcccagctactcaggaggctgaggcaggagaatcacttgaacccgggaggcggaggttgcggtgagttgagatcatgccactgcactccagcctggcaacagagtgagattctgtctcaaaaaaataaaaataaaaaaaagtcacagtcacctattctttgtcgttttactaggcccttcagcagtactgtacactgagtacatcctcatggacatgctttagtccctaggtttccatgtgcgcacacttcttggttctcctccactttggcctctcatgcctggccctctttctcctcacaacccaaatattagacaatatatcacaaacaaatcccgaagtgctgggattacaggcatgagccactgtgcccggcctacttaagtattttcatagattatctaatgttcaaataatgcaatattcctcagcatctgaacaaatgcatggaatggatggtggatagcaagagatacttgtactttctctctgcctttccctgccttctccagggtccccccacatctcattaagtggcatcttctttcacctagtcactcaggtcaaagctgggaagtcattccttttttctttctctcataccacttgtcattgaatttcctaagttctatctccacacctgcccactgcatcatcaccactgctaaaatcctgagccaaataattaacttttttttttttttttttttttgagacagagttttgctcttgttgcccagactggagtgcaatggtgcgatctcggctcactgcaacctctgcctcctgggttcaagcaattctcctgcctcagcctcctgagtagctgggattacaggcgtgtgccaccacgcccggctaatttttgcattgttagtagagacggggttttgccatgttggccaggctggtctcgaactcctgacctcaggtaatctgcccgccttggcccctcaaagtgctgggattacagatgtgagccacaatgcccagctgagccaagttaacttctttcctcatctgaactactggaacagcctccttacctggtctccctgtctccatcatgacttactatacaagactcctgccaaccttccctcatccactgtgctcctatcataccagccgcctttcaatccttaactgcgccaagttcatcctttctgctggaacctcctttcttcacatggctgtctcctcctcattcaggactcaactcaagtgtcacttctcctgagaggctctccctgacatccttaactaactactctaattataaagttccaaggaagcgctacagaaaagacatccgtcccctgacagggctctgggctagtctcttccctatgggaggtggggcaggagctgctgaggctcatgattcttctttggccacctcactcccagctgatgagggacaggtcaaggacagcctgtgcttccactggctcctggtcactacatgtagcgcactccaggtagacacgttcttcctggctcccatattatgagctcatcagacagcctcccctgctgtcttcctgccttgaaaggatctaacatgaaagcacttttactttctaaaagtaaaatgctctctattcatgggcaagagattaccacctcactgactgggaccttcagctaatgcctttctttctgggcatttctttctttgctatgaagtgagaagaaccatacttgctgtatacaattaagaagtgatctattcaaagagccacttgatgactgagtgcaatggctcacacctgtaatcccagcactttgggaggccgaggcagtggattacttgaggtcaggagttcaagaccagcctggccagcatggtgaaaccttgtctctactaaaaatacaaaaattagctgggcatggtggcaggcgcctgtagtcccagctacatgggaggccaaggcaggagaatcgcttgaacccaggaggtggaggttgcagtgagctgagattgcaccactgcactccagtgtgggcaatagagtgagactctgtctcacaaaaaataaaagagttgatgattccatggttcctatggacatataatagttgactgtcacaaaaaatataactctggccgggcgcagtggctcacacctgtaatcccagcactttgggaggccaaggagggcagatcacctgaggtcgggagttcaagaccagcctgatcaacatggagaaaccccgtctctactaaaaattcaaaattagccaggcatggtggcgcatgcctgtaatcccagctactcggaaggctgaggcaggagaatcacttgaacccgggaggcaaaggttgcagtgagccgagatcgcaccattgcactccagcctgggcaacaagagcgaaactccgtctcaaaacaaaagaaacaaacaaacaaaaaaccaaaaccctgccgcaatccttccactactctcccatgggaggaagctcagagccaccctgaccgctcttcatttcaccacctctctccatttgtcagtgacctgaggctgcctcattgtttctgagcactgttcatatcagctgttcttccacgcttccttcagcctagaccccagaaacagctgcccctctgccttcattctctcacccttctgtaacagatatccccttccactccttccttcctaacagaaccccaatttggttcaggatggcaatgtgcctctctaagaatagttggctcctcagccttgtactccaggagagacttgcctcccagttccggtcaatgtagtaatgggagtaggtgggagtattaggtggaagtccatggggcgggtgccccttcccaagcaaagcctcacaagaggcttttggctctgctcttttttctctcctagaacttggagcgtgatgcccagaagtgtgtgaactggtctgtgaccacaaagatgagaaccgcatgctgagattggtggaatggagacttcagtgagcctacatgcagatgacatggtgacacccgtgcccagcctgagctgttttcttctggccctcttattacatgagaaaaataaacacctatgcaccttggcctc

SEQ ID NO: 35811 - DNA, 89507 bp, Homo sapiens
gcgctggctttagagccacagctgcaaagattccgaggtgcagaagttgtctgagtgcgttggtcggcggcagtcgggccagacccaggactctgcgactttacgtaagtgctttgtaggcgccggcgggcactaggggagcgggtttcctgggcgtgggcaggagtgggtcccggggagagcatctcggttaagctcagcaggaacgtgcggcgcaccgtggggcgggggttgggggagagggaggtcggagaaatttcagttggagccctcgggcgcccgggcgatcggtcgcaaccgaaatgggtgtgagtgacggggagtttccctactagcatccgccgcagacacgttttctgcacttcactgtattaagtggtgttttcttactagttgctcttaacttgttgccagtcttgggctggagtcctagacgccagcccttgccctgattcccctccgcggctgcggccccgaagtggaaagggagcgcacaacttccctctgtcgtccttctccagctactgccatcccctcttccctcccgcccggactcaggaaatcccggagccagcagcctgctactcctccagcccccacacgcccgcctcgggtgacctggctggcttaagccgaccctggggctctggagagggggggccgtggccgagggaaggcacgaggtttgggttgcctgccttctgcctgcttccctcccttgtccttagcgagggcgtcgcgaacgcacctagtctccctatgagtaagcactttttttcctttcagtaggagaacatctctgggctagtaggacagtacctttccgttctcccctggccccacaccccctgtccttttttcagctcctttgactttgcggccccgggcgcgcggtcggggcggcggcagtcccggacctctcccgactcttggagagagagaggcaaaggggcgacgggagggaggtaatagtctacccccccgccctttccccgcacagctgcacttgcctgtgtttacttttctccacccgcagtacttaagcgctgtaatgagaggcccggggacgccgaccacccccgccctggcttctcgccagtcccaaagttgctgccgccgtcgctgctccagtgtgctggcggttccgaccgccgggctccgggacgtaagatgatcccagcccgggaggtggagtgggggttaatggcatctgactctagccttatgcgatgctccttgcctctcacctgagctgcacgatatccccagtggtgcagaaggttgaacttttgcagaaggttgagcttggagctaagtgggttggagagcctcgccatttagcgtcagacagacgggatgctgggggcgcccggcctgttaagagggattgggaggagggaagggagcctggctaacagtaggtagaaaatgtagggaaaagtaaaaaccattgaggggcaagcacttactccactttgctggatgtcacaatggactggggagcctaaacttgatcctcgagatgcagttcatggtgaattccaactaagtggctggagccccacacataccagttggaatcacgtgccccaagtctctgatggtcacatgacgtctttttactttaaagctggaatgtaatggttgaggcccatattccaaaaaccacctctacgtttgaaaaaaaaaaggtggggaggagtgtgaactagcttctaatcaaggaagtctactaggattttggatgaggggaccagaaagggaatttggtgctcagcttttatccaaaacaaaaacaggagctgtttttaaaataagggattgaaatatatgtgagctgggacatgtatctcctctcttcttcaatctcatggtttttctaaatttaaaaaacatcttactaattattttctagggaagtcatcctattactcatgcctcattttgtccctgaatactagatttgaagctaaatcccacaagatagtgttaaaaagtaaggctctgttcatcttccttggtctggcctatattctaattgaactgttccctattttaggcaactacttaaaggtagtaaataacctcttgactaaaattaaccaccagttatttgtggttttcaattaactggattagaaatcatgcacaaaaacagtggatagtaaatttgatacatcgagttggttgggtttttgcctgtcagtggtttggtagaataatgagaggacactgaaacaactttcccatattgacctatacccgcccaagtggcccaagttaaggttgcttctgggaaaacgtggcaatttggctattcagattatatattacagagtatagaagagaggcagaggagcctctgaggtcaggagtttaaaagctttgcttatctgaaaaaaaaagaaaaaacggacctggttgatgcatattcagtcttgaaaacaactagggcagaagatatttaagagattctgactttgtattcttttgccaaaaaccctttgtctcctgcagcagcctctgaatgaccggagcactccagtttcttgctgttcatccgtttctgagcctgaaaactagaacaaccttaaagcacattgttctgaccccaaggctagccttgtggcacagatgagctggaaatggatttaaggtgcacctgagttactagagttaactacactggtagatagacccctctagtggaagtgaggtgataatataattttagatcgaaataataaatgtttaacctcaaaaaaaggaagttattaccactcaactaggttacagtggtagggggataagttcttttttaagtattgtgaaatcatgtctaaacagaatcatcgctaggctctagtccacagcttttcattgtcttgggatgcctactcattgaacaccacccccaatattgctgactttttttggtggtatgatctaatgagcccaaatttttattgaaattagggggctgggagtcaaattcttgatttttactgttagatctagcagatagcaacccctttacctgaggtggggagctattaataaataaataacactttgccttgacttaatacagacgatcaacattgaagtccaaagtctctagtctgatgtaaccatttagattcaattgataaaaatgactaggcttatggcattttgggtagaaggattaattataactagtgagtaataatttgggtgagattaagcctcttccacaagtggttacacgcacattagactttgactgtgactgtttatactggcagaatgtcagtatctagggcactatcagaaacccaatgagatttttctcccaggagaacagaattctgttactgaaaataaaagggcagcttggccatggtgcttgagcaccaaagtggttctttttggtgacactgagagggtacaagaagaaagtccatttgccattatcccatattctgttttaggcattatttctacttggattttcatgaaatgtactgacagtgttcttagcacatatgataaattcatgagtttgctgttgtgtttgatctagcataatctatgtggaatgtataagctgaactgtttcttttttgatgtttggtacagattatgaaagtagctggtataaaataaaatttgaaaatgaatatctctcaatacatgacaacaatggggtatctgtttttagaatcatgttgtctttggtcatatggcaatttttcttttggtgaagagtgatccagaaggcaaaatttttgatctgtgaaaataatacaactcatttagaagaagtcagctgggtcatgttttgagtctgtattattttagacagtgatataccatataatgtatattcagtgtgttggaggtttcaaagctttttggatacattacaatgttggaagatttttatataccagtggtcatgactagctgattttagttatgagagcgctttggttaaagttatggaaacagtctaatcgtgaaatgtcagtcttagaagatctgatcatacttgggccaatttattttagttacggaggtgagacaatttcagaagattcacgataaatttaataataccaaattttgccttagtcttgacacttggaagataaatattagtgagtataaactgttttagggatgaagaagtattgttagtatacaaaaatgaaaatactaattattttagcatgggtcttttagtcctttgcagtctggacagatagattatcttaagtaaatcattgaacttgccctcagaggaattagattctagatagtgctctgccattgactcataatttgaccttcggaaagtcatttaaaattattatattaataactaattgagtacatacatgtgccagacaccattcatgcttttgtttataaaaagagaggattgctcaagctttttggtttgctgggttttattttttcaaatattcataatctggcttatttcacttatcagttgacttttcaaactttgatgcaattgcattgatccaagctaaatactttgttggcaaattgatgactattcaggaaagtgatcaccagtgggttattccatgactaatgttagttctttaaaataaagaggtgccatttatttaattccttgacagggatttttggtgcattaagcctactgattttataatatgagaaaccttacattttcttaaaagtttagaaacgtatttgataataaggaggtagtgttgtttattggaaaagcattgagcatagaatttagggtcttttagtcctttgcagtctggacagatagatgatcttaagtaactcattgaaattttctgtggtcatatctgggtttcactttatttttaagccatgtgattccaatctacatatttcacaggcatggtaaaaggataagtgagaaacgtgaagccttggcttttaagcagacaggtgctatataaattcaaagtactgcagcagtgtatcatagaaacactaaagctttaacaagagtttacagaaatggcagggttctcatcacgtaagtcttgccacatttttctttgtctgtaaaagttctgcacccatccaatttttacaagcaaaggaaaaataaagccagacatattataatgaaaaataagagactaggttgataacaatagaataaaaacctacatgtgatactttcttcttcttttgttttgttctgttttgttttgttttaaagacggagtcttgctttgtcgcccaggctggagtggtgcagcggcgtgatctcggctcactgcaagctcctcctcccgggttcaggccattctcctgcctcagcctcccgagtagctgggactacaggcgcccgccactgtgcccagctagtttttttgtatttttagtagagacggggtttcaccgtggtctcgatctcctgacctcgtgatccgcccgcctcggcctcccaaagtgctgggattacaggcgtgagccaccgcgcccggcccgttttgttttgttttgttttgagatggagtctcgctctgtcgcccaggctggaatgcaatggcgtgatctcggcccactgcaacctctgcctccgggttcaagtgattctcgtgcctcagcctcctgggtagctgggattacaggcgcgtaccaccacgcctggctaatttttgtatttttagtagaaatggggtttcaccatgttggtcaggctggtctagaattcctgaccttgtgatccgcccgccttggcctcccagagtgctgggattacaggcatgagccaccgcgcccagcccatgtgatactttcttctatttcttacctcaaatattgtgcaaggtagcccgttaaagccattaattgggtggtgtttttcccctttttaactaactactgagtagaattttggtcttcagtggtaattgttacagagtccattggcttaccatacctcatttttagttttgtgattgcccataatgggaggtttcgtgtaaaaaacctcataaaaaatcaagtttttcctcctcataattgcagtctaaaggaggacaacacgcaggtctgggaaactgcatagtggaagagataatctatacatttaagtagcatgccatgaataacacaaaaaatggcctggcacggtggctcacatctgtcatcccaacactttgggaggccgaggtgggtggatcacttcaggccaggagaccagcctagccaacatggtgaaaccccgtctctactaaaatacaaaaacttagccaagcacggtggcacgggcttgtagtcccagctacccaagaggctgaggtgggaggattgcttgagcctgggaggcggaggttacagtgagccgagattgcgccattgcactccaagcctgggctaccgagtgagaccccatctcaaaagaaaaacagaaaaacaaacaaacaaacaaaaaaaaacagaaaatgtgggaagttaagttgaaaaataaacaccttcaaagctattaacttggattttcttttcttttcttcttcttttttttttttttttttttgagtcaggttctcactctgtcgcccattcatactctgtccagttcattgaaaatacaagtctgattcccttgagttgtgatattcatacacacacgagtatatatacacttatgtgtgcatatgtatattatataaagttttacgtgatatataatataagtttttactttctgtaaaataaaatttgttagggccgtataatagttttgaatattcatattattgtgttccacattataagctctaattacatcgtgttgcactcagattgacattctgctgttgacactgaaaataacgctttcattcatagatgaatgtaattttcaagctttttttctatatttcttaacttgcttgaatgttcccatttttgccatttcttgttgttcattttaacattttggggcttgtgtttcagatcaggaagaatcaccattatagggtgcaaagagtttgctcagaggtgaaaatgatacgaaattgtccctagagcacatcctattgctatactattcaacatgtatgaattaatctactgggaaagtgtcttgtgtagtgtgtactttaaagatgttttcaatcactttgctttggattagaaaaattcaaggtaactataattttaaatgctcatatttttatgtttattttatatgtaggaagagaaatttttaaaaattggaataacactatatcccattcttttcatttattacattataaacatgtttccaagtgatcaaatatttttaaaaatgtttaaaatcactgcagtatattttatataatggctgtttcataatttatttcactaattccaagttgttgaacatttgtttccatatcttatagataatgcttcagtaagcattcttgatcgaacatcattttgcactctatcattttttagaagtcaccaagaatgttttaaagatgaattcctttgatagtccctgaaatttaaacattggcttaaacaaaaagatagccttgatttcagtggcatttaaaaaaagaaggctgggcatggtggctcaggcctgtaatcccaatactttggaaggccaaggcaggcagatcacttgaggtcaggagttcaagaccagcctggccaacatggcaaaactccgtctctactaaaaatacaaaaaaactagctgagcatggtggcgcacgcctgtaatcccagctacttgggaggctaaggcaggagaatcgcttgaacccaggaggtgaaggttgcagtgagccaagattgcaccactgcactccagcccgggcaacagagcaagactccgtttcaaaaaaaaaaaaagaagaagaaaaaagaaaaggccattctttatatagtgtattgtatcatatgtgactctaaactggaacttgtttaggtaaagtatatgtcttggaagtattttggttttctctgatctagttagcaggtgcagagcaggatgaggtaggattctgtgctgtgtacaatcataggaagttctgttttttgaaacggaactgttaatgggggaagggagacacgtttgtttttaagaagcctttatgtttaatattattataaaactcagttcaagtatacaaagcttatttgtgcctatgaacattcagtatcctaaagaaacatttaatcctggtgttggctaaatgactatttgctgatatgcccttttatctcaaggctattagtttcttaaagtactttgatatcactcaataaactacagttaaactcagagttttacatttcattcaggttgcttaaataatataactaaacataggtccaataatagtaaaaattctgatgctgtcacttaatttgtgcctggtttcagtatatggcgattgcttaaattacaagcacttgaatttacaaatattttgtgtatttaaatggctcattgtacattacatatccctcctgaaacttaacccatgccatttcacagacccttccatggtgtttttctctttcctccagttcactagcctcactcaccaaagactttattggtctgggaattctattatgacccagaagtgacttggaaggttcctttcacccaacaacacattctcactacctttcttttcttttcaggggcatcatttacatgctatgttgcacagtcagaatggattttagcataaagtatgggttccaatagctctcgcattttattatttatttatttgtttagagacagagcctcactttgtcgcccaggctggagtacagtggcacaatctcggctcactgcaacctccatcccccaggttcaagcgattctcctgcctcagccttgtgagtagctgggattataggctcctgccactgtgcccggctaatttttgtatttttagtagagatggggtttcaccgtcttggccaggctggtcttgaactcttgacctcgtgatccacctgcgttggcctcccaaagtgctgggattacaggcatgagccaccgcgcctgggccagctctcccattttatatctctgtggcattgaggaggtttcttaactctctgaacttcagttaccccatgaataaaatgaagataatccactcacttttcactttgttctcataattattatatgagaacacttataaagcaactagcatatggtaggtgctcaataagtattttcatttacaggttgattaatgttgccttagatgatttttgtcaggcatctatatctacctctttttctctaatttgagtaccttcctaccttcctttttttttttttttttttggacagagtcttgctttgtcgcccaggctggagtgcaactgtgcgatctcagctcactgcaaccttgacttcccggggctcaagcgatctccgtgcctcagcctcccgagtagctgggattacaggcgtgtactaccatgcctggctaacttttttttgtagtttgttttttagtagagatgggatttccccatgttgcccaggctggcaagattttagaaattagtggggttttttgtgttttatttaatggtattggaaaaacactccttttattgtttttcattgtgaatgtgaaggattctagccatgtttcaggttgaagaagcttcttcgcttagctcagaaacctgtttatcgtttaatttattctttttttttttttttttttgaaacggagtctcactgtgtcgtccaggctggagtgcagtggcgcgatctcagctcactgcaacctccgcctccgggttcatgcgattctcctgcctcagcctcccgagtagcagggactacaggtgcccaccaccatgccctgctaattttttgtatttttagtagagacggggtttcactgtgttagccaggatggtcttgatctcctaacctcatgaccacccacctcggcctcccaaagtgttgggattacaggcgtgagccactgaaccctgccatttaatttattcttttgtgaggatatgtggagaactagccaagacccgtcacagtggtttacgcgtgtaatcccaacactttgggaggccaaggcgggcaaatcacttcagctcaggagttcgaaaccagcctggccaacatagcaaaactctgtctctactaaatatacaaaaattagccaggcgtgttggcccatgcctatgtacccagctacttggaaggctgaggcacaagaatccctcgagtctgggaggcggaggctgcagtgagccaagatcgtgccacttccctccagcctgggtgacagagcaagactctggaaaaaaaaaaaaagaaaaagaaagagagaaagagaaaaggaaagaggaaaaggaaaaggaaagaaacaagaactcaccttcaaaggaaaattggaaacatggctcagtaaattacagacaccgttataaactcaaggccgctaacaaatacagcttaaatcagaatgaaaggtaataggtagtgttgatacctgacttgtggaggaggaaaaaaaagtaggggcaaagagaaaatatattattgaaaacttaaaatgctgaggatggcagagggttataaagtaaaccaatatgttttcatgatgacatgtagcctttaaaaatggctgaatctaaaacatatttatgatgcccattattttatctagtggaaattttcaaaagcaaaaaccaggaaatgatgaaggctattgacacattcagaaaatattctgagcagtttgtgggtctccattgtaaagctacagttgaatcatttttacaagtgggtatgaataattacaattttatattttgtcctgtggtaattaaaaagcaaatagagccaaattatcattaagcgtaactaacagaaaagtaatattgatagatttacatgtttaaaaatataagccaacccatgcattcagtattttatcctcaaacaaggtgttccagctttagttgacactcagataaaaagcaaactagtggctgggcatggtggctcacatctgtaatctaagcactttgggaggctgaggcaggaggattgcttgagcccaggaattcagaaccaacctgggtaagatatcaagaccctgtctctattttttaaaaaataaaaatagaaaataaattttaaaaaagcaaactagaatatatctagtaggtgctagcagaaggggaaaaattctctaagcagagatttgtgtaaaaatgaagggaaggttaataagtatctagaaactgtaagtgttgtataaaagaaggcttatagaccattggtaaatagatgtaaaactcaaggaaacttttaaacgtgcccaaagttcttaagtatatattaagatggtacaaactacagatgaagtaatagttaaccaaatatactaacatgcacaattgcttaattagtctatttgtggaatggtttcattattcattcaactaccataagtttaatgcagactgttaggtgctagggctacaaagacggataagatactcctccagtctagtagaacagaaagacacaaaaataatcttggttctcatgaaacctaaaaatattcataaatgtagaaaatgaatttagaccgtgcccggtggttcatgccagtaatcccagcaattagggaggccgaggcaagtggatacctgtggtcaggagttcgagaccagcctggccaacatggtgaaaccccgtctctactaaaaatacaaaaattagccgggtgtggtggcaagcgcaagtaatcccagctacttgggaggctgaggtgagagaattgcttggacctgggaggcagaggttgcagtgagccgggattgcgccattgcactccagcctgggtgacaagagtgagactccgtctcaaaaaaaaaaaaaaaaagaaaaaagaaagaaaggaaaaaaaaagaaaatgaatttaaatacagccttttttctcagcataaaataatttctaaatataaaccttgtgtgaacaaagaaattcacttataacccaatataatcaaatctaaactaagaacaaatctcatttaaacattgttatttctttgcaataattattgcataccaaaaaagagcccactatgagttaatgttacttaaatagaacattgctcagcctacaaatgaaggtcagcagacaccagtgtcttggaataaaatagccctttggcaagaaaacgagccacaccccattaagtttttacaaaaataaaattctttccagctttactaaattgtagatgttgcgcccagcatgtacttctgcagtagttgattctgcagctgtggaaatattcatgtatgcagaagtccccaaaaacatctattcaccattacttgcacatgcagctcttatactttctgtagtaaagtattccgttaagttttattttgactcgtggataatagcaagcaactacaggtatagctgacaccttaatttcctgccttgaacttctggccacagactttatttttttattttttgagatggagtatcgctctgttgcccagactggagtgcagtggcataatttcggctcactgcaacctccgcgtcccaggttcaagcaattctcccgcctcagcctcttaagtgcctgggattatggtgcataccaccatgcctggctaatttttgtattttttagtagagatgggttttcactgtgttgaccaggctggtctcgaactcctggcctcaagcgatctgcccacctcgacctcgcaaagtgctgggattacaggcatgagccaccttgcctggcccattgtcacagaattcaaattgagcaggaatacgtaggatttcaaatctaacagttgtttcatttggtgggatagcatcaaagccatgtactgtgaccactgtatatggttttcttcaagagcagcaataaatttctgccatgtaccatgggaaagagctgtacttttagggagaaaggaaataagccctgagaaaaagccccattttcctagttcctttcacagttcacctggcacacaacgggtcttgatatttatatttgaaagagtgaaacatggatggccataaatgctccttgctgataacgattgaattgggaaaatctaatcaggaaatcagtgatttatgaattacattgcataaaatacataatgatgggagcctgtaagaagactaaacaaatggcttccttagtttatttttcctttaggttttagttgttttcagtgaatattatgagtgaatgttatcgatagtgttttcattgtgagaactgctaaactgtagagtcaaagaagaaattgggacatattaatattttgacttttatgccagctttattgagacataatatcatactttttttttttttgagacagagtttcgctcttgttgcccaggctggagtgcaatggcacgatctcggctcaccgtaacctccgcctcccagattcaagcgattctcctgcctcagcctccctagtagctgggattacaggcatgtgccaccacacctggctaattttgtatttttagtagagacagggtttctctatgttggtcaggctggtctcagactcccgacctcaggtaatccgcccacctcggcttcccaaagtactgggattataggcgtgagccaccgcgcccggccccataccatctatttttatagattttagtatattcacagataacatgcaaccttcaccagtcaattttcaaacattttcatcacctcagaaagaaaccccatacactttagctatcaccttccacagcactctacccctgcaaccctaagcaaccactgaactatttcctgtctccattgagttccctgttctggacattacatataaatggagtcatataataggtggtattttgtgactagtttctttcacttagcctaacattttcaaggttcacacaccttgtagcaagtatcagtactctattcctttttatggctggataatatttcattgtacaccatattttgtttatccatttgtccatcgatggatatttggggttgtttctacactatggctatcataaataatgggacatgcaaacattaagtgtctatccatgagtcccctaatgagttagaggtggtgctgacaagataacatttcacttattaccactctgctcttaatataaatccttgctttgattaagcactaccgatttttccatctaagtttttttgttattttttgttccttgagacggagtctggctctgctgcccaggctggagtgcagtggcaccatctcggctcactgcaagctccgcctcccgggttcacgccattctcctgcctcagcctcccaagtagctgggactacaggcgcccgccaccacacctggctaattttttgtatttttagtagagacggggtttcaccgtgttagccaggatggtctcaatctcctgacctcgtgatccacccgcctcggcctcccaaagtactgggattacaggcgtgagccaccgcgcctggcctctatctaagtttagctattttttttcttgtttcctgatgcttattggcttatcatcgacttgttctcaataacgttttccttagtagtatttatactggaataatagaaagcctgtaaatgctgtataatcatcttttctaaaacttattgtataataaacatttagcacagttttgtttaatcacattttttgaacactaaggagcaaaggcaagcagtattaaggagtacaaaagtacatgataaatgctttgaaatgcaatgggttcaatcaaccaaaagcattattgagcacagctaatatatttacttttaaatgtactattcaagtgtgaaatatatccatatagaacaaaattcaaaactcacaaagggccataatgataagtaaattagcctctaacacttaatatttttaagaagacattagtgttttacgtttaggtattttgacagtaagtttgagggagtctttatcttttgaccttttggggtgaatatgagaatgaaggaatataaaaagatgattaaaagaatcaccaggccggaaatgacggctcatgcctgtaatcccagcactttaggaggccgagacaggagaatcacttgagctcaggagtttgacaccagcctgggcaacatagcgagacctcatctctactaaaaataaaacaaaattagccaggcatggtggcgtgcgcctatagtcccagctactcaggaggctgaggtgggagggttgcttgatcccgtgatcacgcctctgtatttcagcttgggtgagagagatcctgtctcaaaaaaataaaataaaataatttcctgcaatttcagattattcttttaagcacccttgaccccagattcaccagatcaaaacagctaatgactcatagaactttactctgtcattattttccagattcaacccacagcgaaatttttgggatccagtctccttactcttatgggcaggcggaaccttgcagatcctttaggaaaggataggcttccctgagaaaggtgggctggagttaagtcaaaaaaaaggtgcaactttctggagtcccatttagaacttcctgcgtatttaataggcctttgctaattattaacaatgtgcctggcacactaacataaataaaacagtgtgccatcgtttgaagagctgagtctaatccacctactgatttttacaaaggaggcaactgaagtctgattttggcttgcctcagcatagagtgctccaggacaatggtggaggatcaggtcgccatcactggagacccagattgtagtaatggaactgatccatcattcttctcactatatatttaaactccatgtccagggtcaactttgtttagtagcagtgcctcttccctgaatcagtttgtatctacacttaatttctttcagagattaataaaatgacaaatgctatctcaataaagttaccatgaactctctgaaactcatatcacccatgactaaagcaacttgctttgagtctgacaagctcttccctagctaatggaaatgcattagcaatagctttacagtggtaagctatttttctaggtcatattcaacccagagtagtcacatgctgacaaaacttcaatcctaaacactgatcataaagagtttcctatattgtatgtaatatatccaaaagtttttgaaaactctaattccagtatattgaatatacattatagggtttatcactcctgatttttttttaattgagacggaatcttgctctgttgcccaggctggagagtagtcccgtgatctcggctcactgcagcctctgcctcccaggttcaagcagttctcgtgcctcagctccccaagtagctgggattacaggcgtgcaccaccacgtctggataatttttgtgttttttgtagagatggggtttcgccatgttggccaggctgatctggaactcctgacctaaactgatcctcccgcctcggcctctaaaagtgctgggattacaggagtaaaccaccatgcctggcccactcctgatttcttctaaactggattttatcattctcagagtcagtgtttcctctctgtattactccttgcctagaaaaaaaaatgtccatttcattcatctattcattgacttattcaagtacttaccgagcaccttatatatgtcagatactattctaggcactggggattacagccgtcaatgaaacagacaaaaatcaccgtctttatgaagcttacatcctactaggggagagatagaaaataaacaatgattttatatattagatgctaatgtgttatggagaaaaagtaagattaatggtataggaagtgggaagaagggtattgccatttcaaaatatgtggtcacagaaggcattactgagagggagatatttcaggcaagatatgaaggaaatcaaggagtatccatgtgaatgtttggggagaagtgtcacttgaacaagtaaaaaatatttctaataacagatacctaaatcatcatacattgatgtgtttcagccctgaaattttcctttatgacaactcctttttattttggtattgaacagaaaaaaataactttcacccagatcaaacactctagtggagtcatgaactgactatatatgctaagaatattgtgtcagaagttatgtcaaaaaagttttgaaaagataaagctaggcgtggtggctcacgcctgtaatcccagcactttgggaggctgaggcaggcggatcacgaggttaggagatcgagaccatcctggctaacacggtgaaacctcgtccctactaaaaatacaaaaaattagactggcgtggtggcgggcgcctgtagtcccagctactcgggaggctgaggcagaagaatggcgtgaacccgggagacggagcttgcagtgagccgagatcacgccactgcacaaaaaaaaaaaaaaaaaaaaaaagataaagtgggaataatgtttaaagcaggatatagaattaatacaagtaaatgttcttcattttccctattaatttaattatactatattctgtgtttaattctgaattagattttttaattaaactttttattttgagataattgtagattcacacctacttgtaagaaatggcacaaagagatcctgtgtacctttacccagtttcttccaatggtaaactcttaaaaaaccatagtacaatagcaaaaccacaatgttgacactgatacagacaagaggcaaatgagtttcattaccagtagaatcccttttattgtcctttgataacaacacacacctccttcctcccctgacctccatttttgaccccaggaaaccactaatctgttctccatgtctataattttgtcatttaaaaatattatataaatggaatgatatatagtatgtagcctttgggaattagctttttttctctgagcgtaattctcttagagattcaacctaagttgttgtgtatgtcaatacctcgttccttttcattgttgaatagtattccatggtgtgtatgtaacaaagtttatttaaccattcacccattgaaggatatctgggccatttccagttttttagttatcacaagtatttgtatacaggtgttagtgtgaacttcagttttcgtttctctgggattaatgccggaagagtgcaaatgctgagttgtatgagagttgcatgtttaattttataagaaattgccaaagtgtttgcccagagtgactgtaccattgtgtgcttccaccagcaatgtatgagtgatccagtttttccacatccttgccagcctttggtggtgtcactgtttttcattttagccattctgataggtgtgtagtgatagctcattgtagttgcattttcagtttcataataactaatgatgtttaacattttttatgcacttatttcccatctgtttgccctcttcagtgaaatgtctgttcatgtcttttacctattttctttcatttttgagacagggtcttgctctgttgcccgggctggagtgcagtggcgcaatcacggctcgctgcagcgtcaacatcctgggctcaagtgattctcctgcctaagcctcccaagtagctgggactacaggtgcacaccaccattttattttttgtagagttggggtcttgttatattgcccaggctgatgtgaaacgtctggcctcaagcagtactccgcccttggcctcctactgtgctgggattacagacatgagccaccatgcctggcccttttgtctgttttctaattggattatttgtgtttttactgttgtggaattttaagaggtctttatgtattctagagtctaattctttatcagatatgtggcatacaaatattttctcctcgcctgtagcttatcttttcatcttctgaacagaatctttcatagaacaaaaggatttatttggtgaggcccactttatcagtatttccttttatggattgatttttggtgtcatgtccgagaactcttcatcaaatcaggttcctgaagaatttctctttcccccctaaagttttatagttttatgttttacatttaggtctgtgatctgttttgagctaacttttgtgtaaggtgtgaagtttgggttgaagtttcttattttttgttttggactgtgtttgtcctcgtctactgacatggttttttgcacccttgtgaaaaatcattgaatatatttgtgtaaatctgtttctgggttctcttctgttccgttgttttgagtatctgttgctctgtcagtatcacactgtcttgattactgtagctacatagtctgacttaatgccaggtggagtctattcaccttatttttcaacagttttagatgttctaaggcttgttcctttccatgttaatttttaaaagaagcttgtctataactacaaaaactgttctaggattttgagaggaattgatttaatgaattagacttttgaaattgcatatgtaatgttaataaagttaaaaatggtaattctgttaaggaaaacaatttagttccttccaaagtctaacgctagttcttattttctgaagaaatgtgtatttttatgattttgaaattattgaatgaatattaattagcagtttcttttttattttttaaattttttgtgtggagatggggtcccactatgttgcccaggctggtctcaaactcctggtctcaagcaatcctcccgcctcagcctcccaaagtcctggtattacaggcgtgaaccaccatgcccggccagcagtttcctttcagccataacatgaatgaccttttttaatggccaaaattgaagtttgtcaggttctaaatcactaatatgtttttgaatttaaaaatttttgaaggtttacttctggaatttttaagaccaaccattagatttataaggctgttaataagattcctaaacctattgttttgccttaaggaaagtatggtttaccttttgtgttatcccaaacaaattcatctccccatatagcaaaatggaatatgctactaaatagttgaaatttagggtaatggagtttgggatatgtttattattcatgaatagtaagtcaaaagtttttaaatgaaaacatttgtgtattctcatgctttgattgttgattctgcaaaataaaatcttaaaaattacaaaaagcatctgataaacttcttaatttaaaagaacactcagaaatttactttcaggtatttaaaaaaagagggaggctatcaaactgattaggactgaagaagaactgaagagataatgtcaccttgttggttttgggtgagggaaaattgaatgagatcatgctttctttctgtcttgctttctcaagataaagcttttccactcttctgtctgcttactgattcagggtggcaggcacaaaacaaaacgttccggttatattttccatcctgtttatatttaaattggctgtttattctttaataaagtgtataactgttggtctataacattatgaatgtgggattaagtggttagacttagcaggaatttgaaaatcagggtccaaatgtactaccctaagtacagtagcagaattacttctataaagaaaacttccctaagttacagcatctggctcatagcattatcattacagtgaagtttaccatcactcatattagtgatgtgttacttcccacttactcctaaccctgcttaggtaatgcaaaactataatttagaaagtgtgatttaaagaagatgcaatataatggtactcattgtaaacatatatccagatttctttcttcacatataatttatctgtatttttaaatttattttgtctaatgaaagacttttaaaagctcattctctcgagcagtgaattctcagctagtgagccaggacagtctgcctcatcaaaagaattctgctaattgctttagccaatttctgaggtaataagctgggagagggaagaggttggttactcatgcataggtgactttttgctaacagtgtgatttttaggaagtgaagaccacaaaagctttttgacttgtggcagaattcattatgatgagactttagctgtaccaggtaacagattgccaaataaaacaccaaacaagcaagattggtcagttacaatccagtctgtagtagtctgatccagcatagtgttatgtttatggattcaattccctcctcgaagtcatacaattgaggcatctcagtagaaataaaacaaaataaacaaattttgtagggaagctcctatacatttgaatggtaagggcatataactattaatactttatgagaccatggtattttgcagccaatcttaaggataaatctacattgtgttcaggattctgtgttgggccagacttaacaatgaccattatgtgtagaaaatagcaaccattgttgctgaattaaactctctctggagatttaaacatttttttaaaaaattaagctaataggccaagcgtggtagctcacgcctgaatcccaacactttaggaggccgacgcgggcggatcacttgaggacaggagtttgagatcagcctgggcaacgtggcgaaagcccgtctctactaaaaacacaaaaagattagccaggcatggtggtatgcatctggtcccaggtactcgggaggccgaggtgataggatcacctgagcctgggggaggttcaggctgctgtaagctgtgattgcaccacggcactcagcctgagtgacagagggagactctgtctttaaaaaaaagaaaagaaaagaaaaagctaataaaaccttgatgacaacatagccaaagaaattaatcagagaagagtggtgattagaaacagaaagcatagtggaatagatgaattacacctggcaaaggaactctaaactatattatgtaaagctcaggacagtctacttgtctgaaaaagaaataccaaaagtatacacatgcaaaaatttggatttttcagctggactttttgtgaaaggttccctcccaccccaaattcaaaagaagtataaagcaggccattcatggcaaactcccaatgaaatggaattaatttgtattgtgttttgaaagtgtatatatgtgcttgcaggaattacatggaagaattatactgacatagagtggctctcaaagtgaataatggaatcttaaggatgttttattaaacagcgagtcaactatttttctccgtgaatgtgactccacaatgatagtggaagtcagaaaatatttcacatgcaaatatatctgaaattcttcatggatgtatttaacgctttgaagtgatggcaacatctggtagcaagtagaagccagcgtcttaaaagctatggcttcatgttactacttcatctgaattagtcatttaaaggggattttatatgtcttcctaaaaactgacgaggttaatcttagactagggcaggctggcaggaaatgctaaagcggctctttcttttgaaggttttgttattccttgtgaggtcaaaaagtagttgttttaaagtttggaaagctaaagcagtgatgttttgactcttgacagtgagatgtttttctttttttttgggggagggtgtgtgtggcaagtttgaggaaaaacttgatacactgagagttctttatactttccactccacttattttctctcaaatgaatttattttctaaaggtgcagaatttagaaattcgtttcaattaccaaatctgagcatggatttggtgctattagaagatgtaaccaccatgtgtttggccagattagctttcaggaatgatcgtatcttacagagttagccaatggaacaagagtagatgccttttatccttatttatttgctttgcattaaaaagacaaatgctgaaagtttattcttgactatgaaataaaccactataatatatgacactgagttaattcctttaggatgctatgtcttccacatacatccatttaataaatatttgttgagtgcctactgtatgccaggcactgttctataagctgaaaatagattgctggacaaaacagacaaaaaatcactgccctcttagagcttattaaatacgaaaacagtagagcaatttaaaattatttaatgctatcactcagcttttaaagatcttcactgaatgagttttgagaacttttgcacatattatctacagcttgaatagggaaaaaatgacattttgtttgaaatctagttcaagaagctagaagctgataagtaaagtaaatattttattctgtgatgatcattttcagttttcatttatcagtgttatacttaggcctcttgaggaatgttactagtttaacttgtggatttcctcctgaggatgggcttaatttgtattgggggaggtggtgaaaggacctagtagccctggaatttaatgtaaagtcgtggcatttgtaaaactatcttctgtcatttgaaaaattatagaatacttaaatgtatttaatgctccctgtggaaaatgaatgtattgctcagttatttttgcctatgtgagtagtacaagagctgactcaaaggagatgacatgatggttcctgtcctgaagtgaaataagatgatgggttgtggtggaaaaatgatgtggtcatgcccatatttgctcacatctcttgttcgtttccttttatagagggaaaccagggaaagtctcatttcttattttttgtttcctttttgtattttctttcatacgccatttccctttctttttttcttaaaattgcattatagtgacttccaattcaattggctcaagttgtacttggtaatgacataaagaaataccgcttagaaaggtcatagtggaagcattatacccattttagggaattgattatatatatagacacagccactctgagccccttgaggatatgaaaagcatgttgcagaaatcctcatatttcctgatgccaactagtatagtgccttttacagaatatatgcttaatcggtatttatctattgaacaaatatgagccatgaaatttaattttgctctccaaaatcccaagtcctttatataagtaggcagaaattttaaaaagtctttttttttgtttgtttgttttttgagacagagtcttgcactgtggcctgggctggagtgcagtggtgcaatctcagctcactgcaagctccgcctcctgggttcaagattttctcctgcctcaggctcctaagtagctgggattacaggcacccgccaccacgcccagctaattttttgtatttttagtagagacgggatttcaccatgttggccaggctgatctcaaactcctgacctcgtgatttgccctcctcagcctcccaaagcactgggattacaggtgtgagccactgcacccggtctaaaaacttatttttatggaattattcaaatacataatgtaaaatagcattaaaaacccccagctttaacaattaccagtatttcatgttcttatttcatctttgctctccccttttttgagatttgctttaaaataatccgcatattgttttaccgataaatactatagtatacttcttagtttttaatattttaagatagtagtgtttgcatttcatatggagttttacttttaaaccctttctgtgctactttatgcaagagaaagaaattcttaaccgcttatcagaagaaaaatctaatttttttttttttgacggagttttgctcttgttgcccaggctggggtgcaatggtgtgatctcggctcacagcaacctccgcctcccgggttcaagccattctcctgcctcagcctccgaatagctgggattacaggcctgtgccaccacacccggctaattttgtatttttaccggagacggggtttctccatgttggtcaggctagtctcgaactccagacctcaggtgatccacctgcctcggcctcccaaagtgctgagattacaggcgtgagccactgcgcccggccaagaataatctaatttgctgtgtatgagtaggatgttaactcattttgtaacatatatttcctttcttaatcttttaaaaaattttattaaaagtttctaaacaggccgggcgctgtggctcacacctataatgccagcactttgggaggctgaggcggacaggtcatgaggccaggagttcgagactagcctggccaacatagtgaaacccggtctctactaaaaatacaaaaaaaaaaaaaaaatagccatgtgtggtggcaggtgcctgtagtcccagatacttgggaggctgaggcaggagaatcgcttgaactcgggagggggaggttgcagtgagccaagattgtgccacgcactccagcctggaggatggagtgagactccgtctcaaaaaaaaaaaaaaagtttctaaacaacattgtacatgttatgtcatgactgtcatgataaagtcttgccttttagacatgaacctgattcagcaaaatgtgctttgaagtagataagctgtagatttttgtcttgcctgaattgatattaaagagatgttttttcttttcacagttcaaaagtacagaactcaggttaaaacctagatatgtaattttgttaattttattttcagtttgaaaattcttgttaaaacctgcatactttataggtttgctgtctctaaaattagatggctccttcataaatattactgaataaagcaccagttttcaaaaagtgtggcacatgggctcatgggggttaaaattactttcatgataaaactaaattgttatttgttttttcactgtgttaacatttgcactgatgatgcaaaagcagtagtgggtaaagctgctgaatcaagatagtggccccacactgtagtgatagccactgtattcctcagcaccataccatcacctttagaaaaaaatcttacaacatgcatttcatttacaaatgtacttgatgaagcaggaaaaaataattgtattaaatctcaattcttaggtatgcatctttttaaatattgtgtgtgatgagataagacatacccataaagtatttctgctgcatatggatatatgacgattgtcttgagggaaagcacttgcgcagctgtttgagttgtgagctaaactagctgcctttttaaaaatagaaaaccaggccgggcgcggtggctcacgcctgtaatcccagcactttgggaggccgaggcgggcagatcacgaggtcaggagatcgagaccatcctggctaacacggtgaaaccccgtctccactaaaaatacaaaaaattagctgggcgtggtggcgggcacctgtagtcccagctacttgggaggctgaggcaggagaatggcgtgaactagggaggcggagcttgcagtgagccgagatcgcgccactgcactccagcctgggcgacagagcgagactccgtctcaaaaaaaaaaaaaaaaagacaaccagttttactttgaaagattgaattaactgattattcagacccgagtatctaacagatactttatttttaaaaaatgaaccaagtgtgcctctcactgcaagggaaacaactaagagtatttgttgccaatgctaaaattagagctttcaagcaaaattcaaatttttgagaacttgcattggtcaccattttatccgatcaatacttaggcttttctagtgaaatcgacagtataattaatgaaaataatgtgttagattttgtataatgaaatgtatcagcatttggaagacccacataacttactgaaacaatatttttccaaataactaatgtatgatgttacaaaatcaagcatgggtaaaaggcccattctaagtgcaagacagacaaatagattttgaaaaaatcattgatattgtatcagactctacattgcaaccaacctttgaaaaactaccacttctctcgagttttggtgtagtattgaagaatatctgtaagtatctggaaagcctcttaaagtatttctttctttttacaacagtttatctgtaggaggccagatgttcttcatgcactggaaccaaaaccggtattgcaaaagattgaatgcagaagcagatatgaaaacccagctttcttgttctaggttaaacattaaagcgatttgcaacaatgtaaacaatgccacccttgtcactacactttttttgaaaatatagttatttttcattaaaaagcttatgttaacatgtaatgggcttattcttatttttaaacaaataaatatcttaaaagtttcgtagtcgcaatttttgatgtgacaaatacactgatagatctaacccatgtgtcaccaaactctttgggatcctcagatcctgaggccaaaaagtttaggaactgctgagttgggttttttgttgttgtttccctccttatccctttgccccacccctccacttttctcctattcccctctcctttcttttctttttttgagtgagagagagaccctcaggatagaaaattgtagagcatgtgagttattcctttgtatgtttttattagctacgaactgaacatgtatgtcttttaaattcattcattgccccatgtgtagttcgatgtattttgaccttttcttttatttattttaaaattttgattacttagttacacaaataaagagctaataaatactatcagggagacagcccttggaatattgaattttatattttcttctgcgacagtcttgctctgtccgtgcagtggcaagatcacagctcacctcctgggctcaagctatcctcctacctcagcctcccaagtagctgggactacaggcgacagccaccatgcccagctaatttttttgtattttttttgtaaagacagggttttgccatgttgcccacgctgctctcgaactcccgggctaaagtgatccacccacctctgcctcccaaggtgctgggattacaagcaccagccaccacgcctggccagaatattgaaattaagatatattctgacttatttttccccaaatatgaaaaaaatgattacatatatgacttgattattaaaattgacacatccatgcaacaagtttatatacctaatgctgtgcctggtatgaatttcctaaactttccaatatagtcccaaaattacagtagtagtttcttgaatgtaaacttgttgcctgttttatatgttagatccctttgcttctatgcttcactcactatgtttgtttgttcgctttgtttttataagtcatgaagatggaaaaaaaactgtttcatgaaaggaaaatagatgagtgttgttgaggtgtgtcattaagcacagtgggagaggcctccaatgtacgtgtcacacatggaaagtatacctagtactgggtgtggtggagagcatgacgtctggatgaaagttgtaagagactttaaaaatactatgcctagcttttgtgttacaactacatattccactgatacttatgtgaaactcccataacttttcgggttgtacctcttttttccaccctggggtgggagtgtgtccacaagtgcatgtgtgtgaactcttaactttgtgtttgtattttgagatggagtctctgtggcccaggctggagtgcagtggtgcaatctctgctcactgcaacctccacttctggggttcaagctgttctcctgcctcagcctcccaagtagctgggactacaagggcacaacaccaatctggcttttttgaatttttggtagagacggggtttcaccacgttggccaggcttgtctggaactcctgacctcaggtgatccgcccacctcagcctcgcaaagtgctgggattacaggcctgagccaccgcgcccagcccggcctgaactcttaactgtatggtttctgtttgtaacatctagagagagtgacagtgagaatttggtttccgtcggctttccttagcattcattttgatgaatttgggatgcaatttaaaagctgttttcattctgtggcctgctgatgaaaatgtagaatttattgcagaacccttgccaccgtcttgcattcccaaaccagtgttcattacccatagtaaaaaccgagatcctgttcacacacatgcacatacacagacacgctccccaccgcccccgtcacgcacacacccacacacacctcggatggtgagtgagatagaagtttagtttacatgctaaaactggttaaattactgatgtggtagaactgtcttttagcccgggcacagttgctcacacctgtaatcccagcactttgggaggccaaggtgggtggatcacctgaggtcaggagttctagaccagcctggccaacatggtgaaaacccgtctctactaaaaatacaaaaattagccgggcatggtggcaggtgcctgtaatcccagctactcgggaggctgaggccagagaatagctggaacccgggaggcggaggttgcagtgagctgagatcgaaccactgcactccaacctgggcgacagagcgagactccgtctcaaaaataataataataaataaaagaaacaaaaaactggccgggcgcggtggctcacgccttgtaatcccagcactttgggaggctgaggcgggcagatcccaaggtcaggagatcgagaccatcctggttaacacggtgaaatcccgtctctactaaaaatacaaaaaaattagccgggcgtggtggcgggtgcttgtagtcccagctactcaggaggctgaggcaggagaatggcatgaacccgggaggtggagcttgcagtgagccacgatcccgccactacactccagcctgggtgacagagcgagactccgtctcaaaaaaaaaacaaaccaaaactgtctttatgtcctacctagcatttactaagtagaagatgtgcccttttgaagggcatgtctattcctagaactttaactacaatgctttgcagtagaaatatatgctattgtattaaggtgaagtgactttagaattagtaactcggtgttgacagatcatgctgatcgaagattagccttggagtttggaaagctggagagcatgtatattccagatgaccaggaaaggaaaagtcagaaaaacagtttttaagtagtactgttataacgacctgtaaaacttgaaacgagagaaagctgtcttctaaaatgaagaattacatatttaaaacattaatttcctcaatgatactgctacatatctgaaaagggtggttacgtagcatttgggacagacccgtctcagtggtttgaggcaacaggtgtggctgaagaaaaggtaaggctggggaaaaaccaacatttctggtctaaactgatactgtcttcttacctgaggcagtttcctatgccctggttttctctgtctgaaaaatgcatgataacacatactcttcaaattagctcaaaatgcttggtagttacctactattccctgacaggccacaggcagatagttctatgcttgttttagaaatggagaatttggtactcagaaaagttgaagaagcttcatttcattcacatagtgagtcagcaacaaggacagacggaaaaacatgtcctatgactcctgccattgtattccttctcttctgcattgtgttgccttttgatatttcacgaaggttttgtgattggtgaaataaattaaagcacttccatgaaggagacaaaatgtaacccagtgtctgctgatggtggttagtgacgaggacaggagaacactgcctcataatggggactatccggtgagggctccttttcacaggtgcccacactgtgagtcacctccttatgctgagagttcggtatgctatcataaaatactttgttgtgtattatttatgaaggactagagtatctattgtctcactttctttcattctcatgaggtagattacagcagcagatggcattatgcatgctttatcccagacacaagaaaataatatctgccacttactgagtaccttgctggacccagacactcttacatatttatatcttcccattgggtcatcccgtggaccttgtgaaatatgtggaatagctccattgttatagatatgaacccggggctcagagaagctaagtaatttgttcagggtcacacagacttacaggtctgtcagactcctaagaccctgatgctttcattgtgctgcatttccttcaaattatgaacttgccctatgtcagcacagaaacggcctcttcagcctagcccagtgctccaactgattgttctctctcataaaaggcactcacaactaaccacttgcttgatttaggaattcactgattagattgctagaccagttaaaggcaaatttcaataatgagagcagttatcacgtatctagtacttaccatgcgccagactatgatctaaatttatgacacatattaaatcatttaagccttacaaccatgtataaaatagtgaactgcgatatgatggagttgctcttatcttcatcccgggatgagaaaatagaggcagaagagttttaagcaatttgcacagttaataaagtgtggagccagaatttgaacccaatctggctccagacctctttactacagctctcagttagaaaattatttctaactgagatatttcggttcagcaagtgttggcttagttcctgtgtgctatgccagcagaaaatatagttcctacacagaagagcttacatttttgacataaatcaaaatgtatatacttgaaataaatgctacaacaccttagcatatggggtgtaaatgttgtgtatggatcagcatgaataatagagactgttagtgagtggcttgagagttaatttgccttcgcaagtaatgttcttgactatggacgagtgacttgggcactggggagaagctgttccatgtgttctaaaataagcaggttacttggctactgttcaaactctaaataggtatatgggttgtagctatttgacctgaactaactttaaattcccctgagtccttatatgattttggggaaaaaaaaaaaaggaagaagaaaaaagaaaacttttctctgtaaatgctgcatttaaattagaatttattaaattctctgcaaaataccgccaggctgacaggaaggggattcgtaagtattgtatcattcttttgtcagggtgttctctttttctagcaggaagtgttgtgacttgctctctaaagttgcaattgtaagaagaatgttgggtttccagattgctcttctgggcgtgggagaaggttctgtctatcagtgctgcgagaaaggaaagaaacaagtttgctctcagcgggtaactattttaatattattttgacaggctctaactttgagattactaaatctaaatttaaatactaaatgattaagcaggaatttacgtcaaaaagcttgaaattcctgttatttatttgggtaaacatttggagtcactttaaaaatattatttattcaagtagaataaaatttttgttaagagaaaattttgaagtttagattctaacctgttctgtgtgtattctgtatttttctttatttagagaatgtttagggagtttatactttttaaaaatgggttttgaaatcctaattatacagccgtatttatcaagttaagtatctaaaacactaaataatagaaattattgtctatatttgtggtgggggtgggatttcaaatgcttttgatcccagttacatggtttttcaaaattctgtaaaatggaggttgaggtggctgtcatgacagaacatgtcacgattagattgatattatactcttcctacgtgagttaaatcaaacagttgtcttagtgtttataatttacaaaataataaacatcactggtgattaaattttgatggcgttattggtacttggcagcaatagtgatttctggtgctcacatacattaggattttccatcacatggttgtcatataagtttaatttccccatatttctggcaaagggaagtatagctagttatacagtcaatcctcactctgagttgagtcacctctcggactggttgtacttaatatgcgcatatgaagtaaaaagtgaagcatgaaacaaaacaaaccagttttttcaattaacaagtgctgtatttgctaacatataagcaaggtatataacactgcaagaggcattttcagtgacttgccgatagctttctgcttcgtgtatatagtgatttgagttgtaggtcacaatattttatggcatttttattttgaattgaagtgaagcatggtaactagtctgatcttgcctagcctctctctctctctctccctccctctctctctctctctctctctctcacacacacacacacacacacaccccacacacacatatccctgaaagttgcccttggcttcactcaaacatatgttaattttcataagaaaggaaactggtggaaatacttcttaggtatgaaaattaattaatttcattagcagcagatttattttcccataaattattcagattttgggggtagatgtaaaagtttacttaggcatggaagacattagaccttttaaaagcaaagtgggctatttcaatctaagaagttagttaatgtaccttagctttctgaagctaggggaaggagaggtgtctttttgttgtgtctttgggtttgaaatagtattcttcatcctaggaaaaagggcttttagactataattgagacttgcattaaatagctgcaaaattcttgcctgagaaacgtttaaatgatgtctttaatctgaccaaattgaattgaatatttctattattggaaaaagctacgtattaatttatttttaaatagccattgctttcagatcttatctttgtttattaagtataaaaagaggaaaggaaacttttacctaaaatggaggtatttgatattcctccaggaaatgacacaggattgggcaccctttggggtttaagtgactcatagatattggtactgaaaacaaaacaaaacaaaagatcagttagaatctagctaatgatcaattatagcacagaatagaagtatttccagaaaaatgaactcatttcttaatagctatgtaggggtgaaatcacaggatttctgagatttgctttaaaataattcatggaagagagacagggaaggagggagggagaagaaaggacaggaagagagaatagatgaaccaagcaaatgtggggaaatctggataaatgtagaatctgtgatgggtttatgggtgttttttgtgctattttctcttgtatatattgaaaatattgacaataaaaaatgttagtagacctttagtttggggcaatttatatttattttctttcttttttttttttttttttttgagatggagtctcactctgttgcccaggctggagtgcagtggcacgatcttggctcatgcaacctccacctcccgggttcaagcagctctcctgcctcagcctcccgagtagctgggattacaggcacccaccaccacgcccggctaatttttgtgtttttagtagagatggggtttcaccatactggccaggctggtcttgaactccttatatttacttctaaatgtcaacttttatctataaattgcaggcctgtcaaaacatgatgtatgcatgatgtgtatgactgtaaaggtgaaatgtgctgcttgaatgccaaaatggttgaaagtaaaaactgcttctgaaaaggtttatttctgtttgattttcagctaaattcaaaggacaggtcacaaacatcttgaagagttttttagtatcttgaagtattaaacaagggtagttaaagcatgataacaggccaattgtatgtgaagaatgtgaagacgttattgaacttgactattttgttcacagctttctccaatagagtatgtgtttttaaaaccacgtgagaggactatatagcctgcatgatgtataggtctgcgcactttccctactcacctccatcgaagtttatttattgaacaaacattcggtaggtgcttgtggtgagccaagatacaaagtcaaataagataccaaccgtgcttttaaggagctcacaggctcgtggaggagatagagaaagaaatagatgtcatcacgctgaaagctgaaaagggctataggaatatggggaaggggaggaacgggttagcaactatgaccctatgacgcatctcctttaaaataatacaaggctgggcacagtggctcatgcctgtaatcccaacattttgggaggcctaggtgggcagatcacttgaggtcagtagttcgagacaagtctggcccacatggtgaaaccccgtctctcctaaaagaataaaaactagccagatgtggtggcgcatgcttgtaatgctagcaactgtgaaagctgaggcgggagaatcgcttgaacccaggagtcggaggttgcagtgagctgagatagagccactgcactcaagcctgggtgacagagcaagactctgtctcaagaaaataataataatataaaataaggctgggtgcggtggctcactcctgtaatcccagcactttgggaggccgaggcgggtgggtcacctgagatcaggagttcgagaccagcctgatcaacctggtgaaaccccatctctagtaaaaatacaaaaactagccaggcatggtggtgggcgcctgtaatcccagctacccaggaggctgaggcaggagaatcacttgaacccaggaggtggaggttgcagtgagccaagatcatgccattgcactccagcctgggcgacagagtgagactctgcctcaaaactaataataataatataatgtaatataatacagacagaaaattggagatggtttaattggttgtgggtattacagtggtagaagagggctaaaatggcttagtctaaccccatgcataactttgcaaataactcttctgctctcatctctcttccccgcccttcttaataaacctttatatctttcttatgcatccacaggggttattggagcagtgtacgtgcagaacagagcaatctcttcttcacattaaagagtagactgatgtttaagtctcccttaaaggttttagatatatccaaggccgaattatagttattaggtaggcagctacttggagttggataaagggtagagttagccttcagtcacagatagagccttctaaagttcatttctcaattgatttggaatttgaaacatattttgtcatggaaatagtagtagggtttttcaggttactttacaagtattcctgaaattttatattatgttatctggcatgatatggttttgttctatgatatcttattttattttcattgtattctatgtgaattgtagaagcacagttgctaaatatatccagatttatgttccatcagccagttactttattctctagttcctgatactatacaatctaatcagtgtatataataatgcctcatgagaaaatactgtcaattttatttgaggtacctaatgatgtcctctgtttagttgtacaatttgcagctgaaatgttaagtagaatgaacagaagagctagacctgaaaaataactttccgaagtaaagtctgctatacgtggtgattatttctttcatagatgtttgctcaccacattgactataagaagaaatttttggctgggcatgatggctcatacctgtaacctcagcacttttggaggccaaagcagacaaatcacttgagcccaggagttcaagaccaacctggagaacatggcaaaaccccatctctccaaaaaatacaaaaattagctggggtgatattgcgtgcctgtaatcccagttactcagggggctaaggtgggaagatttcttgagcccaggagttggaggcttcagttaccatgacactgcactccagcctgggcgacacagcgagattctatttcaaaaaaaaaaaaaaaagaagaaggagaagaagcaatttttgataatgctgatgtgctagaattaatgcacagtaaaacacttcaccactttttcttctgcttcaacctttcctagacttttaggactaggaacctatgacacacgtgagggcatttaggttttgactcccttattttgactttcagagcaacaaatcattaaataaaaattatgcatatagcctcttaagcctttacaattactcctttaccaagattccgtgaaagttttctaaaatgagtcaagcaaaattccaagccacttgttcttgagaaaaatcttgaaagaaaaaatttttaaatgaaaagtaaatcacatagatacttgagtgtttgttttatattaagactaagttattagcactgatacaatgggagtggttgttcacaatacttagcattcatgaggctgaaattaagcagtattaacaaagagaagcagaagcctgtcatatgtaggaatgaatgtgtcataggagaaagtaagcgtttgtgtgcttttttttcagaatattgcctgttttatgatcagtgccaatttaacaccaatgttttaaataaatgacttttagaactctgtatgagtctttactgaactcattgtctatattctgtatgttttatacaattaaagttttggttattttagttcaaggcttaagtgaatcccttatccttttaaataatgaaaacaagttagtattagctggagggggttactatctccattttctggcaactgttcttatttctcgatatcatggtcatatttgttaggagctttttaagttattttccaaaggctatatatactaggcatggaccttctctctgcaaagcaatgtgtagtctctttgtttttgtttttctgggaagagtagttaattggctgggcactgcagctcaagcctgtaatcccagcactttgggaggctgaggcaggaggatcacttgagccctggagttttagaccagcttggcaacatagtgagatcctgtctctacaaaaaaaaaaaaaaaaaagaaataaaaattaaaaattagccgagtatggtggtgcatgcttgtagtcctagctactgggggtgggaggtgctgaagcaggaggatcacttgaggccaggagttggaggctgcagtgatcatgccactgcactgcagcctggacatctcagcaagactctatctcaaaaaaaaaaaaaaaaggaaagagggaaaaaacagttaattacctttcctccaacacatgcttttgctttttttttttttttccagctatgcttggagaaacacattattattattattattattattttgaggtggagtcttgctgtgtcgcccaggctggagtgcagtggtccaatctcggctcactgcagcctccgcctcctgggttcaagcaattctcctgcctcagccccttgagtagctgggactacaggcacgtgcagccaggccctgttaatttttgtatttttagtagagacggggcttcaccatgttggccaggatggtcttgatctctgaccttgtgatctgcccgcctcggcctcgcaaagtgctgagattacaggcatgagccactgcgcctggctgagaaatacatctttttaattgtgcttcacagctttgtgtcctgggcaaagtcaacgactatcccaggcacttgtttattccctaatacaatttagggaatgaagttatggaactctacagacttcttagctttcaaattctcattgctgtgatcactggatattgggaatactgggaattttcactccctctaaacattgcagttggttggagtattttattcattttttatgtttatttttttagaggcaggcaaccatagctcactgcagcctcaaactcctgggcttcagtgatccttctgccccagccttcctagtagctaggactacaggctcaggccaccatgctggctgatttaattttttttttttttttaagagaaggagtctcgctatgttgtacaggttggtcccaaactcctggcctcaagcagttctcccacttctgcctcccaaagcactgggattataggcatgagccaccaccctcagcctcagttggtatattttgtaaaccatgcctgtgtaaccaacatccagcaatgagagtaaaaggtgaagtttagactgttctccagaaacaaacaatcatgaaatgagacttgcaaagcaaagaattacacaagtttttgtgtgctgttcgtgaaagaaggattttcttttattgaagaagattgttctctttgaccaagtttaagaatctatgtaaagaaggtagataaactgaaccaagtaggacaatggaagtcccagttagactgactgtcctcatatccacttatgtaactatagggagaagtctataattaaatttcaaaattttgtggcaagattctaaattctctgggagttgaagagaaagatcagtgggaggtggagtcattgggaaacgtgctttgggagaggatgaggcttctgaaccttgcttgaagggtgagtagaatttggatagagagagaggaaaaatagaggagagtattctaagcatgagacgcagatagagagagaggaagttcttaatggaagacaggaaaagcagaagagaccagaataaaacaaaaggtactgatagaggagaatccagaaccagctgtaatagaaacacagttctgtgagagtactgggaagataaattttatcttgggtgcggacaatctgaagatacttcctgaaataggcttttgaagtgtctagatagatgggtgaagagcattccactggagagacccagtggtctctccagggagtggaagaagcgggaaaatacatggcctgtttggggaataaggtctcttgagagtgttgggttcaagggtgtagtacatataatgggaagtagcattggaaagatgggcagacataaagctagaagtcaagtcagaaaagtgtagggccttgaatgctgtcctaaaaaggtgggacctccttttgcatggaatgtttataagatccgctcttcaggagattatcaggagattagcagtgtaaagattgcactggaggaagacagaacagcaggcagatctgataaaaaaaaaaaaaaacttttgtggggttgggggagggggaagggatagcattaggagatatacctaatgtagatgacgagttaatgggtgcagcacaccaacacgacacatgtatacatatgtaacaaccctgcacgttgtgcacatgtaccctagaacttaaagtataataaaaaaaatatataaaaagataaaaaaaaaacttgtggagtaggccagacatgaggtgataaacagatatgacggaagaatctcagatattgcaaggcaagaatccagagggatgggtggttgactgatcctccctttgttttttatggtcaaactgcagtctggagacagaggaaagtgggaaagttgaaaacgagacctgatttggcagaagaaagagttagaaaaaaacagggaaaataatgtggcagtaagttagattggagacacttagactttcctaacttgaatcgtcctcactgactttccttctcccttggccacttctaaattggaccctgatctgctgctgcgagtgtgtctgtcactaacacaaggcacaatacccttaccagtgatgtctctctgagaatgcccttactggggatgtctatctgagaaaatcctacttgcactcaaagacagagttcaagcctcacctcggaaaaaacttttctgacgcctaccatttagtatatatgactgtgatggcatgattgcactaatgttgtatctttgtttttccatctgtttcccccactagacagtaagctcttccagaaagaaggggatttggatcctaattgtctcttatctggagcacccaacacagtgcctggtacatactaagccttaagttaatgcttgattaatataaataaataagtgggtgagtgtggtagacattcaagctgggaatcttctaaagtcattaggaaacatgagactggagctttagtaatcatagtatgaataggtgagttttagcccacagtgttgcacacccatctaagctagagactagtgttgagctgttcacttacctaactagggaggtggcagggtggcagtttctattggtaaaggtaggtatgcaaagtgtgggtgttcaaaagcactgcctgttttggatggaggaaggtgacaacaccccttttctgatcattcttgaactgttcacacataatggtggctaacttgtttattttcatttatagtgaaataatgtatttcttccatgttttgtcccctctttgttgctttcttgttcattttaggacctcaagtatgtgttgcccagtctctgatttaagtaatgagcttctcttttccaattctatttaccatactagtggctgggatgaagcctgtggtgaatatcctgtttttatcttttggctgcctttcaatttaaaaaaaaaaaaaatcaagtttatgatcaaagttggttacccccagatgagtttcccacgtgcattctctttctcctggacctcatggtactgaatgacacagatgaataagtagattattcagtcagctgcattcctaaagtgagtgagtgctttaggagataaaataggcacccccgtcccccttcaaatacctttcagaatttgaataatagtttcaggtagttgtaggtatacctttctcagcaaagatctgtgtttagggtttatgtatagttaaatgagccggtggagtggtttcataattgcagtattgttagtcaaactctgtaattagagatgacttcataggcataagattcttctatgggtgacgccctgaattcatacccaattgtacactatatccttttatgaaaaaacaaacaaacaaggttttgtttgcttttgttttactcccttatttgaaaatctgttttcctgtgtcttatatgtttagtgaagaagggctggcttttttctacagctttcccttttcctttacagaaatggcaggcataggagctaaggaggaaacagaatttgggacagatcaaagtgctttgcagatgagcgaattcagaaaaacgtagagactccaggaggttttatttttgataagtattaaaattgctgagtttaaatggaggaaaaatatatctctatttctttgaatgtcagttctctttctctctccctctctctcatcatgtaaataaagtccgcttttgcttggtggcacacatctgtattctcagctactcaggaggctgaggcaggaggattgtttgagcccagaagattgaggctgcactgagctgagattgcaccactgcctgggtgacagagtgtaaccctgtctcaaaaagaaataaacacataaagtccacttttgtgggaagacagactgggaaagaggacatatttgaaaatcagggtttttttccttttgcctgtcaatcacatattgtgaaatcggggttaaacttttattcagcaagtaatactttctcttcacctttttctagtactcatgaaaaaatttgcaaattaggaggaatgtgacaatattgacaagctgttagctattttgaaaagtgatcctaaaatatttaaagaaaaattgttgtttgtttgtatatctcctgtctgctctttaaattgtgtttagaaactggccttacggaggaaccaaattgagtcatggataaaaagtgactgacaggttttcctttaggcccatccttcttaaattactttgactaaagacttgtaatttttatatatgagggagacctattatactctgtagtcagtaattatagggagatgagataacttttcatttatcccatgtaaaaggctattagtagaactaatgccttatatttatttatacagctcttcacaattaacccaagcattcatttattccctattttctttcatgaaggatttgaagttgctatgtaatacttcatagttcacaatatgctgtcatacataccatctgtaatcttcattaggacctgggggaagtaggtattattatcactattttcaaatgaggaaacttaggctgagacagattaattaaacttgctcatggacacattactagggaatagcagaaccagagcaataatcgatgccttctaatttcacgtccaacatctttctgttaaaacatactacaaccttgggcgcggtacaacagcttggtgtactggtacttgagattaaatgaagtgtctacagggcagtattgatgtcaaatcttgtgttttgctttgtgaacccatccgggatgttttagtaactttaagggaaaaaagtcctatagtacaatgaatgccccatgaagaggaatagagcttctgttattttaatttgtaagatctttattttttaatatcttcactcatttccaagttacttaatgtgatgttttctctcaagatagtactttactgcttgacttccttaaagacaccatcaagtacctatgagtagtcttaaggacagaccattttttaattcatagtggcataaagaaatctacattaaacaactttattttaagcttcaaatggcaaaatgtacaattgtatcagctagagcatatattgtgagctttttaaatttggctttatattttttagtcttggcccaggtacttcagagtagcatttctttatttcctttcaaataactgtcaataaatgaatatgggtttatttaaattggaaagtcctgcattaaactattctgttatcctgaaacaaccttgtctggaaatacggttttaaggatatgtgcatgttccaattccttctttttgttctcattgaagtgtatctctttaatgtctctgatagatgggaaatctgagttacatatgcaaagtcactttaggctttttaaaaggcaattagaaataagaaacttgaaaattttaaaatatatgtttaatgcactggattaatttttggactaaactggtgccctaaaattatttctatgagatctaagcatttcttaattcatttttattttttactttttttattgagacagggtcttgctctgtcacccatcctggagtgcagtgacgttctcatggctcactgcatcctctacctctcgggctcaatcggtcctcccacctcagtttcccaagtatctgagactacaggcatgtgccaccacccacgatgcccagttaattttttgtatttttggtagagacgaggtttcaccatgttgcccaggctggtctcgaactcctgagctcaagcgatctgcccacctccacctcccaaattgctgggattacaggcatgagccagcacttgctaattttataggaagaaaaaaagaactgcgtttctggccactctgagaagaaattaataatccttaaagtctctagagacttttttcttctaaaaaaatggatatttgtaccttttattgcagtcactaattcactttatgtcatattgtaattattcatgtttgcttcgcagattgtaaattccttgagggcaagaactaggtgtatagcagatgtctaaaatattggtaaaattgtttgagaagtagcggggaggggcaggttggggagaaagagatttctacaggatttaatcagaacccaactggtcagcagggataaggggggcggggggcaggaatggtttatgtccagaaccatcttatctaatttcttttttttttctttcttttttcttttcttttctttttttttttttttttttttttttgcagtgatgcactgatggctcactgcagcctcgacctctcaggctcaagtgattctcccacttcaacctccagagtagctgggattacaggcacgcaccaccactcctggataagttttgcatttttggtagagacagggtttcaccacgttggccaggctggtctcgaactcctgggctcaagtgatctgcccgctttggcctcccaaagtgctgggattacaggcatgagccactgcacccagacctaattttcttttgcatagaagtgatatggtagtgtgagagtaagctcagttgtataggtttgttttagttgttttttacccacatactttaaattattactgactcactatctgcccaaactggaaaggacctttagagataaaggagagaggccacatgttttagatttctgagatggtcttacttttaaattttctgtgccattgttctccttggtgtgtgattcatggagatgtgtaataattctttattaaaaacatgattgcttaaaaggggtgaagaaaattggaataaatcctatgtcgtatttttgtaatggggagtgttgaacatattagtgaaacagaatatttttagaattactactattcgtttgcatttaacttacgaattttaaaaaaaaatttttttggaggcgaggtctcactatgtttcccaggcttgtcttgaactcttggcctcaagcaatcctcccgcagtgctgggattgcagttctttttattcttaatctttaaaatgcctaacttcaggcctgggcgtggtggctcatacctgtaataccagcactttgggaggctgaggtgagtggattgcttgaagccaggaattcaagatcagccagggcaaaatggtgaaaccccatctctacaaaaaatacaaaaattagccaggcatggtgtcccacggctatagtctgagctacttgggaagctgaggagggagaatcacctgggagggaggagcctgggaagtcaaggtcgcagtaagccgtgatctcaccactgcactccagtctgggctacagtgtaagaccctgtctcaataaacaaacaacaacaacaacaacaaaaaaaaaacccacaaagcctaacttcattactaactgaagaactttctttccctcatagatcctgagattactctgaaaggtattttcatccaacctgtctactgagaagttatccatctttagtggcatcttgatatcatacataagaaaagtttatgaataggccagctttgttttatatcttttttaaagagtctagtgttatttaatttttttttttttttttgagacagagtctcactctatcacccaggctggagtgcagtggtacgatctccgctcactgcaacctctacctcccaggttcaagcgattctcctgcctcactcaacctcccgagtagccgggattacaggcacccgccatcacacttggttactttttgtatttttagtagagacagggtttcaccatgttggtgagactggcctcgaactcctgacctcaagcaatccacccgcctccacctcccaaagtgctgggattacaggcgtgagccagtgcgcctggctgatggttttatttaatttttaaaacaccagtcactgtatgtgtctgttacattatggtaaaaacttagctaatagcatcatatggtcattttaaaacttctccaggatttgagaaacctgagtgtgaattccagtcctgagagcccaggtcttctaataggaaaaaaaggagattagaatatttagctcataggactattgtgagggtttaggaaattaatatgcaaatgaatttgtataatgtattaataatacttggtgcatagttgttgaagggattaattttattaaagttctgttttattgagtgccttactatgtgccaggggctgtgataaattctagaaatagcaacaattctgtgaaaaagatagatgtagcccagctctcttatgaatccctccctaccacttccagcccctacctctctatactgagtgttacacttcttggccaaaacataagttggtgagtaatttgttgccttttaataaaatgtctaaaagggataaatgtaagatctcaaaatgtattttgtatagtttgtgaaatttaacccgtagtatatttttttggaaaggcaacatctttagggcagtggaactactctatgtaatatgttaatggtggatacatgtcattatacatttgtccaaacccacagattatacaacactaagagtgaaccctaatgttcaccagagtcttagggtggtaatgatgtaagttcatcagttgtaacaaacgtaccactcaggtacaggatattttggtcaatgactgatcgaatgtatgatagtagtcgcataagattataatactatattcttactgtaccttttctatgtttagatatacggataccattgcattacaattgcctacagtgtttactacagtaacctgctgtgccatttgtagcctaagaggaataggccataccgtatagtctaggtgtgtagtaagctataccatctaggtttgtgtacgtgcactctttgatgcttgcacaatggcaaaatcacttgacaatgcatttctcagaacacatctctgtctttaagcaacacttggctgtatttgggaactctctgtaacttctgcttgattttgctgtgaacctaaaactactctaataataatgtctattggccgggtacggtggctcacacctgtaatcccagcattttgggagaccgaggcgggaggatcccttgatcccaggagttagacaccagcttgggcaaggtggcaagactctgtctttacaaaaaaagagaaagaaataaagaaaaataaagtctaccaaaaaaataaatcagaagagagaaaaaacccaaaacaaaaaaggagaaaggaacatgtaatcattttcatttttctttgtccaaaattattgttataataggtttgcatttggaaattatctactgtgatacagacctcctctctttattgccaggatcagcaaagtttttccatataggttcagatcataaatattgtgtgccaagaggtaaaatcaagaatattatgatattaatatcaaggatataatatattatttctatcagtttttattgacaaaattcaaaatataataattgagtacaattttttggtaatacaattctgataagaatagaattctttttttctgggataacatttcacttaattgggttcaaagttaatgtgcccccatcatcaaaatggactgcaaaaattttcctttaataaccatatccagcttgaggtcatacaaaaacaactggtgatccagttttggcccacaggccatatgtagtttgccaacctttgttctgttagttaaatagatcaataaggccaaattggaaagggtgtatactcagataatataataatttacatgcataagaatgtgtatattagcacacatgtgcatttttatatcaaaaccagctataatttgttttgtttcctctttattcttcctttaatgagagtgattgatagatgtcagtatgctatttgaaaatcaatgtcttcacagtgaatgattctaaagtggcttaatgggaaaatgatactttccgtgaatcattggtcacataatattgacctttagctttggctcatataaccaagaatttctattatgtagctttttcctgtcactgctgggtactttggcccttccttaaactttttgaatgtaatttaagattttgtccttagaaggaaaattcagaaatattttttctcaataaattttggtaagtgatgacttctcatttgttttctttattaaagctgtatgtagagacatggtaacctattcagattgttttgatagtttgaaattctgtttaaattatccctaagatgagaacttagcaagagtgcttatatttatcacaattttttaaagtctgaaacgtttttggtttttctttagatctttaaatggatgagatggctaccactcagatttccaaagatgagcttgatgaactcaaagaggcctttgcaaaagttggtgagtattttttgtagtaaaactatagggaagcaatatttatttggtctcaaagttatttctctataaatatcacatgaatggttaatcaaaaacattagggcaagatagttaaaatagatgggataaagttttggaagctatacttaaaattgttttatttcttttttttttttttggtcgagtggtagctgatattatttccaattttatgtagtatttaatatggtcaaattttttagaccacagttccaatccttaactggtgactgttatgtatggttcctgaaattttcatgccaaattttagttattattatattttgtatctcatatctttctgaagaggtttgaaactttcaccatattctcaaagggatatgtgaccctcgaaaacattagatgatgttttacccttccttaattagtttggcgttattgacttttttatgggttttctgtgcctttggttactgcagatcgttctacctcgccacgttaaattatagcttcagtataagatgagaaggcatagcatgctatttgatttatcctttatcatcatataacatgccttacaattgagcagctatggaaggtaaatatggagtatttacattccaaattttagtgcttgggtcaagtctatagacaataatgagaaaacagggtgagaacagcctacttatgtaaatacatgaatcaacatgtgcttagagaggtagattattattatttggtatctccttgactgaagggtacagaattagctcatatgatgatttgttatgtaaatcagaatttgccgttagacctgtgtcgaaaatcccattagtggaaaatgaggaaatatacatttctgttcccatatatttatgatcaacattttctatgaaggcattcagtagtagcagtgtaccttgggaagaataatgaccccagccagagtgaccattcataatcccatcaaaattttaactagaaaaaactgaatattcctgaatctaacatgatcgcgcgcacgcgcgtgtgtgtgtgtgtataaaaatagcagttaattaccttgccatggataccacttactgtaagaaaaatgctacatagtttaatatataacagcaagtgaattcttggctgcaagagtttttttttttcaaaatgactctcattcagtcaaaatagtcttataattgttttaggagtgcatttttgaaccttttttaaaattaatattcatctttcagcattagcagcagcttaatttgttatttatgaatagaatttcagagtaggcaccatgccttattaagtactcatctcctcaagtaaatgctgaatacaggtcttgtcctcatgtgcagcatcttggaaataattacgtgcaatattccttaaaaattaaagttaattcagatattgtttacctgatgagacttggaatacatttgacgagtaaaagaacttcattgtcccttaaaagcttaatgacataaagaggattgaccaattatcttcatagaggaaggagttaaattgtattaagtaagggatcaatgagaagtttgactgcaagaaaaggtcattgtggagctattgtttaagtagagtttaagataggcgtacagtttgccaaagcccctgccaggcatatgttcctaacatactcaggctcttattactatatatgctgtaaagaattctggaatccagaatttctgcctattgtgaatattattcttttgtagtctccactcagtatctagcatagtgttgcacacatgttaggttctcagtaaatatttcattgattgaaacccaaggaactatatacatagccttttgatgtactgggatttttgtcattatcaaccatacattcagagggcctttgttgtgaagattttcattacagtggaatttattattaaaggtttttgccattaaattgtagcatataaaatttatatatatttttcagcataataaaagcttgtgtgtacactccatcttttagaaactcatttaaggacccagccgagtctttcgattttctttaaaaaatctttgtagttttaagttgttgttacttacagaaccctcaggcaaccgtcaaaggtgttatagaattttttttctaattcagggacactttattttaaaaacaagctctataacttattatcctgtgaaggacagtttttcctttttgtgggggtgggttggcagagaataggaaagactactttgtctcagttcaattgcgacaaaatatggaaatcattagatgattttccccatctattaacaataatagccttgattatctccttagaaattcagcaaaatcatagcgtgtggagaaaatctctgtaattactgctaatcataggttttgttcaatcaattaatagtgctttgaaactctctttactagcaataaattgagtattagaatttaaagttctcttttcactcactttctgcacctgcttagttttaagctccaagctcatgtaattattttaattttctcaacaattgtttccagtgcttcccagtagcagaaacgttagttatcagtttttgtacttcatgatgtttcaaatttaatttaaatgctgtaatacataactatttctaaagaagaataaataaaacctttcaaaacacttaggtattaatattttaccatctagaaactgtcttttacattctaagcctttaatcttgctatggaaactagtggtcatttggatgattacttgtcataaagaaaaattcatgtaatgtaaacctttgcagagttgctttagtactgcaaacacttaccttgccttgccttttttccctcctgagcactcactactgaggttttttaaacatgaattcagcacttttgaaataaaagaataatgggtttcttaaatgactaggaatagtatgggtgtattcctttgaggtttcccaccaaactaagcaaaaaaaaattggttgtggtgattgtagctataccagacttctctcatcctaggaagttgagttgtttcaaattacttgatattcgctagtatataaaaaccacatcaggatgatgccacaaaaaaaaacagtgctttagtttaatttactttcagtattcaataaaagaacaccagtgcatatttgtttaattatgccttaaaacaaaaacaaaactatagcccgtctaaaaaaaatgaaactaatcagtgctctttcattgtgccatctggttaattatatatggattattagaagtggaggtctcgggatagtcggaaaaccatgtttcaaaggtgtggaagctagttaggagtacacatgtgtgggtgcatgggtaaaagcaatttttatttttatttttatttttattttgagactcctgggctcaagtgatcctcccacctcggcctcctaaaatgctgggattacaggcttgagccatggtacctggccagccaggtatattttgcttcatgcactagatgcgttcctgaaaatcagcaagccaactgtaaatggattttatgtagtgggatatattttaaatgtaaagagaaaatcttatttttttaagtgaagcctgctttgaatttttttatttttttatttttatttttaattattttttgtttatttattttttttgagacggagtctcgctctgtcacccaggctggagtgcagtggcgcgatctcggccactgcaagctccgcctcccgggttcacgccattctcctgcctcagccaggtggcagactacaggcgcctgccaccacgcccggctaatttttttttttgtatttttagtggagacggagtttcaccgtgttagccaggatggtctcgatctcctgacctcgtgatccgcccgtctcggcctcccaaagtgctgggattacagacgtgagccaccgcgcctggcctacacacatgtatttttaaaacgagagttgcagcaggggaaaaatgatggccaaactgctggaaattttgagtcagaaaaggactgataaacatttttgattgcctggtctcaccctctaaacttgtccagccttctgctgtacttgacctccatctttggaaatccactagtacagtgaattctaaagcagcaacctccagtctacccttagctggaactcattaaactgcctcttatatttgctgcagtgagctacctcaaaaggtataagctgtgagaagcaaaccccatgtttagctaagcatctggagatgtttagcagctgccttttctaaggatttaatgcctaatgaaagcttgatttcactgcttagatcttgggatggaatatagtttaaattcttctgcccaagtcttttgaccgagtcttttaagtcagtattttgtgagctttcatgggcattcaggattgtgtatgtgtgtaaacccattattgttagataaatagattccttttgtcatttctttagtgcagaaaatttgtagaatatgttggtcaaaccaaattgaacttttaaatccagcttttccaaaaggatatgcatctgcacttgctaggctttcttctttaagtcctaatgagcactgtcctgagtgggctaatagagaggtcgcatgtgtattccagatgagggcacacaatatgtgacctcttcataaagaaagacaccagatttagacagattcaaggatgtttaaagcaacacacacacacacacacgcatacacacacaacccgagcgtcaaagaaaatcctagtctttcttactgtcaaatttatgagacaaagtagcaccccaaaagacgcttttgaagtgatagattgcagcacgtaccacctggacatgggcagtgtaaaacagcagctaaaatcaaaaccacttggattctggcttagctttctccagacaagtacttaaaatagcttaaataacaggatgcaaggggagggaaaacatttccttttaaggatatgcattcttggtgtgattcaaacttctgcaggaacatggctgtgtaataagtttatttactttaaggtttacttaggggagggcggcgggggagttaaatagtatttaaaataatacttggtaaaagagaataatgagatttcctttaaaacaaaatgcagatgtgaacctacacgtgtcatcagagagagagagagagagagagagagagagagagagagagagaaaggaaacagtccttttaacagttgattcttttcttatgaattcagtcagtggccaatatgaaaaatgggcctgtctggtgcagcactgggagctgcgtagtgatttttttttaagtatcataattttcttcttttaaaaaaaaacgctttgtcaatttactcaaatttagccctttactttctgccagaattgtgttcagtgataaggtagagtttcctttatccagcttctccttaatgtccagccatactgaccatattttctaaaccaaaaggttgagaagtgctggcattgaaactgcactgcacaatataggcagtatggtaatttatgtctgctttatcagctggttggaaactatgatgctgaaacagaagagtcttcaaaacacagagcttttcccactccataccaatgtatagttaatgagaaaatggcaagtgagccaaaaaggtgttgcagagtattggcagcatgaatgagaaaataaaggactgccatcattcctggtggttgtgattttagtttccagttgttaaaacgacttccaatctaggtatgttattttgggtcagtttattattaagttctcatgtttatgtcaaaactcagaataggagaaattcaccatcaaacatactgaacagcaacattctaattccaatgctctgtttttaaagtggacactgtaaccacaaataaggacatagtcttatgatttcaaaaaattaaattgtctttttgaaaaaccttgccacattattcttattctcattttgcttttgaataacaaaaaattatccaaaattcattttgggttatttggaaatcattcaggtacctcagctattttattttacacataaggaaaacatgactcaaagactatcatttagccagtttgtaaaacgaaactacttttctccgatgtagaaaattagattgaatagtcatcagcatttatgtttattttttaaaattacaagttagtcttagaagtagactaaaagttgtgagcacctgatgagatggaagctttctaaaatcccattatgctacctttttactggccttccaaaccacgttagatctttgatattgtttaaggatgtgtttttggttttttgactgagggttcgaaataaaattagcataaaactctttaagaataattgcatgctattttgtctctcaagtactttaccagctgggaggttttgtaaaattaattgctagctgcatttttaggctccctctgccttcttgtttaaattgaaattattttcttcaaaatatatgatttaagagctctaagaaaggcttgataaaattgactctaactaacactaaaatgcctttgatcatgggaggtagtgtaatttggactaacactgggggctaaactatgggaaaatggcagaataggtaaaacttttagaagacgacgcacattcttgtcatccaggaaagcctaaggatatgtattcgaagtgactcaaaatttttacaaggattttgtagccacagtttcaagtaagacccaggggttccgtttgattcatttctgtatctttggtatgtagcccagtgggtgtcttcccacagggtaggtactcagtttgctctggagggtgactcatacctaaacaagtgcacatctcctttctcagtaaagccaaagcaggtttctacatttggaacaaaagagatcctgaccagagagctatcactggtggtccacttgggccctccttgatgggtgtgttcacttagaaaaccaaattacagatctgaaggctgctgggtagggacaggattagaacaaagggaatgagattgaatgttatttaagggatatttctgtcaagttttggtttctcgatgaattgccattcagtctttgagtgctatttctgtatttctgtcattgttgtttagttttgtttctaaaatgctcatctaggattagagcattctttctttggtcaattcctgagaatcagtgattctacaaaaataatttttttccattgcttattatacacaaaagattgtgctacatattggggtgggagatacaaagatttaaaagaatctttatcgggagatttgcagcctaataaggaagtttgtcatgtaatgacaaattcttattcctccaatttcctttaaaattttcctgtccctttctaaaagcatttcttactactgcccttacttcaaaatgaaatttccaaatgtggttattttatgttaattatgttttagggtggctacttcctggcatcttttaatcacatcagtgaactgtcttctaattaatgttcaagagaggttatttcagggaggatacaggcaaatagtaatttctccctgcgacccaaacttctggagttttttgtttttgcttttgagacagtgtctcactctggtgcccaggctagagtgccatgatgccatcatagctcactgcagcctcgaaatcctgggctcaactgatcctcctgcctcggcctcccaaagcgctgggattacaggcatgagccaccagtcccagccaccagacctgtagtctaacctaatacaaataggcagccagataaactttctgggccttagtcagtttcatatagctttgaatccactgtagttctcccacatctaatttaaaacatctctaccttccacttccattataacactgagaatacaaaaagaacaaatcctgttacatacctgttatatactccagtctaaactagagtcaaagcacagtggctcatacctgtaatcccaacactttgggaggccaaggtggaaggatcatttgaggccaggagtttgagattagcctggtcaatatagtgagaccctgtctctacaaaaaatacaagaaacaaaaagttagctgggcatagtggtgagagcctgtagtctcagctactcaggaggctaaggtgggaggattgcttaagcccaggatttcaaggctgcagtgagctatgattgtgccactgtactccagcctgggcaacagaatgagaccctgtctctaaagatacttttttaaattaaaaaattggctgagcttggtgacttatgcctataatcctaccactttgggaggccaaggtgggaggatcacttgaggccaggagttcaagaccagcctggccaacatgacgaaaccccatctctactaaaaatacagaagttggccaggcatggtggcactgtaatcccagctactcaggaggctgaggcaggagaatcgcttgaacccaggaggcggaggttgtagtgagccaagatcatgccactgcactccagcctgggtgacagagtgagacttagtctcaaaataaagaaaatagcttaaaagaaaaaaagaacccactgaagtggacaacgttttgatagttaaaagaataagctatctcttcctccaaagatatcataaaaatgaaagaatattatacttaggtaataaggtgcagtagtgatcagaatgttatcactctgtatctgtatttaatatgcgttactattctatctccaggttttaaaagtgtttgtgtgaggggagggttgtgaagtcttgtgtattctgatttagaatcagtgtgatagaaccaaaaaggaactttagagattatgtggtccaaagcactccttttacagatgagaaaactaggacctgaagaggtaacttgtgcaaattaatagccaagttgagataagacattgtttcacattattcccactgtgtgtctcttcaagcatgtatgctgtgtttctttcactatgccacacttactctctagtactgaactccactgtaattttagaaaggatgtaggaaaaacaagttggtatatgcatgggagcaggtgtatttaagcccaagacattcataaaacaagagccactaaaattttgcctcagtgccatggggattactttgttctttttagcaactgcagacattattgatggattgatttctacatagaaatactttacatgtagaaataaagagtttgatgtatgaccttttataaatccaaagcaaagaaagtgaatatacatcctagggaaattaagtgctttacctcaaaggaaatctaagtgattttcacactaagtattgaatggtttgttattgatgttttaaaagtacagatattttaattagccaggcatgatggtgcccacctttggccccagccatgccggggagctgaggcaggaggattgcttgagcccaggaggttgatgctgcagtgagccatgctcgtgccactccagcttgggcaagagagaccctgtctcaaagaaatacaaaagtaaaaataaaggtacagatgttttaattcatagatttaaaatgtagtaatcaatgtttaagaaaatttaatacttaaaatagactgcattaaaactaaacagaatttcatcagcattcaaaatatttgcaagatggttccatgcagtatacttaatattttaatttaatttaatttttaatcccccagagcattcttgcaaattgcaattttagtaattgaccaaaaattggacaatgtgaactacacgtagatcacacttagaaagaaatgtcagtgtattccatggaatacattggcctagcagagcttataagatcagctagctccccgaccttatctctcattttcccccttgttcactctacccaagtcatattggatctttacttttcccgaaacacaccagacacactgcagcatcactgactttgcatttgctattttctctacccgaaatctcttgccccagatagccacatgatttgcttcccttacctcatggaagtcttcattcaaatataacctcatcaaagtggccttccttacccattctgtctaagtagtagcaccaccaccatccctgccccccaatatctctataacccagggttactcaacttcagcacaattgacattttaagctgcataactcttgtgttgtacatacaaggaaggggtcatatccattgtaagatatttagaagcatccccagcctctacgcactgtatgccaggtgcttccagttatggcaatcaaaaatgtcccctgggggcaagatagccccagtctaaccccttatgcttttttcttttttttttcttttcttttttttttttttttttttttttgagatggagtcttgctctgtcacccaggctgcagtgcattggtgcaatcttggcccaggttcaagtgattctcctgcctcagcctcccgagtaggtgggactataggcgcccaccaccatacccagctaatttttgtatttttagtgaagacggggttttgccatatgggccaggctgatctcgaactcctgacctcaagtgatccgcctgcctcggcctcccaaagtgctgggattacaggcgtgagtcactgtgcccagcctgctttatttttttattttttattttatatatttttttgagacggagtctcactctgttgcccaggctggagtgcactggtactatcttggctcactgcaacctccgcctcccaggttcaagcgattctgctgcctcagcctcccgagtagctgagattacgggtgcccgccaccacgcccagctaattttttgtatttttagtagaaacggggtttcaccatgttggccaggctggtctcgaactcctggcctcaggtgatccacccgcctcagcctcccaaagtgctgggattacaggcgtgagccaccgtgcccggccacaatacattttcttaaatgcgctaaggtcatcttgagtcatttctctgttcaggttgtttccttctattataattaagtttacatatgaaaatcagtgagacctaaggaacagaagatatttgaaattacttgtgaacatcaaactttattcacaggaaaatatatactcaagtggttacaaccctcaggacattagcctttttctcaataaattaacttttggtcattgatcaggttttttttttctatttttaaaagcttcagaataaacatcattcatttaatcagcacttcaagacatactctgagaaacttcagtagtacaaaaattaaaaggttatttatagagtcatattaaatatctgctttcctcagtagtgcatttatttttataaactctatatttgtcttgaattaatgtttgtttacattaactcttaaaataattggcactgaacatgactgcttaatttcaggtgtactttgaaacagaatcagcattaagttcatataagttctttttggagcaatggaagaataagaaacacaaaattcctatacttacagtagaaattgttctataccatggaagtgttttgtaggtttacgatctattagttctttttttaaaatcctattagcgccaagttaataataattgtattagccaactatgcttccttgaacttagggatgctctttttaagtaaatctacttacacattgcttaaatcacaggatacatgatgtaaaaccttgctttttccatttaaatgtccatttccctttcaaacaactttatgttccccacaataagaaaatattttatgtaagtgagcttatgaactgaacctcaaatgaagggaaatactctaacttctgtctttcaattttttttccttttttgcttgctctccttttttacaaagatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatgtaagtatgtgaaaattcacaattattagaagtagtagatgttccctcgtctagtgggatgttatagtattaagtactgttatgttaagttcttaaatatatcatattagtactgttataacatttctgtcatcctgcccactaaatgtacttcttttagctgctggaatatcttaacaaacgaattgagaaaaagagcactgcagaaacaaagatataacatgataagatgttaaggtgataagttatataaggcgaacagtctcctttcatgtcatcattaaagggcagttatcaaggtgctaagtgacatctttgaagtgttctctctcccgtggtgaacagtgtgctccaaaattttaataatacaccctgactcacagtctcggaagcttcctgagctgaactttctcattaaaaagttgttttccactcttgtggtaggggtatttaactgaaccattctctctaggatgataattttgataattaaaagtttgaagcatatcttttcagtccattggaagaggcatttaacatttttgttttcttctctagtttcatcaaatattcttcaaggttaggggctgagtttttaattctttcacccccccaccccactcccagaacttagtttggtgttctctactcagtgcctggaaaatgtatacatggcacatggttcttcaatgcctaccactattggctgctagcaagtgaggtctagattttttagacttatgccattttcagtctgtatttattgacagtgtatttgagatacgtgttaaaaatagctggctgggtgtggtggctcacacctgtaactccggcactttggtaggctgaggcaggagggtctcttgaggccaggcattcaagaccaacttgggcaagttagggagaacttgtcagcttgggcagcttagggagaccccatctgtacaaaagaaaatttttaattagcccagcctggtagctcgagcctatagtcctagctactcaggaggctgaggcaggaggattgctcaagcccagtagtttgaggctgcagtgagctgtgataacaccactgccctccagtctgggtgacagagcaagaccctgtctctaaattaataaattaattaattttaaaaataaaagaatagttgttgcttcttccctcaattaaggatacctttaagattttattggtgtatttattattaatttaaggctgagtttgactagatcttactagggattcctttcagtatatcacaaactagttatcagtgcctaatatttatcacaaatgtcccagcgctcctatcctcctttgtcatggtttatttttccccaagacaactgaaacgatagcatgtacttccatcagtaactgtggctcaccatagcaagtgaaattttgaaatgttctttccaattagaattaacacctttagaacactgtagtagtccaagaagcaaattgactaagtaatgatgcctactcagctgacagcattttgtgattgtttttaaaatgcacacttgtcggccgggcacggtggctcacgcctgtaatcccagcactttgggaggccaaggcgggtggatcacgagctcagaagatcgagggccatactggccaacatggtgaaacccggtctctactaaaaatacaaaaactatctgggcgtggtggtgcgtgcctgtaatcccagctactcgggaggctggggcaagagaatcgcctgaaccagggagtcggaggttgcagtgagccaagattgtgccactgcactccagcctggtgacagagtgagactccgtctcaaaaaaaaaaaaaaaaaaaaaaaaaagcagacttgtgtcataattataatgatatcgttcctgccgttttcttttgaaatactgatttcctcccaccatttttttgtctccagttatggccaaagccttttgttttgaattctatgttcaatagtaagttgcagtttatttgcaatttgagcacttgcatgttttctgatgtatcacttgctccccttttaactgcatggttaattgtgaatttaaagtagcgcagagcagcagttaactatgattggctgtttttgataaaatgtattgctcagaattttttaatctattagaaagaacagaccaaaatcaataggatttgcagtgtgtcattatattaaggacaaaattgtaaaagtgtctttgaaaatgatcttggggaaattgttaattttgtagattttgaaatgtagtttttacacagctatttgtggcttttaagggaggaggtgtgattaccttagtatattctttaaaagtaaagaacatgcacaataattttggcaacaccagggctttaagaaaacaacattcgtgaggacattttaggttagaatatacattttagaattggaaggaatcattatgtttacactcctacacttttcaaatgaaaagaaacaaacttggatttctgaaaaaggaagtgacttttcctttttgcctaacattacacagaggactagtggctttttccagtacctccctgctattcaagaaatttgaaatatcaaggacagtaaagtaacctacctgaagttttcagatgctactactactatgactgtattaaccaaatgtctgtccgcacccatctgccttgtcatcagtgaaacatcttacaaattgtcaaacaaaatatgggtagagcttagttatccaagaaatagaaatcatgttattcctgttagatattggcataaggaaatagatacaaacatgttcttgcttgttaggtttctgctttttctttgaattgttgcttaaggggtgttaattgcaaaccagactacaaacaaaaacagtttatgttaatttcagagaaatgtctgtgtgtgtgtgcgcgcgtgtgtgtgtgtatggcaaaaaacagtcccaaaattatatgtatgtaaactttaaaggtgaaaattaaatttaataccctgctttttaaaattctaagcacttcaaaactaaaaatactggatttttatgcttacaagataatgggactttttttctttgattgttaaactagtatggcactttcagcagagaagtaagctgcccagaacagtcttggacatatagtaaatactatataggtgttagttgctggggtagttctttctttaaaaaaaaaaaaaagaagttatgtttttcaaatattactaagtttaggcctacaagacattccaaaataatggaaaaattcaatcctgcctctttggaaacattttggaaataagccccaaacactggaagccagtcaattctttttttgcaattctttctgaaatctttctttcttaagtcatatgcctctggattgttttggtttggccactcgtcctgtgttgagctaactctggggtcaaaagaagttagccggttgctgagagtctttgagagaaagaaggcgaaacttaataaaaggaataaaaaacatatatattccataacggagactgaaaaagatgtatagatcaagagtggttatggcttcctgaaaaaagtacagcaggagttagctcacagatgataaagcaagtctttccttgtggagagaaaacagcacaaaacagtgagctcattagtatcacaacgggcagctttgaaaagattcattgagaagactccagcacagtagtcagccttgtgctatctctgatttcagagatttcttgtcaagccaaagcttgtactcaaatagttttatcatccacttaagcgatttctttactaaagtagaaagtaaaatgcaaattcttgtgtagtgaatcaatatcatagacacaaatcttcagttctttcttatcatttttactttttttttttttttgagacggagtttcactcttgttgcctaggctagagtgcagtggcgtgatctcggctcactgcaacctctgcctcctgggttcaagggattctcctgcctcagtctccagagtagctgggattacaggcatgcgccaccacgaccggctaattttgtgtttttagtagagacagagtttctccatgttggtcaggctggtctcgaactcccgacctcaaaccatccgcccaccttggcctcccaaagtgctgggattacaggtgtgagccaccatacctggcccatttttacttttttaaaaccaagggaatagaggaaaatactatgaaactaaaagtttaagcttagctggaataatttatttgaaacaatttagaaaatgaaggtcatgtaacttttgcaagacctttgaaaattaacaaacttaattacaactttgcatttcattgccaagcataagaaggagttttactaaagctatgtaaataattgcattaggatatatagcagagacattctatatatatgtatatatatgtttaatttattttcctttttttttttctgagacaggatcttgctctgttgcccaggctgaagtgcagtggcccatcttggctcactgcaacctccatctcccgggttcaagtgattctcatgcctcagcctcccaagtagctggggttacaggcatgcaccaccacgcccacctaatttttgtatttttagtagagactgggtttcatcaagttggccaggctggtcttgaactcctcctgacctcaagtgatccacccactttggcctcccaaagtgctgggattacagatgtgagccaccgtgcccagcctacttttctagttctagttattagttcgaattcccagacgttctcttttttaaatatgaattaatccttttttctgtgacataaacaaatttggatttattttttagctgaaatcatgatcattgaaacaacctaagttttagaagtaaatgattcttgaagcagaagcactcgtaataagaaaaataactttacatatctcattctgaagctgtaacacttttgtcattgcagggacttgtggtatgttaggcatgaagaaatgcacacctttcagattttaacttattagacaatgaagtagagttcagaaagaagtagactagtgactattgtcttttcacagagcagctgcgttgttatcaaaaggagagctataggatcaaaatgcatcacagttaaggcacagttggactaaaaaatcagattgtaaataaaaatattttaatcatttgaaaactgcctgaagtgtgtgcgtaagctccatactgttgatacttagtgaaagtcagtataatggccatagagcaggaagggtgatttcattggttgtgtttagtatttagagtagtgtgtatgtgtgtgtctgcatacatatacaaacatagacacacacagacatttattctaaaattccacctccaaaattactggtaaagctagcacagaatcacaggtatggaaatactgagtaagcttgattttgtaaaatttaagtgcttactaactattctctcaaacaaaattttatttgtaagtccaaagaaagttaggatttaatttaagaaaggtaacaggaaaaaatgactaagtaatagggccactgacaacacatacagcaacttttctaccagttactaaaagtcactttctctagatggattaattacaaaaaggtaccctcctggaaagacaaaatacaacaaggcactcctttcggtctgacacagtcctgtgcgagacacaaggcttggttagtatagcttgggctggatttctgcttctgctcgtgcctgctctgacacatacaacctgaactgttatgtatattgtaaccctgttctatgaaccgcagacataggctgcatcttcctgagatgtgtgtgtgaatacatatctgtcacgaatgttaaaggtctttgaattgcatttgttcagcaacttttccattaagtcttaagttttctttcaatgaatccacttaaatggaattctaaacgccatttaaagaaagttgtatacggtttctacatcttgctcctgttttactggctttgactaatttagccacgcacattggtggatcaggaacacatttggaattaggtacattccaatacctcagaaaaatatagacagatagaatgtccaatcagatagctacacagtactaggatgtgaaacttactgtgttataacttgcttttgtacaattagaatgttccttactgtgaagagaagctggacttcataaatgccccaataagacaatcactgaaaagcctctttttggtgtttattcttgatagtcatctattactaccagcttaacacattttttaactgcattattctgtaacttttgatttaatgaattcttaatgagctaccccattatactgtaaaatagttttttggttaaatcataaaattttatctttctttgcattaagaatttttattaaagtagggggattcttcaatgttttctctccaggaaaagaataaagccttccttgtttgtagaaaattaacagatttacctgtgcctttgaaccacattagtttttggcttaaagtgagttcaatgcatgtagcgcttaatgtttttgacaagtgtgtgcaattgacattctggtgcttcattttcagaaggggtattgtagtacttgtttagcatttcaaaaactcaagcccagttttttgtatcttttaacatcagctatggaaaaaatgtaagtgatcaagatataaaagaatataaatatgcttattgtgcatagtttgaaattaattgtgaatcaacaaaattactttaattaatagatttttcaagaggtaaaaagtagtgatattgccaagaccttccgcaaagcaatcaacaggaaagaaggtatttgtgctctgggtggaacttcagagttgtccagcgaaggaacacagcattcttactcaggtaatcattttatatgcaataggttaacacaatgtgctaagtgggatggttgctgtaatgtcaaggacgggctctagaaaaacattaccttctaattaagaatacagtagaagtcctttgtgacatgtatttaggcttgagactaatacttgtcataaaggcattataagtgtttattgtatggctttgttagcttgcaagagacaggatacaatccatgtaatgacaggctttattacagtgcattatacagtaatataaatataatttttaaggaattttgtaacttttctgaggactggttaacgtgttctattctttttcttaattttgtaattcctaataaccactgtgttgcatccaagtgtctgggtttccacacagaataaccacatgtttctgacacattaactttcagcactactgcacaactattttaggctttggagtcaaatatttaataagttagagtatgaactaatgtcttgttatttaacataattttagaggaagaaaaatatgcttttgttaactggataaacaaagctttggaaaatgatcctgattgtagacatgttataccaatgaaccctaacaccgatgacctgttcaaagctgttggtgatggaattgtgctttggtaagatgttagcttgttttatatccagatatccaaaaatagccttccatataattgatatatttgtttctgcatgcttgacaggttcacctcaagaaataactagaatggaaaattatccaggttctgcctttttcatttaatctctaggtctgtccatgaatctaaaattcagccataaatcgacaacctctttatagggaagctctcagcctccattttcttctcaacaccaggccagcagaacattacaactttgttgaacttaagtatgtcagtgtctctttattctaaagtaccacagcttccaaaagaaaaaaagaggctactcttcagttctcactctccaatgacctatttctaaaaaatgcttttgtcactgctgctgccccacagccaacagcatcttggcagacataacacaacattatcaacactgccagtcgatgttccaatttatagaggcagtgtcacacagtggttaatagcatgctccataatcagtctgcctgacttctttctattcagtcctgccactctgaagcggtacaactgtgatcataatactcaacccctttgcatttcagtttccatctgttatgatctccacattattatacttatctcacagggcttttgtgagcattaagtaaattactacatacaaagtgcttagggtagtgcaactgacatatttcagataactatatatatataaaatatatacatatatatgtatatatatacatatataaaatatatgtgtgtatatatatttacacatatatattttatacacatatatacaaaatatatatgtatatatacaaaatatatatgtataatatatataatacatgtatatatgtatatatatgtataatatatgtatattatacatgtatatatgtatatatatgtataatatatgtatattatacatgtatatatgtatatatacaaaatatatatgtataatatatataaaatatatattatacatatatgttatataatatatgtatatatacgtatataaagtatatattatacatatatgttatatataatataacattatatatatatatatatgttgtgtgtgtgagatggagtttcgctcttgttgcccaggctggagtgcaatggcgcaattttggctcaccgcaacctccgcctctgggttcaagccattctcctgcctcagcctcctgagtagctgggactacaggcatgcaccaccacacccggctaaatttttttattattatttctttacttttagtagagatggggtttctccatgttggtcaggctggtctcgaactccagacctcaggtgatctgcccgcctcggcctcccaaagtgctggggttacagatgtgagccaccgcgcccggctgacagtatatattatagtatacacaattcttctttttgcagtagggtcattttggttgtttgaaaagctgatattaaaaatgtaagataggctggtcatggtggctcacgcccagccctttgggaggcagaggcagcaagatcgctgaagaccaggagttaggtccagtctgggcaacaaaacgagaccctgtctctacaaaaaaattaaaaattaacccaacatggggttgcacccctttagtcccagctacttgagaggctgaggcaggaggatcacttgagcccaggagtacaaggcggcagtgagccaggatttgcaccactgaactccagcctgggtgaccctgtctgtctaagaaataagaatatatatatatacatttcctttgtgttctgtttacaagcagtgaagaaataatttcccatgtgtgtgttttgtttttgtttttgagatggagccttgctctgtcgcccaggctggagtgtagtggcgtgacctctgctcactgcatcctccacctcccagtttcaagcaattcttatgcctcagcctcccgagtagctgggactacaggtgctcaccaccgcacccagctaatttttgtatttttagtagagacagggtttcaccatgttggctaggctggtctcgaactcctgacctcaagtgatcctcctgcctcagcctaccaaagcgctgggattacaggcatgagccaccgtgcccggcctcccttgcattttaatatagagagaagactgcaagtttccctctctggggactcaccctgcagaactcaaaaaatctataaattgtaaaaataataagagataatcatattgaactaactaagatttgaattttgcatggaaagaagcatggctttctttctgtagaaaaaaatttattagggcagtattatgaacatctaatatgttagagccaggcatagtggctcgcacctgtaatcccaggtacttggaggctgaggttggaggatcccttgagcccaggagttcgaggctgcagtgattcgagctacgatttgggcctctgtactgcagcccaggcgagagttagaccctgtctctaaaaaataacaaaataaaaaataaaatgttaaagtctaaatctagattttaccaaatgagatttttcctaatgagtcacagactatagcctacctaatctttctctcgccactatactgccagcaccaaatatagtgtctggctcattgttgaggcactcggtaaacatttggtgaatgaaagaatctcatgctcaactaattttactgttttgtggaaaagactcatttccaatgcaggattttatctgtctttaaaatatattcaataaagttccaccccccacttttttttttttctttgagacagggtcttgctgtgcagtgattcaatcatggctcactaccgccatgacctcttgggctcaatcagtcctcccacttcagtctccaaagtagctaggactacaagcatgcgccactatgcctagctaattttttttttaactttttgcagagatggggtttcaccatcttgcttaggctagacttgaactcttgagctcaagcaatctgcctgccttggcctcccaaattgctagggttacaggcgtgagccacactgtacctggcccaagttttgttttcaatatccaagttattttctttcataaaagaatgagaaaaaattaaaaaaaattgaaagagaaagcatgctacaatcctctgctcagagatacccaactactatgcacatattttggtctttttgggtttttttttttttaacggcatcttgctgtgttgtccaggatgaagtgcagtggcatgatctccgctcacttcaacctccgcctcccaggttcaggcaattctcctgccgcagtctcccgactagctgggactacaggtgtgtgccaccacgctgtgctaatttttgtatttttagtagagacggggttttcccatgttggccaggctgttttccaactcctgacctcagatgatccacctgccttggcctcccaaagtgtgggattacaggcgtgagccaccatgcctggccagggttttatttatttatttatttatttatttttcttttgagacggggtcttgctctgttgcccaggctggagtggaatggtgtgatcgtagctcactctaactttgaactcctgggctcaagctgtcctctttcctcagcctcctgggtaacctgtactacaggcacatgccaccatgcccggctaatttttttatcgtttttgtagagacagggtctcactatattgcccaggctggtctggaactcctggcctcaagcagtcctcctgcctcagcctcccaaagtgctgggattatagacatcagccaccacatcaggccttggccttttttatttttagtttttattttccatatgtgtagtttattatgatcaacatgataaaagtcatctagctgcattttttagagtacatgaaagagatgttatagtaagctttaaaatatttgtaaatatttacagccactttataaaaggaaatcagctctttttttttacatcagcctttttttaaatttttgtttcagtaaaatgattaacctttcagttcctgataccattgatgaaagagcaatcaacaagaagaaacttacacccttcatcattcaggtatgcattgttctcccctccctttaacatgaaattactgtttgaggacctgttctgcagacttcagcctctgcactctgtaggctcccaatcaatccttgtaaaaactgttgagtgtgggattgttatccagattatacagacagaactgggactcagaaaggtttctgagcttgcctgagattaatgttggaactgaggttcaaatcccattctaatttcaaagccccatgttcttttcatttcataatgtgttcaagcactacagagataagcagaagtatataagctcttaattaactggcgtgcttaagaaatggagcatttttttttctatcaagtgaatattagattattagcaaaattccctcagagaagagcacctcttgggatgtggacattgataacttctaaaactcttttgggcatatgcagtactgttggtctctcacccatttaggcatttttggaattataacactttactcacatggatatatttactgtggtactcagccttttcatttagtgccagcatacttcaaaaggtaccaaataaaaatacaaagttaacttctcatgagattctgcaaaaggcaatagcaataaggctgaaatttgtcttagctaggctttctaacacaaaactctggaatttgttttttgtgacacatatatggatgaaattaatacagggtattaatttcctcattgaatgttattttcagtgaagggagaaagtagactgctaaaaaatggaaaggtcaagaagcaagtgtgtaatttggctgtcttgcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaaggtaatggaacacagtcattctggcagttgtttattggttatttttttctagtcatgcagactttcgtgctctcacttaatggaggtgattaaatggtggtaactagaatgaacataaggtaatgctatagagttattcaggaaaatagcctaattacatgactctcttctttactagtaattcacatttgtctggcactttacaattcattttgcaataatgacacaaaagcacagagagattaaggagctttcctgaagtcctcaaacttgattatctatttttttctgttctgcctacacaacttctaccccgttgccaccctcagctccaccattttgcaccatcttcttttttggagacagggtctcactctgtcacccaggctggagcgcagtggcacaatcagcctggctaacatggtgaaaccccgtttctactaaaaatacaaaaaattagccaggcgaggtggcacgtgcctgtagtcccagcttctccggaggctgaggcaggagaattgcttgaacccggaaggcggaggttgcagtgagctgagattgtgccattgcactccagcctgggcgaaagagtgagactctgtctcaaaaaaaaaaaaaaaaaaagaaagaaagaaaaaaaaagagagaaaatgtaagattgcaaccgggtgtgttggaccatgcctgtaatcccagcactttgggaggccgagacaggtggatcacttgaggccaggagttggagaccaccctggctaacatggcggaaccccgtctctacaaacaatagaaaagttacctgggcgtggtggcatgtgcctgtagtcccagctagtcaggaggctgaggcaggagaatcgcttgaacctgggaggcagaggttgcagcgagccgagatcatggaggcagaggttgcagtgagccgagatcacgccactgcactccagcctggtcaatagtgcgagactctctcaaaagaaagaaaagaaaaagaaaatataaggatgaattatatttctgttaaaataggattgagccttcaagagttaattgattaattttacttaaatacaaataccaccgtgtttctagactactttaatcaaaaggttaagtaaaagattcccaaattgtaaacatctttcccccaaatccctgactttttttttttttttttttgagacggagtctcgctctgttgcccaggctggagtgcagtggtgcgatcttagctcactgcaagctccacctcccgggttcacgccattctcctgcctcagcctcccaagtagctgggactacaggcgcccgccaccacgcccggctaattttttgaatttttagtagagatggggtttcagcgtgttagccaggatggtcttgatctcctgacctcgtgatccgcccgcctcggcctcccaaagtgctgggattacaggcgtgagccactgcacccagacccaaatccttgactttagaagtgttaaataagaacaacttatacaaacatatgacataatgtgaagcttgcattaagcttaaaggccataacctcatttggtatttgaaatgtgaagaataacagagaaaagaataaattgtagtattatgttattatatctgttatatatttatcttttttagtagattatgagtatcttgaaactaggaactatgtcatagtagtttttgcacctctattacttaacagtgtcaaaagactgaatgaacttggcatgaccattattgtgtcatataataactgtgggatttttttttttttcttctagccttggctgctttactccgagatggtgagactttggaggaacttatgaaattgtctccagaagagcttctgcttagatgggcaaactttcatttggaaaactcgggctggcaaaaaattaacaactttagtgctgacatcaaggtaactgttgaaagaatcacaacattttggggggatataatagctggaagatttcatcccagcttaacagagagaaaatcctaacactgtatcaccaagccttgttgtctcttggccctgaaggtagattttagaagagtaatagagccagataaggtacattagcacctatgttttattttgtgggaaaaggtaaaaatattatgctaatttatcatattataatgctaatttgttatatcctgcctattggtaaacatggagtattaaagaataggacatgactattctattcttaactgcctttcccaagcctcagtgtacctgttagtaaacacacctagaagagataggaagggcctcatgatttcctcttcaccttttttatttggcttctctcctgtcattttatcctacctttagttgtgagttcctcgaggatagcaatgagctcttatttatgtctgtgtatcctacctcagcccctgctccagggccctcctactaaagccaacttaaaacatagtatgtggcatatacaagaccctcatatttcttgcattgaattgaatttttttttcactcactgtttatcatgagcagtgggggaaaactaacaatggaggaagacatttattacatgttgcctttggcttctcatgcagagggccaacattaccatagcaaacattgtgtggagttctccttaactgcctcaattctgtgtgacatccagatgttggtacacagggaataaacttaaggatcttcatcagatgtcactgaccagcaaggctgtgaaaacaatactatgtgatgatatgattttgttcagtgatgagaggaagcagtgagttgcctgtactactgatttcatccatgaaaattaagagtagccccaaaattataagaccaactgaccctgccctctcttttaattacacaatatgtttggccaggtttgttgttgttgctgttgttgttgtgacagggtctcacttcgtcacccaggctggagtgcagtgctgctaacatggctcactgcagcctttacctcccaagctcaagcaatcttcccacttcagcctcccaagtagctgggactacaggtgcacaccaccaagcccgattgatttttttttctttttctgagatggagtctccctctgtcactcaggctggagtgcagtggcactatctcggctcactgcaacctccgcctcccaggttcaagagattcttctgcctcagcctcctgagtagctggaattacaggcatccaccaccacgcctggttaatttttgtatttttaggagagacagggtttcaccatcttggtcagactggtctcaaactcctgacctcatgatctgcccacctcggcttcccaaagtgctgggattacaggcatgagccactgtgcccggcctgatttttttattatttgtagagatggggtctcactgtgttgcccaggctggactcaagctcctgggctcaagtgatcctcccacctcggcctcctaaaatgctgggattacaggcatgagccatggtacctggccagccaggtatattttgcttcatgcactagatgcgttcctgaaaatcagcaagccaaccataaatggattttatgtagtgggatatattttaaatgtaaagagaaaatcttatttttgtaaatgaagcctgctttgaatttttttattttttattttttaaattattttttgtttatttttttttttgagatggagtcttgctctgtcgcccaggctggagtgcagtggcgccatctcggctcactgcaagctccacctcccaggttcacgccattctcctgcctcagcctcctgagtagctaggactacaggcacccgccaccatgcctggctaattttttttgtatttttagtagacatggggtttcaccgtgttagccaggatggtctcgatctcctgacctcgtgatctgcctacctcggcctcccaaagtgctgggattacaggcatgagtcaccgcccccggccatcaatatttttaaaaaggaaataattgtttggtaatgtgaaaactaacttccagtttatctgtattcaagttcaaattttcacctgtaaagcccttttcagggtagtaaatacagattttgctgggtctgctctttacttgttcttctcaagagcataggtttattataaattgtttgtgtagctttagcaagtaattggaagtgaaagcactttcgcaattgtagtacactattccttaagaggtaaatgctatgcccccaaatgatagaatcggagttggcattttatgaattgctctgaaatagctttcaattacctgattttccccattcttagaatcatttatggcaccaagtttcaaactcacctgggtaactggtttaaaaggcacctttctgggcagctcccagacatttatatttggtagctcaggaattggattcagtaattcacatattgagtaacttcctcaggggttagtatgcacatagactatgagaaacactccttcatagcctgtctggaccttcaaagcccagtaacaggaaactattaatatcgtagctggaaggtggtcttcacatatggcaggattaaggaatcttgactcaaattccggtcctctagcattccaaagatgcaggaatttacttgacacgtgtgtaaaggttcttaataagcgtttgtgcaagtacaatagttttcaagctgtgttttgtggagttgtccacacaacctgaattcatgttgactgtgagccaaccccattgttttatgtattgggattctaagaaaacaacattcaagtgatttagtccaggggtttaaaacgaaaagagacctttgttttgttaagtacattcagatcatagagggttcagtgttattttagcaactaaaatgtttaccatttaatgcttttgtcatttaaatttacaattaaatacatctttaacatagctaatctcttcttcgtaggttgtggtatatgcattgtgctttgtaatgatataacctgtttattttctctttcttctatgcttcctggatttctgctctcctacttttttaaatgcttgttttgtctgtcaagcttattgacttcagtaattcagtgaaggtacagaactggttatatgtttattagcattattgtattgatgactttaataattgcgaagtcatgtcaaaatccagttcatccatatgcaagacagatataaggcagatagatggacttttctggggaaaacacctgttaaattaaaaggcagagatttgtgccatttattctcaaaaaatccaatgcaaatagccttccaaacatgggacaataggatacattcattccttgtaactgtgatctcactgacattttcaattctttgtaggattccaaagcctatttccatcttctcaatcaaatcgcaccaaaaggacaaaaggaaggtgaaccacggatagatattaacatgtcaggtttcaatgtaagtataagtgctcttttgaattctacaatcttgcaaaattattgtcaatttcttataagtacaataatttttataatcgtatgaagtagagttggcaattttaagcattattttaaaatgtattactgtacatgtaattcagaggccagaaaactagctttgatttattttgattgttagtgaattccatcgttgttgtggtattgatttatatggatggcataaaatattcaaaacaagtatggggaaataagtaactagaagctaaccttttccaagtatttggattacaaccacagtaatagatttagtgactatatgaaaaccttttccaagtatttggattataaccacagtaatagatttagtgactatatattcatattcctgtgttgagagtaatgtgattatgttttacaaactcccaatctatgaaatctaatttagggaattactctcagagaccatgttccctggttatgtcactaatttgtttagtgacattggacaagttccttctcaaaattggatttcactttgttcatccataaagtaaggagttagagtgaactatttagtcccaagtttctaggaatctgtggtttttgtacccattagatatggaatgcatgctactaattaacaaaatccacatatctagcctattatgccataggatggagtggattacattggctaaaccatttttcttctctttcttttttttttttttttttttgagacagagtctcactctgttgctgaggctggagtgcagtggcaccgtgtcggctcactgcaacctccatctcctgggttcaagcaattctcctgcctcagcctcccgagtagctgcgattacaggcgcccaccaccatgcccagctagttttatatttttagtagagatggggtttcaccatgttggccaggctggtcttgaactcctgacctcaggtgatccactcgcctcggcctcccaaagtgctgggattacaggtgtgagccaccgtgccttacgtggctaaaccatttttatgctgcccttatcagaactgaatttgtaactgacttgtgtgcttatatttctgtctgtatgttaaatgcaaaactcttcagctcaggtcactcttggtagggatgaggggccatcttgtccaagaagggagctgtctgggttggctagccatgtgatctgataccagggtaaatggcatcagtatgctaaccgattctgatacaccccttctctagtcaatcctttccaattgatcttaaaacactcttttgtctcttccctcttcagaatccgacaaggattcttctgttgactctagaattcagtctgaaatgttctgcttggcactcaccctacaaatcttgctctaaaatctagccagtgttatttccccaaaagtctgtgttccccaccccaaccttccttcccaccaccacccaggtgcctttgctcatgctgttctcatggttttcagtgtccttcatctttttcagctttacaccttctttagggtcttttttttttttttttttttttaagagacgaggtttcgccatgttggccaggctggtttcgaactcctgggctcaagcaatccttctgcctcggcctcccaaagtgctgggattacaggcgtgagccaccacgtccaaccaaggcctaattttaactctgaacagttttacctgttttttatttcaatttaacttttttctcttcgtctttgtaatggaaaaaatcccttcctttcgtcctaacttttttaatccttcaattccctgagattaatccttggtcttgccttccaccattctccctacgctcaaaagaaatcagtggaaatagattctctgcttctcttcaattcaagcaacagttcacaagcatttcccttgggatttgagcatgacatgaatgaaggtgtctgtcttctccctcagccagggaagcctacttccacagctcagcacaacttcctctctctctagctcgctctccagcagtgccctcctttctagttccttctgctgcataacacagccccagaggttccagggttccaaggagtccactctgtcatgaagctcattgacttaatgcacagtacccagaagcctcagtgaagttcagctgagagccagtagaaaaaaggagaaactccaaagcagaaagtagtaaatcagcaaaataaaataaaataagccaggttgaagagaatgaacccacaatttacagaaaatgaacaccattttctaaaggagacttaagtaggactacagttaataccctttcacatttaataattaattgagattcattgtagataaagtacatttgaaaaaaaattttaacataattctactgaaaatatctgaatatttaacttgaggtggcttaaaaggacaattgaagctgttttcctattgagaaggaaaaaaggaaaagtggaaccagagaaagtgaagatggtgaatgtatatttttctctacagattttcaaacaaaatctgggagtttcccccaaccttttacgtaacttctttcttaatgcaatttagttaaatgtactcagtagtttgctgtgtgatctggcgccatctagtgtatattacaggtactgcatctccaagagggccaacctttttttttgcattcaaaacaattttataataagtaccatatgttagctaaaagaaagtagaactgtatacccagactatgacagtggggaaattttctatatttttagtgtggcctttgacaaagtcttccgattttgtttcaacaggaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggtaactaaaaacctcaatttcgaatgtgtgggactatagagtagaaatacataggccacaatgattttacaatctagacttaataagtttttttatatctacaagaagtagatggcagatgctgagtaaaaactggcaggaaagtacgatacaagtgaacttttaaagtaaagtagtcgaggccgggcacggtggctcacagctgtaatcccagcactttgggaggccgacatgggcggatcacctgaggtcagtagtttgagaccagcctgaccaacatggtgaaaccccgtctctacgaaaaattaaaaaattagctggggcgtggtggcacatgcctgtaatcccagctactcgggaggctgaggcaggagaatcacttgaatctgggagacggaggttacagtgagccgagatcgcgctattgcactccagcctgggcaacagagtaagactccatctcaaaaaataaataaaaaaaataaaaagtagtcgagtcgcttaatgtaaagccacttagtaaatcagtatttagttttaatatttagggttagaccactttttaatcctctcatcaggaaaaagtgcacatatgcattcagtttgacctgtaaatttagcatatatttatgtttcattcatccacagtcaatgtaactggaactaaccccaactcctttcacctttacctcctcaagaaacaaatgataatatatactaatttttttttaagttttggaaaggcagagtttaccttttccagattatatatgtgtgaagcgtagtctataaaaattaagaaatgcagccaggcgcggtggctcacgactgtaatcccagcactttgggaggccaaggtggccagatcacctaaggtcaggagttcgagaccagcctggctaacatggtgaaaccccgtttccactaaaaatacaaaaaattaggcaggcattgtggtgcgcacctgtaatccagatactcgggaggctgaagcaggagaatcccttgaacctgggaggcagaggttgtagtgagctgagatcgtgccattgcactccagcttaggcaacaagagcaaacctccatctcaaaaataaataaataaataaataaataaataaataaataaataatgcaaatagtaattcattgagtgtccactgatatttctataaaaccagtaacttaactgataacatcagttactttgagggatgcagattcgaggaaatattggagaaagatttgagaaggagactataaaaagttcataaacctctaaattgcttaactggttagaataaggttgtattctttaattttaaaataaattcaaattttaaaaataagcctgtacctagagagaatgtatgtacttagaagaatgcttggaaactcgtattatcgaaaaattctagatctgaatagagagataaaataatctaatatgtgtattggcactatatgcacatacataaagtgtttaatgaatcagtaaattttgtgaatattcttaacaggagaaactcgtgaagaaagaaccttccgtaactggatgaactctcttggtgtcaatcctcacgtaaaccatctctatgcgtaagccttcctactgctattgtaaacagttacgaatgtcatgaatggatgttaaataatgacagctctaaagattttctagatattaatttgtagctattatttatattggaaaatgtcaagtggtgatttccatcatcattttccaaatacacaaaagctttaagtattcctttacatgatcgttaactgtaagtgatagaatatataaatgtctttatagtaccctagggagcaaatactttatattttgaaacagctgtttgggaggttgaggtgggggcattgcttgagcccaggagtttgaggcttcagtgagctatggttgtgccactgtactccagcctgggcaacaaagtgagatcctatctctaagagggaaaaaaaaagaaaggtaaaaaagaaagaaacagagaccagggaatcctttaagtagaccatccacaacaactcagggactttggttcattgttctctcagcctggaacgttctttgctcgcatatagtggctcgtatccttactgtattccagtcactgattcaaagatttcctgactaccacctgctactctctaacccctaaccctagttcctttttttcttaatagcacttacatacacccctaaaattgtttgtttattgtcaacaaaccaataccccccgtattgtttgtttatccatgtacttgtttattgtctatctctctgactctaatgcaaggacagggatttttgtcctgtgggcccagcctctagaacagtgccttgcttacagtaagctctcaataaatacttataaatgaatgggatggtcttagctctgttttcagcacagattgatagaaaatatgagtcttgggtattatttatggttttatatatcttgtttgacaatgtagtgttactgtttttaaggaaagtcaagtcccagcttcctgaaaacactgattacattatttttaaatcattagtgacctgcaagatgccctggtaatcttacagttatatgaacgaattaaagttcctgttgactggagtaaggttaataaacctccatacccgaaactgggagccaacatgaaaaaggtagataattaagttgctgtatatatttgttagagtatttttattctcgattaatttcttttgtttctaaaactcttgacgctgagcttcttgaggacaaaactgtgtcttatttgtttttgtgtgctgatacctagcattatacaagacacacacacacgtatgcagattaaacaaatggaagtctttaaccatttactcttgtgcctttgcagctagaaaactgcaactatgctgttgaattagggaagcatcctgctaaattctccctggttggcattggagggcaagacctgaatgatgggaaccaaaccctgactttagctttagtctggcagctgatgagaaggtatagtacacaattttagctgtttagtctttactatcatacaggtctgtgatttagtccttactgtgtttaataagtggatatgtcgataactacacttttgaaatatgttatatttacactccgaaatgagtttaattaatgaatatatgttggatgttaagtgggagatgcttccttgcaagttaggcagcagaactatggttagtcccttttttaaaaaataggaagcctgacacacagatttcggcctcgtttagtgtcagtgaattaaaaaattgtcagaacaaaattatgaacatcttcatgctcatttgaaaataaagatctctctctgtaatgctgatgaagatcactataatgctgaaaagcattcattatgactgggcaccagccaaagcacagcttattttatgccattaccgctattggaatagtacaaaatgtgcctacagtgggctgttggacctgctcattaaagcactgtcaatctgctcctctctcaccactacaaagagtagatcagtagcaagccactactgcttgaaatatttttttcacatagtgtgaatctctttccatgaaatctttagtccttgaaatttaaggaatataggggccaggagtggtggctcacgcctgtaataccagcactttgggaggccaaggagggtggatcacgaggtcaggagatcaagaccatcctggctacacggtgaaaccctgtccctactaaaaatataaaaaattagctgggcgtggtggtgggcacctgtagtcccagctactcaggaagctgaggcaggagaatggtgtgaacccgggaggcggagcttgcagtgagcaggagattgcgccactgcactccagcctgggcgacagagcgagactccgtctcaaaaaaaagaagaaaaatttaagaaatataaaaagtggaagataaagcatctttctgatgtttgcatttttcctcataaagtagatggtgacgttttcttctgctgcctctcttagatataccctcaatgtcctggaagatcttggagatggtcagaaagccaatgacgacatcattgtgaactgggtgaacagaacgttgagtgaagctggaaaatcaacttccattcagagttttaaggtcagaatccatatttgactattaaatattatgtttgctggataacatctatcatttgggaaggcaacttttggcttctttgtgagtgagaattagtgttgggctaatggcacaattctttacgaattcactgggctttgtttttggcacttgatataagtaagcacatgttaatttgtatgtatcaaaattctcagatttgttctcctttcacactaggacaagacgatcagctccagtttggcagttgtggatttaattgatgccatccagccaggctgtataaactatgaccttgtgaagagtggcaatctaacagaagatgacaagcacaataatgccaagtaagggagactgctaatagtatgaaaagaacgcagctttgtagctggacagatctgaattctaattcaggttctgccatttaagagtggtgtcaccttgggagaaacctcttggagcctcagattcctcatcaataaactgggggcaataatacttaccttagattttataaagattaaatttttaaaaattataagagcctagccttgtgcttggcctactaggtgcttagtcggttgttgcttcagtggattacagaaataatgtagcatgtattttaatgcaaatcaggtaaaactttacaaggaaaataagagcttagggtgttcatctgtctgtctcattctttttttaaaaaacgcattatccacttatgtctcttttactatacatagatcattcttactacatttattgaatttatcttcatcagttcccatattaacagaatgcttgctagccctccacagaagactatgccttgaaagtttcttgcatttcaacaatattcagaaggtcttttccaccagcctattttcttcttcaccaaaggcctagagtgtgacctggcttcatgggtgacccatgaaaaccttactagttagacattgaaaatccatccacagtcctgcattaccgaacagctaagaagcattcctgcaaaactttggagttaggcacattatttcttttttccttgaaaaatatttctagcagatatgacaaaggtctaatatccacaatatatcaagaactcttgaaatctctttttctagaaactcgatgatttaattatctttaaagattctggttccaacacacctagaaatacttcacggattagttgagatgtgttcctgaaaatttccctacctggacatctcagttcttctgtcccttcgtctaccttttctagtttttggtccagccactctgtccacgtaccacgtagactgtctcccctctcatgaatacttggaagtattcattgcatctgcctaacaacttgggttttgcatctagcatgattttccacctcatatctctaagatgacttgagtgtgtgttattatgtgtgcaatgagaatattaacatggattgtatagacagcctaggtaattatatatataaagttggtgcttcaagcttaattctcacctcacattggagaaaaagagtgaataaatattattagccccaaataatagagcttaaaaacctactgtaacttcaaagtgaaatcaaaacccaaatcaaaagaaaacaaaaagcaaaactgttctaattggaactatcaatatggaatttttgcatcccagcataataattatatatgaggaaatagatgtcttacgtggtgtccttaactgacaagaatttcatcctgattttgtttccccctaaaataggtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataat

SEQ ID NO: 35812 - DNA, 172692 bp, Homo sapiens
cgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcgggggtgagcgcggcgcggggcgggcccgggccggggacccccagcgcagccccctctcggcgggcgggagggcgcggggccgggacgcggggggaattgggaaccgggtgggcggaggaagggggtggggtgggtggggaagtaggaagaggctcggcggcgaggggaggaggtggaagggaagggaggggtagggtggggaggggaggggagcggagggagggtggggagggcgggagggggaggggcggggagctggagagattaagtttttgtgtgtgtgtccctgtgtgcgtgtgtcattttaaggtggctcgggagcggcccggaggagccggcggcggcccgaggagcgagggaccgaaccgggagccatgccgcgctgagggggggccgcacagccgccgccaccgccaccgccgccgggtggggtgggaggggcgggagacgccgccgccgccgcctccagggtgggcgcctttcgccgtggacgccgaccgtccgggacgaggtaaggggggccccgggggagggctggggccgccgccgcccccgcctcacctgcggccgcgggctgggggcgccgcgcccgcgcctcactgcgccactcagggaggaggaggaggaggaggaagagggcgaaggacgcggagccggcatccgaggacatctttggtccgtgcccccggcctcgtgtcccccctcggcgcccgggggtggacgctggctcgggggtccccgcccgcccccgccaccgattgcgcccgctggccgccgtttgcgccaggatttttgttgttgtgatgagagttgatgaatgcgaagtaggcggtcaccttccttcccatcagggttgaaaaaaaaaaaaaaagaaaccccgagcgcggcggcgtccggagggcagcggcggcggcggcggcggcgtctcggcgacggttccctgggcgcccccggctcctgctccctgagcccggtgggtgcgcgcccgggggccgccggcgacccaggccgagcgcgcgacgcgccgcggggacaatacggccggatctccggggaacaggagtccgagcgcgccggggtgcggcgggccttgcgcctacgaggcgagggtggggggggcgcggagaagaggggttccgtggggaagtcggggcgtgagcggctctcggtccccaggggcgctgcccctgccggcgggggatcccgcgcggctccccgggagcgcaagtgaaagacgggaaaggaggcgaagtggaacccttttgttttgccggccccgcattgttggctcctccgggcagccgggccacatctgctgccgctgccgccgccgccactgccgcgcggggctcggcccgccaaagtcgcggcggggcggggggcctgggcgggccgggcggcgggcgcgggcgggggccgggcgggccgggcatttcctctgcccggccgcgctcccgcgggcaccacttcctcctcgcccgccgccgccgggagcccggcccgcccgcctcccccaccttccccgcccgggccgcacttttcgggtggggcgaatcaaaaagaaaaagtttagcaggaggggctggctagggcgcgccccgggcggcagggacccggtgcggcgcagggacagccgggccgccgcggttcctcctcctcccagccctccgcggcgccggacggccccgcgcggccgaggggaagcgcctttctttctctccctcgcgctgcccccagcgccccgggcgagttgggcagaggcgcgcgggagccggggcgtgcctgggcctttctcccgcgggaggcccagcggcgtggcgggtcgcctgcagcccacgccgcgccctggggctcggaggccgcgggcccaagagctcagctcggtcaccgcgggccgcgccgagacacacacgcgcgcacacactccctcccgtggctcgctttccgccggcgacgacggtcgcggacacggagtgagcgtgtgcgcgcgagtgtttgtggttgtcccccctccccccgcccggtactttttccggaggcggcccaagcggcagttggctgcagaggaccccacgtttaggattttatagggaagaggaggaatttttcgtagaaatccccgctctgcgtgctcgtggtggaggctgctggcaatggcctacgtcgtcataccgggcttccttgccctgtccggggtaaacaatccttctgtgtatttacccccttttttctttaaagattggagatcgggttaagttcttagagagtctgatgcgagtggctggaaggatagacaagagaattctattctataaatatgcattgggaatttaaaatgctaaacgccttatttgcaattctgttggatattctagagactggtatatttttatctgacatggataattttgaggggacgttatattttggggaagtttacaaagtgattctttctgcctttctaacttgggcgaaatatatcgactcataccaccctttcaaaaaagatagctttctctactaggtgtttgggttcgaagacagtttaaaaattacctcgtgttcagtacctaagattgctgttttgcctcgagggttttccaagtagaagtgggtagttttcatgtactttgagaattctgaggtttttaacccccccctttttttttaaatataaatcttttctattttgaagtaatgagactttaaaggatcttgtttttgtaatcacttgatttcaaaggatacttcttacagcaattataaagtaatagtcaaaatgctaattagacattttcagtcatagctgctttaatgttgaaacagaatttttttctttagcagagactgtatcgtagagttgaaacgctaaatattcttttgtctggcatcagatctctgaactgctctgacattctcctgaaaaacccctagtgccctttttattgcccccaaaagaaaagttaatgagatggtagatttcaagcaaaaaaacaggccctctttcttgcaaaatatgcttacagttgccattgaagttggatgttagccgtgaatgcacttgcctttaatgaaaccagtttaatcgttcacacttgatcaagtataacatgagcaaacaaaggaaataagccagcatatttctgtagagtgtaagtgttgatgttgggtcaccccctccccctaccctgcccccctgtaaaagggagagagggttgaaggcaaagggaatttatggcgctgattggttttttgtgccccaggggtaggggaccccagttacatccctgtggaaagcagttattagagggaattaaaagatcttgggtttggagcttgttttgaacctgactaggtggtttgggtttaattctttttcctgttcagaaagataaggtaaagaataccgactcccccccgctctttttttttttttaacccccacctgacaaccccctctctaattgtaccttaataagagtctgcaggttgaatgcagaaccctgtgagttatttacggtttcgcctgggagctttgaaactgacccttgaatgggtgttctcctgcggggaggggcagggtgaattaccttttcttaactgattttaaaaagcctcattgtccctaaaaatcatttccttgcacgagttgcaatttatgtgtggaactgaatcatcaattccgtgaagagaaagatattcgtaaagtacatctctctaaagttaagaaagtaagaacgtttggctagttaaaaacaaacactactgccattgtaaaaaacacgccagtgacatacttggtgagatattttggccttttgagagtcggggcacacctgttcctgtccctgccaagttgtgtgtgctttccctgccattgttaatctggtcgtgtacacaagatgaaacggtaaaacttgctatctgtataattattaactagtttgtcagttaccctttcagagaataatcaataacttcagtcttaacttttaaaactccagaaattttactttttaagtctggaaaatgtttcaaagagagattaaatgaaacaaacaaacagcaacaacaaacaacaaaaccagaaaatcaacctacaactttttagtttctgagtagccagctacaaggcaaagaaatgatgaatatatatagtatgtactgaacaagcagtgcactggattttaaaatgatatttttattgttaccattgctgttaaaatacaaacagctcacactatttgaaatccttgagattcacggattgaaaaaaaaccgaaaaggacacctctgagtgagggagtagccctgctgagatctagcaccagaatgccatttgccaacagttcactaacatcatgaatcatttttgaaagcaaagttataccctttgcacttaacgctttccctaaatggaaaaaatttaaagagtttacagcaatggtagaatggcagccccagttgtcatttttttaccactgtcatttccatagagaggggctgtcatcataatgtatgtgcatgcagcctgggtccctctgttaatctatcagggaaaagcagcagccctagtgtcctgtggccctgaatcaggccacaaatatatattcatacagcacatggttgggaagggaaatttatcagttgggcagggcacagctcaggtaatatttccactttgggatggtaggtctgttacacagggtggaacatatttttgtagtaactaaaaaatgggagggcagtgtgtctgtccctggaaaaagaagtatttgtacttaatggaagtgacccatgtggtgaaatctcggggtgtcttttccccagcaatctttctatgaattgctaggggaggaatgcttgtgtgaacttaccctgctgaaaacttttagtgggcacatgaaatgctggaatggatacacttttagagactgtgcggcctggcagatatcagttttctcccttacagctggtaagcatgtcttaatttacgctgctgcaagttaaagttacagcactcctggaaagaagggaaaatgcaaggcttctcctccccacctcatcttttgaagttaattttcattcaagtctgtgtttgatggaatatgtatcaaagacttatgaaagagtttttttttttttaatcctatcttggggtttggaaaattatatttaataattgctaaaaacttaagaaccattttaaaggtgttcagtggcccttttgatcatgatttaatggagagtatccaaaagccatcagtgtgactctaatgatattcacaaattaatgtttgggcataatctggagtttgcttttagctatcattattaatgtttaaagcctaaattatggctgcacttgggcattcagaacttcgcctgtgaaaagaagggctttgcacattgtgtaaaaaaaaaaaggggggattcacaaatgaatacagaatgtacaatagggagagagccaggccattgtttgtgtggaatgttgaccatgggagccaagggctagtttcgccttcattcttctgactgctggagaacacagaaacttcaggagctgtggacgggatgggaaccaggggcacattcatccgtctttgccgggcatggagatttggcctgccccctttccagagtttttcttagaaggtggtcttttctggactgctaaggaacgtcgtgtgctttctcttctcagtaatctgcttttttgaggaacgattttaacggcagatagtaagagttcctcaaggaaagtaaacagaccttttctaccccctcgaaatgtgattttaggaaatgatattcaacttcagaaaggaggcatcttaagtcacaggaggaagttgtgtttatttttactcctctcctgactttaaagtagtttttaatctgttggtagcattagggagaatgcagctaaaataagtttttgctggatgttcatgttttgcgtagctgctgccatttcggaaaaagctcctcccccattcacaaagcccttctccttccacgtgggagccgaggtcccaaagtggaaccaactctgtagcttaagggaggtgcattcctggcccctcactttctaaccctcaccttaagtggaatatgtagataatatgtagatcattaaccattgttggtgtctgaagcctgttcagtttttttagcaacgacactcggtgagaaccagttgtagtttgcatgtgtatatgcctagtccctccctcagtgaatgttttagaaagtgatctgctttagctgtttacctaactaaatttaacagatggttgcctagagttggcttaatattcacaaaaattgtgatgaaatggttgggatcttatgaatgggacaagtgatgattttgtttctatagagaattgtgacttttgtcctaggtaataatagagacttcgtttttcccaaagatcggttggtgtttaaaggatgggaaccctgaatagctgctgttgtctgcccctgatcctggtggtggccagccttgcctttggttttgttgccttctgtgagtccagaaaagccctggaggcaggggtgaggggggagagggagggctgggcttttcatccgtggggttctaaaaatccttctcatttataaaatacaaaaatacttaccttccattgtattgctgatttgtgcttcctccaaagctctcctctgatcagcagaaatgtgcttcttgcattaaaacaaatccttaattatgactaaaagaaactgtcagctgccttaaagattgtctggaaatagtggcaatatttctgtgtctcattccagcccacgttgtggcagaagcctggaagggccacgttaaaggatgtgtcacagagacagtgtgtgtaggtcttcctgcagcacaagcaagctcagggcttgtaaagtccagcttatcgtggctgtgctccagccatgcctgaaatctggcctccagcaatctgtcccgtcccaggacaaacaaaaactttattatggagtcatggaacctgaggaagtttctctggaaggaaccgaagacctagaccgtggagggagatcaactcctctggcctaatggggcttttctttttccaagatggaatttaaaaatctcatctataaaatgaggctagcaaagaatcattttatggtgtaagtggccagaatctaacctggaagtgatagtattgtacctgccgcaggtgtgtgtgtggcagcgggagggtggagaggggaaatgagaggagaagagtttggaggggaaaacagagcattcgaggtttctctgctggagggggtgaaaggccaggagtttgtgcacctttccttttaaatgagctctagctgtgagtttattattttgctgatggatggtctttcgtgcagtctagaagtgcaaacacagtcggcttatccgctgcttgttcaggtccagggagaccaagggaacgggtgggggcagtgcttgcaaatccatctggatcctggacaccccacttggtgttgctgcagccagctcccaggcctgcccacctggagtacagccagcgccagcagcgggcagggcccgagagagctcttaaagccatgtcccaggaacggttgagggaactgagaatgttcagcctggagtggagacacccctgggaagcccaacattgtcctctgtgcggtcatgtggccttactctgctcggaacagggaggccttgctgttggagctgccgggccagatgggctgcgtgggctcctggcacaggcagaacttggctgaccattggctcccagtgccagccaaggctctgcaaacacccgagaccctgatggagactcaggctttgggagcacctcctaatgagctggggaggatactgtgttttcttcccagtggggggtgaccaataatcttaaagttttttccctttctccagacgttcagctgtggtccgcactctggattgctctatctgccctgcggactggatagaggctcagcgtagatgcccagctgacctgacatttcctacccatatttcctagtgtttcaggagcaggcagagacagacctgattcctttatctcggggctttcagattacggaatagaagtcacactaggagggcaatcaataaagagtatattttgctgtacagataccaatatgcacatataagtgcctacaagtaaaatctgggaatgtttttgatcttaaaaacatttcacagtcattaatcttcacgacgctcctgcgggctgggtaaatagagcaattcctattttatgccaggaagaaatattgaattgcctcccccaagtcataaagaggctgtttttcctccttgttcctgtgactcgcggtgtggggggcctggggcgcctggaacccctgcgatccgctcagactgactccaggacgacttccggtgtcctgcgcgaccttctgttgcggggagcgccagtccgccacacctggccgcgctctacctggagggggcggggtctcctgcatttcccggaccgcgggggtgccccaccctgctgcaaggacgggcctcctggcgtccgggcttctggggtcccggggtcccggggttcctggctcccgagccccaggtgaagccccctccatccctggggttcgcccctctcctcccggcgggtggacctggaggccccgcccccgcgggccagaacacctggcggcgcggccccgccccagctgtgccctcttccccccgcagggcacttggcggccccaccctggcccctccgcgggccgcggtatctgacacccccgggcccccccacctcgcgcctcgcctttacacttgtaaatggagccgcttcccgccgcggggaagtcgttgagaggtgtgagaatgggccctgccccctccccccgctccgtgcccacttcctccttcctcccgctggcctttgtgctgggcggggccgctcggacccggggcggcgggggtccagctagacgccgcctcaagccagcagggtcgccggcccctctccggtccgcgaggccccggcaaggtaggagcctcgagaccacgcgggacaccaggttggcccccagcccgcactcgaggctcagagcaggggcggggacctggttgcaccaggccagagccgcctccaccccgcagcggtcgcggactccgggcactcatggggactcctggggtcgtggtgagtggtgaggttcgttgattgactgcgcgatggtggctgagttgcaagcaaacggtaaacagcggcatcatttccacttgaccggcttgggatctcgtctcctgggcagtgtttgggggtgaccacggttcttggataaccttcgaatctgggtgttttccttgtagtacaaatagcgcagtggcagttgctgtgggaaacagcgagggccactgagaccttcagcagaactccacgtcgaggacgagtgacatttgcgcgcctctgctgcgttctctgctgttcaccccggcggctcccaacacctgaagcctggcgaggcatgtgactagaggttgtccgagcgcagagtggtaggacggtgcgatctggcccgtttcgtcttgccctcgtcttctccatggaggaatttctgtgttcgcctctatgttttgcagacttaatttggtgctccagaaacttatgcagccattcaagtgcgctctacctgttattcaagtaactagagagcaaccatttcttgagcacttacttagtgtctggcactagctcgctgggccattgtgtgttgttgcgttgccctgactcttcattggtaaaacagtgactaactatcacctgtgcctctgcgaggacagcgctgtgcttggccagggctggagagccgatctcaaggcaggtgtctggccttttcctggacatagtgagtctgtgatccagagtctgacccacgtattcaacggggcctgcctcaggcttccaaacaggagccaggctgttgtgaatattcactccaaaagtgcagtgaatgtaaaacatcctagagcaggaagtgaggcaggccccgttgaatacgtgggtcagactctggatcacagactcactatgtccgggaaaaggccagacacctgccttgagatcggctctccagccctggccaagcacagcgctgtcctcgcagaggcacaggtgatagttagtcactgttttaccaatgaagagtcagggccagggagcttaggtaattaagtctggctagttactaccaacttcgcctggctctggcttctctgtggctgaccgaggcttcttgtggcctttgactgggacacgggaatgtctggggatggctttgccacactaaccaagactagactccttctttcctcccaagctgtttctcccttgccctcatctgtgtgtctctgatgcagcaccaccccacactccaagaatgcatgggcacactctcctggggttatgtgtgtagctttcacagtgcttagggtttcatgtggtaaaattggatttagtggccaggtatcatttcatcaataggtaagaccatgtttgtggtctgggatagtgtgatctcagttgccctccaccccccatctccctcgagggagggcttgggtccatgggatgcacccctccccaactctggttgcctctggcattcaactggagccatgtgcacacctgaaataggatctggtttgtgggttccacgttggggagttgggggtcaagagacagggaagatgcttaggatttctcctaactgtgatagtctgtttgcaccactcctgtgaaaaccagggagaaactaggttttgccgggtgaacttcctttgggtcgctcccctgcatccgtgtggtgtgggccttagaaaggaatttgaattaatactcctgaacaaagggaacagccttcttttcaaagaggctatcagagaactgacagggaatggcacagagttgggtgtgtcttcaaatccagagaccagccccgctccaccggaagagtacccggagcaggtgatgcgggagctcccaggttgaccttggctttccatagagggtaaggtccccacaaggtgaaggttttcctgaaaaacaggcttttctttataagattaccttcctattctacaacccttctcttctttttgtgaacacgtgtgtacacttgtgagcacatgtgtattctggaaatccttggtttccgctggggctctggtggggccgggggtggtgtggatgttgggtgccccccgcctccatcttggcctttggattctgctctgtcttgtggatgactcaaggaagtgctgggaggagtctcttgacaaatcagtcatgtgagtcccggtgtcctggctcacctccagcttgggtatgaatagagtcagcccattttaagtgccccctgcagtttttaaacaggtctccttccacttcactccacctggaagagggtggtggggccaggatcatccctgggccagccctctcctttctgtggtgcctcactgggacactgagaagggggaagctgctttctcagaggctgttgcttggaaagtggcatctaagcatgagaatgactgcggcgtgcaggttcccatgaatggtcatttcctgtgagccgggccttgtgagtggtcttccagagcccatgtcgtgtctatggtgtgtcccctgtcctgttccaggtttcagggatcctttgcgctgggcagaagatccactgagctggcatccaggttcctccagcagaacacggcgcagtggtggacctgccgcagctctgaggccagcgagccagttttccccagcaccctgtttcccagccctagcatcttcagagtgtccattctcctcgctcctccacggcgcatgcttttcactcagggttgaggattctttttcctccacttgcacacatccttctcatttctcagctaagcctgggattaagaatgaggcttcaagtgacaaaagccaggagatttcacaattaaagttggaattgtgtctgcagtgatgtcttcctcagcatttaaggaaggccttgaatagtgggtaatatttttctatcctaaattggccacatggctccaaatagtgggcaaaggaagacactcctgtggtaaattcgagaatgtcttagttgaggctctcatgtccgtagaggatgaagggaggggggttatgactcaacccagttgtgcttttgggtccctggttgtgtcccagtcaggcccgagagcttagaagcaaatcccgtatgttacttggcccctcagagcagtcttttaaaatatttctcagcaaggaagcttaaaaaggagtttactttcctaattctcttttgttttctagagcagcgggcaaggtgggagggagagcctgggttcgctgtggttagtgggaagggggctgcagcagcacatggaccacctttttggtcacgcctgtagctgggagttttgcaacctggtggttacttggcatgtcagggtcctggctcagatccaaagttttgctctaggggccccggcagcgcactttgaaagcactgagctaactgctgtgctcactttggtggctggtgaccagagaggtcccactggaaggtcgtgaatgtctttcttcctttcaaacactgaggctcggcccaaggagagatggtcctgccctcctagagcttagtagaggcaaaacaaggaagtgtggcaaagaagggatggaaagaaatgctggacttctctcccacactgggaggcctttgcaaagggcttcggtttctgaatctgtaaaatgagggtaaggagagggtgtgttgtaaggattcaatgaagtagtgtttctaaagcctttagaactggcctgacgtaccgtatgtgtttgttagaatttttttttttcccgagatgggggtttcaccgtgtcgccgaggcttggagtgcagtggcgcaatcacggctgactgcggcctcgacctcccgggttcaagcaattttcccatctcagcctcccaagtaggtgggactacaggtacagggcaccacacctggctagtttctgtattttttgtagagatggggtttgccatgttgcccggactgctcatgaactcctgagctcaagtaatcctccctccttggcctcccaaaagtgttaggattacaggtgtgagctgccaagcctgtcatggtgctatgttaaaaatacctggaagatgtcgtgccctgtggtagggaaggggagtggctggtggggctggcttagtttgggagcagccgtcttctttctcattgattcctggggcccaaagcaatgaactgaaaactgttcacgaggttaattttagtctgtgggatgttactacgtattaggtcactccaagaaacgctcagtaaaatatttactttctatttaagacctactttctcttcctggagaaggaagaaaaaaactgccttgcctgatgggcagccagggtgggggcccagtgctgccccagccaccctgcccaggtgaagcctgttgagaagggtcgctcaggtttgaattctcctctactgaggcctcagtacataaaccacagtgaacgtgggcatgacaggccacattccgaggagcatatttgttgaggaaaaggaactgtgtctgcccttccctctgtgcacacgtcatcatcatagctcccttcaccctcccaggtccctgaggaatgggtgcgtttgccggtcagtgaccagggctgtcgacttgcttggtggcatcctgtttggtttcttgtgggtgctcagtcagcagcagctgtggtaactggaccaggtgcagctgggtggcagatctgctgtgatgtttgagcatgttcctgaccccaggccctggcaatggggtggtaattaatcatgtcctcctaggatattcattcacagatactgactgagcacccactaggggccaggcacagtacgcatgtgcgtacagcatcaccaaatgtcttctgattgaaatgttcaaatatcttttctccacccagccagtgttaactgctctgtgcttcctgtggggctccaggtgtgaatagtaggtcatgtgcgtgaaatggcaaggtggggtaaggaaggtgcctgtccggcagttagtttgtcaccttcagagtgggctggtcatttcatggaccagcagtttctttggattcaactcatgctattaaaaaatctcacttggaggccaggtggggtggctcatgcctataaccccagcactttgggaggctgaggcaggtggatcacctaagatcaggagtttgagaccagcctggccaacatggcaaaaaccctgtctctactaaaaatacaaaaaattagccatgcgtggtggcgcgcacctgtaatcctagctatttgggagtctgaggcaggagaattgcttgaactctggagacagaggttgcagtaagccaagatcgtgccattgcactccagcctgggcaacagagcaagacgctgtctccaaaaaaaaaaaaaaatctcacttagggccgggcatggtggctcacacctataatcctagcactttgagaggccgaggcaggccagtcacctgaggtcaggagttcaagaccagcctggccaacatggcaaaaccctgtctcttctaattagttttggagaaattgattttgtagattatattttagtctcttctagaaatacaaaaattagccaggtatggtggttggcacctgtaattccagctaatcgggaggctgaggcaggagaatcacttgaacctgggaggcagaggttgcagtgagtcgagatcatcccattgcactccagcgtgggcaacaaaagcaaaactctgtctcaaattaaaaaaaaaaaaaaatctcacttggaaaagcaaaatggtccttgaaaatgcccttgggaaaccacccatgctggaatgcaagggcatctcagctggccagggaccaggggtctggggccagaatgtcatattcttcaattgcaaatcctggagagtgtgcacaatgaataagatgtgggaagtgctcccacgctagctgtttgttaccattattattattagggacggtggtgctggtggtggtggtggtgatagtagtaggattcatggcaatcccagtagttatggtggcgtgaatgtcattgagaaagacaaatcctcccgtcaactgtgccttcttcttcctagcagggagtggctgtttgtgccctgttttatcaggagggagcagataagtgctagcaaccttctctggccccctgccgtgccctgccctaccctgccccaagggacagcagatacctttaatactacgaagcttgggtgggcttggtggttttcacgagtgactcagtcagtccccagagaggccctggtacctggggttgggggtgctcaaaaggttggcttctggagcaggggcgtccccaaggcacccctggccaggagtctcctgagggccccacccttcgtcccgatggagaagccctaacatctgtatttttagccacctcctccagggggtgcctgatgcagccagcccgaaactgccaacagcagcacacagactggctttcttcaaaaacaaaccactcccccaacacacacccacacactcgagtctagttattgaacatttggcatgaaaaatggttgaaagaagattttatataactcaaataacccactaaattatttgaaacttggaatatggatttctgctgtactcatcctcattctttgaagagggattctccaccctccaacattaccaggcatttctaggaaggcagaggaaatttcctgggtgtctgataaaattggagctagttccgtattcagatgcacttgacatttcactcttgaccgggcagcagtgtgtattgagatgaggctgggcagtgtcagagcatacctgctagaaaagaaattggttttgcagattatattttagtaaaatctgaactgctcagtgaagcacactattactatctatgtacacaagtcaaagatggatgccacagagtcgatgtttttaacattggcccgtgtgagcaagaacatggatcagcaaaaggtgcatttacttcccactgcaggcaaatatgcttaaccttcaggagcgcccccgaggccctcacttgtgcctctagcctgtttcatcatgatgcaagcggatttgggagtgatacctgctgttttagaactgagagtgaactcgttttgtggcaaatcctttttatcttgatcggggaatttattaattagtaggcttcagcgaggctggtaacctagcttgtttctgtttgcagaagtactttgttatacattggcttattttatttttagtaacaaccctgttgtgaggcagtgcgattatttcccacttgaggaattggcaagccgcataggctgggctcacagttaattaatgatcgagcgagatccgaactggttctcctccaccaataccaggccgtccagagaatggttgtgtattcacatgaccccattctagggatgagcgggtgggtgcaaattcgaaggccagaagggaagcaggagaatccagtttcaagagtctggagcctttggtgggagtcccccgggttgaaaggtgaacttgaaagagcatccacgggtgtccttagatgaagaaggatttaagggactctgtttgccccttgatatgaggtttgtaactggggtcttgagcagaaaggaattgctcttcttggtttgagtgactgctttctggggagcgtctgggtgctttttgagttgcatgcagagccatttatggtgagagaaattatgacctgactaattggcccagggctaggtgttttggggctctgcactgaggcctctgtgcaaggagcttgtctgcttgaatatggaaagtgatagtctttggggccctggcagtttcttttggggccgcttttggacttgagttagcaaagaaatgactttatgatttatggtgtttatgaagaatacctatctgttttcacatagacatcttaatagagattaaatacaaaataaagtggaatgcatgaacggagatattcccataagcaatattgtagttttaggcagtgtaattatgttttgtacacttcccgattaagcagttatgcattactggggaaactaccttttagagatttagaaaagctttagaatttagtaaatcaaataaaaataggtatacaatattttagacatagggtttcaacatgttacatggtgtgataatgcagtgccattgaggtgaattttttctttttttgaaatggaggctcactctgtagcccaggctggagtgcagtggcgagttctccgctcactgcaacctctgcctcccgggttcaagcagttctcctttctcagcctcctgagtaggtgggattacagcactcccagctaatttttgtattttttagtagagacaggttttcaccatgttggtcaggctggtcttgaactcctgacctcaggtggtcggcctgcctcagcctcccaaagtgctgggattacaggtgtgagccaacacacccggccggctgaggcgaatttgcttcttctgaacattgcctgtggaatgaaggtgcacccctactgtgtgcgggatgtcgtgggggggctgccgggctacagggaagaagagcaaggagggtttatctggagttcagcaaaacagtggtggatttccgcgagctggggtgggcagaggtggccacattaggtttggagttaggctgaagggggtgtgctgagggtaaatgtgggagagggaacccaaggtaggagcctttcaagctcgcgtgtcctttcagctcccatgtcctggccactaaaccacgggaggtaacgaaatgattttccctgagtaaaccatctgaagcggagctgcatctcaggcagcctctgcgagcatgtgcttcacagaatccttcctcctggtgtcttctgggtgttgctgatttcaaggaagcctggtggggtgtgtgctggctcagccacccctcagttgcaaagctcttgggggccgcagaggatttcacagttcactgcataaagcaagtcatttaattttatcatttgctttttgagaaggatcaagttttcaaaatcctatgtagaaataacttatatacagtaaaacaccctttagcatgcagttctgcaagtcttgacgatctaggcgtcgccaccgggtggttgcggaaccatcccatcaccgaggaaagttctctgtgctcctatggagttcctgcctccccgccctgactcccagcctccagccaccactaaggaaatcactcctttttgatagtagaagggccagcctaggaagtgcgaggagtttggtagatgctggtgtgagaggccagtaatttccaggacatttgtaatatccaaggattatgcatgagccccaggggtgctctggtcacagcagatggacttggcttggatgacacccctcctctccccagtgccatcctagggatgcctgagactccaggagcttggctcgtctggacaggtcggaccaaaagccagtcactgcagtcttgagtcgtgtctgaaaccagcagataaccacctcctccgcaaagtaggcaaaccgcccccgtcccctgcaaacccaagagtgggcagttctgggccacacctgcaggccctggtgcatctaaggccatgctccctgggctccccagggacactcacaacagctgcctctccacactgtgtcccaccagcccctcttggaaagtgcctgggaacaggtgcctcttcgtccgccatagccgctggctccaggtccagagggactgtgagtgactgccaggccagggccgctttctcctttctctgtgggggaagtggctttggagggagccgggcagtgtgctaaccgtgtgcatgtcgtgtgtttgccgcgtgctcactgtgtacttgctgtgtgcttgctgtgtatttactgtgtgcttgccatgtgcttactgtgtgctcgctgtgtacctgctgtgcatttgccatgtacttgctgagtgtttaccgtgtgcttactgtgtgctcgctgtgtacctgctgtgtatttgccatgtacttgccgtgtgtttactgtgtgcttgccatgtgcttactgtgtgctgtctccctgcttcctgttccgtgctcctgtgacttctgggtggtctggggtggttgagcgccctcaggtccccatttgttttcctgaaggtagagaccagtcaggatggccacctttttgtggtcaagaagggtggtttgtggaaagcccagaggaatgagagcttctgaggtggggaaggtcagctgccccgaggctggtgccggccccgagggtagatggccatgcttgcagtcctgggctccactttcaaccctgccagctccttatgcgtcaaataggacgctagtcactagttcctctcacaggaggaggtaatgagaaggcgctggagacttgtgcccaggtgcccagcagaggagatgcttggcaggaagtccctattgcactctgggatataagctgcaactgactcattgcctcatggtttttgtttttatttttatttattctttttttttttttgacagagtctcactctgttacccaggctggagtgcagtggtgtgatctcagctcactgcagcctctcctctgcctcccaggttcaagcgattctcctgtctcagcctcccgagtagccgggattacagccagtctgtcaggcctggctaatttttgtatttttagtagagatggggtttcaccatgttggccaggctggtctcaaactcctgacctcaagtgatctgcctgtctcggcctcccaaagtgctgggtatgcaggtgtgagccaccatgcccagccacgtcatggtttttaatattctttttattgtttttttgacacagggtcacactgtcacccatgctgcagtgcagtggtgtgatcttggctcactgcaacctccaccttctgggttcaagtgattttcctgcctcagcctcctgagtagctgagatgataggcacccaccaccatgtccagctaatttttatattttttgtagaaatgggcttttgccatgttagccaggctggtctcgaactcctgacctcaggtgatccacccaccttggcctcccaaagtgctgagattacaggcgtgagccactgcacccggcccttgatattattttctttcagttgggagaaacttgaaatgagtcttggaatttataaaattgttaagtggggatcactgcatttgctaattttctggtcgttgcccgaaatgtcctttcggagctcattctttgtccccttccctcatcacatcagtcaggctgagggcaggtttaagcggcagtcatcgtgattggccagccctgactggcattcccgtgatctcggtgcatcttgtatgcgtgcatttgcagtatgagaaaaccctttgatgcctttgagctcagactaaatgtgaccttgattcctggcctgaaattaatgtctaagcattcttggcttcttctgggtggtcgtctgtgaacaaactgccatgcagcgagtgtgatggaaacataccctccaaagacatacatagcttagcagatttcagcggggcttcccagtgtagtgtgaggacacttgggtacatggggttagtagctgaaaggtgggtggacaccccatcgtgtctttattaagggttcagggacagttcagcaagggttggggaaggggtgtgctagacgctgagtggaagttgcgaatgtgtgtggccaccggtctgctttcggatggtgagagcaaagttctttactgtctggaaaggtgatctggggaccttttcacaggtcaccagccacctgtgctctgtgatgtgcagctgtgagcacagtagggtcgcagttctaggcagccacaaggcctcatggtgtcctggatacaggatgctttcccagaacccttctggggctccacatctatctccacactttgggtggggaagttgcttcccttgggtggatccaaaaattccagctgacttggagggaagtgagttgagagcccctccagcggtgcttgctcaggtgagtagcttttgctattacatgcccaggcccagctggcctagactggaagctcccagagtccaaaaaacaggggctaatgaacagtcgagaaaaaaacaaggcagacagtcttttaggggtgtgcagtattaaatcactttgaaaggggaccacttaagaaaatcctctgccctcattcaagaatattagaaatacattaatttggtggaataattataatagtagctaccatcttttttttttttttttttttttgagacagtctagctctgtcacccaggctgtacagtgattgtacagtggtgcaatctcggctcactggaacctctgcctcctggtttgaagcaattcatgcctcaacctcccatgtagctgggattacgggtgtgcgccaccacacccggctaaattttgtattttagtagagacagggcttcaccatgttggccaggctgctctcgaactcctggcctcaagtaatctccccacctcagcttcccaaagtgctgggattacaggcgtgagccacctcgcctggctaatagtatctactgtctgttgagtgccaggaatgtgccaagcagggaagatggagatgtatttggtagatgcataatagtaatggctaatgcaccactcacaggctagagacaaagtagactcagagaagctcagtgactttcccaggaacacacagctctttggcagctgctgtatggaaaccacagtgggactcatcagaagccggttcctttgcacagttagccgagtgaagagacggacgggcacaggtatgtttggagttcttaagttcgtcatcttgcacccaagaatcaaggtcgcagggtgaaactctgtagttctggagcctgaaaggcatttgacatcctggctggaaacatacatttttgttttacatttattcgggtagtggtttgctggtctgtttttttttttttttttaaccatttggcttggagaaattttccctttggttatggtaattaccctttcctgatatgtaaattgattacagcggctctttccaatcttacacatttgattatccacgagcctccttctctgcctcttagttaatcttatttttagcacagtccttgaaacctcagcgtgagactgtccatcttccgctgtttctgaactgccgaaggtcattttcaccagccccaccaaacgcggatgtgtttcaagtcaaacacagccatttgaaccagtttcaaacagttgcctttcaagtgtcagcgtggtggggacaggacctgccgcatgaggtccgtgttgcttgggatagtctcgaatcacccagcgtgactccgttggctcccttggttcagtcggctccaggatgagtgcacttgaccagaagctccggcgacactgagattataagggagccaggtgagcggaggctgcgttgtggacaccagccaagtctgggtgggaggaggcaccgggacctatcagcaacctgccctggactttgtttcctcatgtgtgtgtctagggctttgcggatgatttgctccagatggaattaatgctgcagttgttagaagagcatctctggctccgcttctgaagctaatcaccacctctgtttttgtaagttagtgagaggagcgtggctggctatgagggtgcagaggtgcccctcccgcggtcccctggggtcttctctgcatctgagtcttctcagaggccacgtgagtgagtagccccagtggactccggatgttttgtgagccttacctcgataagaataaaaacgttttggtgtgtgatttgatttgtttgctagaagattagtacaaaagcaggaaggaaaaagaacgtggtggaggtgattgctagaggctggcagaaggttatttacggatttttgctgacagtccttgttgaaaggaattccctgtgagatttatgaagcctttccaatttattgtctttccaagtaaggtaagcaaataaataagttattctattttattataaacacagccaatgtaaaattaaaaataagaggaaatggggctccattttttcagcctagtgtgtttcaggaaagcatcttggagaggctttttgttttgtttttggctccagcacattgtgcatttaaaagataaagtcggtgccttgatgttgtatgtgcaggtcaccatccttggagggaactggttgcagccttggtggggttgacaagatggtgaggacagaggagctgggatattcaggaccagcccaccagagtcaccagggactcccaggccccttgggaaataaggctgaggggttcccgagactctgctctgggtttggccacagccgctgcccccagaagggactcttgactcctgaggcccacgtcctagcaaactggtgacatcttcctgcatccttcttcctgttgtcttgatttctttgtctcttctccttaaactcagaaattgttggtgctttcagtatcttggcgaattgtgattttgttgatacagatgtgtaaggacccacatgggaaatttagatttttaggtaaagaacaagcaggaatatgagaccttgtcgtaaacaaacttctcgttttcggcggtgatgtcagtgctgaagatttgggtgggtcaggtttggtgacctgtgtcccaccaaaggcagctcctgctcctgacacgagcccggagcccatttgaaatcgctcccggctctttcaaggccctgggcaacgccatcagggaaacatcctgttaccattttgggagaatgttttacgtctctgcccctagatgtccctgtgctagtgaagctgttttggggggactaataggcagcgtttggacggtgtcttgtaactgtcaactgatgacttcaagttcgttggcccctgctgtgtagtaggtgcatgttgaagatagagtgagtcacattctctgcaagggtttgttttaggagcaaaagaggcctaagtagggaggcttggaaggtgctgagggcataattcctgcaagaatgggctccatggggttcattttctttctttcccacatcctccacagtaccttgtcccactcctataggcacacaaaagaggagggcctttcttcaactcaaggctaatgagctgggcaccaggggttagggtgggggaacagtgtggccgatgcttttctggagtggtggcctgaacaagcctgacctgctcctgcctgcaaggagctgaccacccaaccagagaacactgggcaggcgatcaagctgggtgagccagacagggggatgtgtctggggcctggggagccccacccatgcaccctgaggtcagggctggcctttcacaggaggtaggctgtgagctgtgagggtgaggggccagcctgggcctccctcccagctcaccctcccctaggaggccgccccctgcctgggtccctccagccccttcgttctcatccttatctggatctgagaatcacctggagagctttgaaaaaagatcccagcttaatcctacccccaggttctgagtgtgtggtccacagtggcatctgccttggtaataaaaagttcccaggtgactctaatgaacaaccaggtagggaaccactgcccagccagcactcctcagctgaggccacttgtcctgttctgctcgtgggccggaagggatgggctggagaatcaggtaagtcctaacttcgctgccccacagactgggagcagggtcagagggcagaaggctgccctgggaggccgacttcttaaatgcacacctgactgacaggtacgctcctgctgtggggccaggcaggagagcagcacaggggcacccagggccacacaccgagaagtgtcccgagtggtgagcccagtgtggcctggcttcccatcggcaggtgagggtcatctttcagggctgtttcacttcctcaaaagaatgcagtggaatgagctccatagggtgaggtgcctgtgtgcgtggggatggagaggagggctagctgctgggatgccagaaatgaagggaggctgggatcttcctgccttggtccatgtgtagctggaaggagaaagcagccgttgcctaggagacaaagctggagggcttgactcagactatggacctcttgaggcttcctgcctgggtgggggatcagcccaggaaccccacgaggcgatgggggatgggatggggacggtcatatatgcatttctatagaaaaagaatctggctttccagtgtctcaagggattccgggaccttacatttttttcggagccctcagatgggaatccttggcctacaaaggtgggaggctgtcttgtggacagtagggagagagggtggtggagcgggtgctgcagggaacaaaggacacctggaggcattcctgggcattggcttccttcctggtggttgggcttttgtagaaggcagagtcagggagagactggggacttggtttcctcccagggtgcaggaggaagtaaacctaacagtgatacctggatcaagaaggggctcccctctagcccagcgcagcgagtgggggcgcaccaaggcatccatgcacaatgtagccttgccgctgcctatgacgggaaggtttgaggttgtgaacgtcggctaaggtccccgggggttggctgttgggatgaacgtgggttctagtattaacgtgggttttagtattattgagggttgagtataccgggggcagggggcagggggcaggaggcaggaggagctaagcagcagggtaggtggagtggggagggctatgcctgactccctctccaggctgggagggaaaggctgggggaagatgggaggaggcctggccacacgcatctgtactgttggctcctttccccaaggacccgcagaggtggcccagggtgctgggcgcttcaccctccctcattggtcaggttctcttcgtcctcccgcgccgcgtgtctggggctgctgtggtgcgggggcagaaaaggaggggcctgccagcctggttctccagcctttgtgggcttcgattggtcctgcctggcagagtgctctttgctcagaggagtcaccagcagttgctgggagcggtaggattatggtccctacctggggttcagaacaagaactttgctgtgaactcccctggttgaagcagagggccaggaagcagagggacctgaattccccaccaggcggtccctacagagtcatggaccttcctttctccccgcttcctcctgccctgttgtctctgctgagcaaggcacggggcgggggggcttccgctgggtggacttgagttggcctagatttgaatctgctcttactgccgtggactctggcatgagactctaagcctcagtctctccacctctgagttgggaatgataacagaattacttgatgttggtcatgttggctgttggtgatgggcttgttaaatctggtcgttggggctgctcaatatttgcattttcagaacagcatgcagcgagtaactagcgctccaggacaggacttcggaatgtttccatttgttccttctgatcgtgtccttttcaaatctgatctgtagtttgtttcttgcctgatatcctacctgctaagttttacatgcctttatgtgcgtttctttttggacacattttatcacccatgcagaaagaagctgctccagtcttccagccgtggttaggaagtgcctgccattcagaagtcagttgtagttttccacatggtcggctgaataggaatgaggcacttccctgtccctaaagagctcacagtgtggaggagagatggtatacttctgctttaggctttgagactctttgtaaatacaactttgattaaatttgttcatggtggcttattatttccaaggcaaaaacagtcatttcaaaagactagactagcctctttaaagtgatttagagtttatagttgtgttcaaatgcgttctaattacaccctccaaacaacaagcctctgttttcagatggagaaaacaaaggattcagattgaaggactgctcagacaccctccgaagaggtggccctgcctgcgctcctcctggctgcagagtaccccaccagcgcgtgagcctgtttccctatcccctggttttgagtttctggcctgatcgttgcatgcttggcttcactgctactttgtgaaactctttgctgagattttaacctgggctctactttcagggcacgatgggattgagacacatcttgggggatgggtaggcaggtgagcaggtctgaggaggaggctgggtctgccttgacctgtcctctcccatctctacatacttaccagtaatcagtgcttgatgctgaaggtcatactgagatggaggctatgggcaagagtttgaatctgtgtggtcttctgtgggtgctcactgacctgctgtatgtggatttccatgcaccagacacatgctcttagaatgtgcctggcagcttgagcaggattgagggatctagagctttcttctggctgcttcccccacaatcaaggagatttagcaagcaggtgcagggccaagttcagggatgtgggccacaggcaggccctttaaatccagtcatccattttgattcttctctccttgtggtatctgtcacttgtcaaaaaagacttcatcttctggggctgtcattctaagcgtcattttgccatactgttaaaattttctgagtgtttgcttgatttgtgtttattgaaactaaattcattaggatgatgtgaaaatagcactctgctgtttaccaaatcggattcttgttgttgatatttcagtacatcatctgttctcacttgaatgtcgtggaatttgttggtaaagtgctgtgcagatgaaaacccatattttagtggagttttttttattcaaataagtttataagtattatatacccaaggtgcttgatttgccatttgatgcagtctgtacggatgtgcgaatactggtgcttggcttgggctttgagagtttgggggtgtgctgggagacagctgcagggattaggactctaccaggtgctgagtcagaggctggttggaaatcctcctcctccaactccgcccctcgccagctgtttgactgctgccaagtcccccaactgtgggaaccccaggccttcatctgtgaaatggccattcctgtgtttctgacaaggctgttggaagacttcattgaagacactgtattggtttttcagcactttaacatctctggactcaagttgtgtcataaaattgatcacaagccatagtttaattgacggcatttttttttttctcccttagtggtttataaaatgatgctggtctaaggtttgatgatgtcttagacttgaagaacatgaacctgtttttgcaaaagttttagagtttggcattttccaacaaaaaggcagttgctggacttttgaattggtcaacgaaattccacttgttaccagaagatttactagttgcatttctagagttgttggcctctcttttctgatttgattcagtggtcagatcatccagggttcttgtgttcagagacccagagtgctataatgcttccgaaataagcctgacctaagactgagacagaaggtgagtatggcagagaccaccagctgtccaccaaagggccctgcttcccttccaccacctcaagtatctgtcggaggctccatgatagttcccacatggaatgtgggtggcaatgtgtgtcgcttcccggcagcactaattaagaaacaagtgtgccttgctcagtttttctcctgttgactgtcagctggatgtggaaaatccagcagagaatgcctaggtgctaggggaggattctgagtgcctgaatcactctgtggagcagagttgcccattaggaacatgagcctgatgttcttgtgatttagaaatcaaattctaatgtgttgagctgatacacaattttaggcttgtttgttaaagcagacaatgtgaacgtaagtagtacagtgagttgggtagttccaacccgccgctgccccctccctgtcctacacttgcttgggttagatagaaagcagcgccgtctcccattcaccagcctaaatgaacctcatggcttcacttcactcattcttgctcatttattcactgagtcctgtagattctgcccctcccttctgcccttgtttgggggcctcacacctacccaaatggcatccacctaaacactttgggttcggctaggtgcccttaaagcctgattttcaaacgttggagaagtttagaagcaagtcgggctgtaaaattgcagcaatgacctggcatggtgtggcagccatgaagacgctcctgatcttctgcttctgggaatgtgagtgactggtggccccagctgctacgttctgaatcccgcagtggaaatccagcatggcgttcccagacagcctgcactctgcgggctgctcccagccggggacagcaggtgaagactcctcctccccagcctcctgccttccctgccatctcatctgcatctgctgtcagacttgcgtctccctctgcctccccgcctgtctgcctccccaagaagtctcttccagagctgatcgtgtcttggcttcggtttttggaagagccgagccaacacacatcgtatttgagatacagtgggtcggaggcgatacccagggattttctccagcttggacagcgagccctttgccctctctgggtggcagggtgcctccctctaaaatgagggggcgatgcttggcagtttctagaacctgttcagatcaaggcaacctgggagttagagttccgctagtcttgtctggcagtacagtcggtctctaaatatgcttttattgtaccttccccaccatctgggtgaagcatcagtaatgaaaatggagtggaggctgcattgaccttttccagtgtccacgcactatattttaactgggaagttgcatgtattttctatacttaatactttaaaagcttcttgggcctcttgagaggcttgtaagtgcagcccacgtgtgacttgagctgggaacgcaacttcagattgagaagtcccacttttataggacacagcatttaacagcagctgcgtccaagtcgtgtggcatttggcagcgtgtttccaagtggacctgtggtaatcactttgctcttggggaaccgtggccaagggctgccctgcctccaaagaggctcagcaagggaaggctagaagtcctgtgggctggccaggcatggtggctcacacctgtaatccctgcatttttgggtggcagaggtgcgtggatcacctgaggtcaggagttcgagaccagcctgaccaatatgatgaaaccccatctgtactaaaaatacaaaaattagctgggcatggtggtgtgcgtctgtaatcccacctacttgggagactgaggcaggagaatcacttgaacctgggaggcagaggttgcagtgagccgagatcatgctattacactccagcctgggcaacaagagtgaaactctgtctcaaaagaagaaaaaaaaaaaaaaagagagaaatcctgtgggctatacctgggggttctttgccctgcttccaagccctgtacagccagcatgttgcacatgtcattgtcctggggttttcttcccagagggcccttttcggtgcagggtcctctgtttcatcagcctgcgttagcacaaacaaccctgaccgtgtcctggacctccttgagctcacgggcagaggttgctgctctgtcgtgtgctgtttgcagacttggacttggagtagttattctccctgtgcctccagggccttggtcctcacaggtgtttctgtgctcctccttccagagacaggcctcctgtgaatcgctctgaataaaatgttcccagctgaggttttggagtctcctttggaaggttgtcttggtattgttttcagtctcttgttaggaaaaccggacaggtgggtctgatcatctacaatgaatgtgcacaccacccccgggttcggcaggacacactgtgcccccagccctggtcatcttctgtttgaccacatttcttggctgaatttcagatcttcacctggagcacgggtctcatgacctaaggtcaacctgtttgtggttctttctgttttttctttgaggtaaaacttagaggaagtgttgggagggaagtggggattggtggggaaggggcatgaggtcaaatgaaatgcatgaccttaagtgtgccatttggttagttctaacacacgcacatacctgcgtaccccccaaagccctaccaagagctacagtcactccggaaagtccccttggggccctgccaggctgtccccaccctcacctccctgatcatctcaggccaccactgttttggtttcttttccttcaacagaggtagttttgcctgttctagaatttcatgtaatactacataatacatgtatgtacattatacacagcatatacatgtatacatacaatttaatatgtatgtatattatgacacatgtacctttttgcatgaagcttttttcatgccacacacatgatgtatttgagatttttaagacattttgggccagattattctcttgttcctttttacttctgagtagtattccactgaatgactcgaccgcagtttctttacccgctcacccattaatggacacttgggctgtttccagcttttcgctattctgagcaagtagctatgaaccattctcatgcatgtctttttgtggacatatgatttcatttctcttgggtaagttcctagaaatggaattgctgggtcatggagtaggtgtatgtttagtcttacaaagtggttataacattttatgcttccactgatcatgtatggaagtcagctattttttaaaccaccctacagaacgttggctttctgcttgggtggtggagtgggatgggagggtgagtgggtagggccccctcctctcccttgacccccacctccctactagcaggatgggggcaggggtctgcaccgttggctctgctgggcgtgggctgtggagttcacatgctctggaagatgtagctgtgtcctctatattagggtggggcctgtttctcttgcttttcctggctattctgaacaattcttgttccttcattccttccccccgcctcccaatgtctctcccttcccctgcttcctcttgtccccaaaataccatgctctctgatgaagctccaggctagtaagtcaagaatgaaggtcgtggcctttggtacctggtgtgttcctggttctttctgacatctgtgcccactgttttgcattcatgactgacagaagtggacttttggagcctactgatggtcacatggtagcacatgctgtcctagtttgcttccgtgtgaggatggacacttggctaagtaggtattctagacagctgctcccagagcagcctcaccatgagctgggccaccccagaacccggcatctgggtgtgctagcctcatgggcctcaggaagctgcagccagctcttccaagtctctggggtcattacttttagaagcatgttttatagggttactagaatgttctcttaagtggattccattttatgtatttatatcctacctctttcaggaaagttctttgaggactcaaaaaataggatgccgtaataggggttgagattgggggagggccaaaattgattttaaaatgcaaatacagcaaccaaaaatttcacgacagttgctgtaacagataacttaagttgggcagctctctctgagtttagggagggatgacgtgtgtccttcagggaaacagcttgccacagggaggtgcgtatagggcatagtgatggctgtaaagtgctctaccaccaaccatgggctgccaacagatgccaggcctgggttcccacaactgcttcttgtgcttgagattgctggaaagagtcagaagtacaacatggagggatgtttagaggaggccattccatgtgggtccttctagggataccctttgatttaggatcaaatttacaatacctcaccaaacaccgagccaattggtacaggtctgttctcccaaaaaattattgatctcagctgggcttttgataggcgtttgagagaagatgattcacattctactttcttcccaggaactgacgtgcacggctagccccggtgacctgccagcctctcagatgtgcaggtggacagtggttgaggcaggcctgttggttccagtgacacagacatgagatcagggcaggattgggcttgtttgggttgttgatgagcactgcaaggggtgaggcagtgatgtcagtggttgcgggtgagcagagttggaggggttgatggaacatgcagttggacagaagtatctagaaggcaggtggtaaggagcctctggagtgcctttgatttgagagcatgtgcatggggctgaggcagagttgccatccctccttcgtccgtgcctacttcgtgtaacactcggctgtttcttgtttgaactccttgaggacaaagttatgtctcatttaatttccagccttccttacttaatagtacctggcttgttcacagttgatgcagtattgggatggacagagtagagtagagagagagagagagagagagagaatgtgtgtgtgtatgcacgtgtgtggtgcagcaggcaagacagatggcagctgagaatgggctataggctttgaccatcagaagtgcacgcagctcttttggatgtgtgtgtatgtggaagatgtgaatgtggtgtggaaatgtggaaatagctatagatgtgtatatgtgtgtctgtatagcggggggtggtgatcagaataaaagcttgatggcaaggatcaaataaggaatgttggcgcctaggggagcagatagtagcttctctggggccgaggccgggaggtgcgagcacatctgccctaacagggaaggaacaagtacgtggcttgtcctgattgacgggcctggccctgccatgtatttcggttcatctgtggctttctgcctttgccatccccatcctcagctgtaccacacgtcagtttgtggggcctggccttgcggatggcattttctggtgcttcctatccatacgctaggaacggagttcagcacccaaggaagagaattctagcctgaacccaaagagagaagccccttaactcttgatgtcttttaagtcccagtgacttttgagtttggctttggtcgttaagtttcatgactgcctatttttaagtggaattagaacttaagttaccgagaatcacagcgtcttgctaggtagcattcctctcgaccctgccaggtgagcttctgagaggctaagtgacttgcctgaggtcacatagttggacaaggcaggaaagcaccagcagctgaactggcccattgcgaagtgtgtccagcgggcctctcccaggccaccgctgcactgcggtctagtggtacaggccagagccctgggctcctccttgccttcccgcaacctcagtccactcctgcttcttaggtggacggcactggctttggcttgagactgggttaggcatgtcatctatttggtttctcgaatgctcagccctgacacttcttccgatgttcttagcatcacccttgaacaaacgttggttggggatccggggaccgacttgtttacacttcttctgatttgagtgaaataccaagaggctggcagagggacagcccctgagctatggctccctttcttagcccagatctcaagagctttctgctgtttttgctgtcatctctgctggatgtcgtctctgctaccgaggtacagcagttaggaaacattcgcgtccccatcactctggtcactctgctgactggtttttggacactgagtgtcccattcactctatcactgttgactggttttgggacagtgagtatgtgacatgcatatgacccatgcttaactcactcggagccattatctgagcactatttgtcaggtgctaagaaggcaagcttcaattgacttaagttccagcggggatgtttgctttttatgaaaatgatgcttagtacctccttactaagacaatggcagaatagaccagactgttgtcttcagagattcccaaacaccggatattgacaaggtttgctttcctaaagttgagaagagggctgaaatataaggcttatatctgtctctctgagcattttagaagaaagatatatctaagctctgtgtttaaatatagcatggtgtttgctactcggatggcaaataagcaattgaatatgtaggtcattgacttatgagaatgagtttggaggtttttttgcatgtgattaacgctgtcttacgattgggctgttgatgctccgccaacattgggttacacagagttcagcaagccatctgggaagaaaactggaagaatcatgagaggatacctctgtccccttaaggtgttaggagtgtgacttggtgttgagccctgtggctacagccagtggcagtggcaccaaccgctcccaagttacactggggagaaacacatctgagtgccgtgcgtctgtacatatctatcaggagggagggggcagagggcgatacttcatcgagataaatgccagcggtgtattttaatacattcttgattcagaaggcactgtttggaattgcatatttaaaaggaaactgccatccccttttgaaggtatgtgacatttaaaagatctgtagcagaagattggtttgacagctttgaattataattgaaagagtttttgttttaaaaaagaaaatgattacttctattttaaatgtcatcacaaagacataaatatgtttaatcaaattatatatttaatgtatgtagaatataatttttgtttgtgtggaagagtcactggtttgtgtgtgttttaagcagctttaaagctaagcaatgttgatgatttgaaagtgattcagcttttttggtaaatgactgtttaagggtttatagaatttcaaaaaatagtattattaaaatctgcttattttttatctatacacgtgtacctagtggcacattttgggagatggaggtacttttattgttgctgacagatagtaaattgtcgaatgaactgaaaaaacgtggaaccttgaagataataaaggcggaaacagcaaagacgctcctgcagttttcttttggattctttgaaccagcggggagttaccgggagtgctagcgtcgagtatgccagcccttcctaaaagggaggcagcaggggaggcccaggaaaagacacagagtgccacaaagacctttcgggtgatacaaaaggctggtgtggcatttgagggcaccagcaaggtccccaggctcgagaagcaggggcgtagctctgggtctcccctgaccctggctatctgctagcacactccagctctagaactttctttgagcaagctgggtgttggaagccggccagcccagcgtacaactgtgtatgtcagctggggacagtcttggcctgttccagcctgctctgtagtttcgatttagccagactgggtcagggagtcctgaagttgttacccaccagagaggcacttgcccagcacagagctgccccgggggctggttttctctgctggtctgtcctccagggctgctctgtcagggaacgtgccctctgttgggtgtggccctgggaggcctgggcagctggcagcacctgggagagaacaatgagtcagtcatgcccgctcccaggaaagaattgacgtagcacgagcatctctgccagctccagtgagagaaggtcagggttcaggaattgtgagctctggcttctcgagagacaggatgcaccccggggcccctggggagccggaggacacagatcccagttgagtgcgtaagcagtgtcaacagggccagctcctcatggcccctccttgtaagcgctgatcccctaaagaaaggaattgccctacttagtgcccagcatgagctaaaccacataaaccaaaaaatgacaaatctgttattttaaaaattaaacttattttgaagtaattgcagattcacatacagaatgaattcacagggtaggagaaggtaatacaggaggtcccttaaaccctttccctggtgccctccagttgtaacattgtgcagagttctggtaacagcaacacagcggagaaattgacgtggatagaatccatggatactattcagaaatccctagtgtaacatgcactcatttggctgtgtatttagtctgtgcaattttagcacgggtaggtctctatttgtaccagcccaagaatccccccgttgcccttttatagtcatatccacttgaggtggccaggacggtccccagctgaagcacatggtcgacacacatgggtagacacagctgaccagcttctaagacccagtttgctcaaagaaagttctggagttggcgtgtcctacctacttcctggtctctaagcctggcaaccactaatccgttcaccatctctccagtgtcatttaagaatgttatataaatggaaccttacagcattgccgcctttgaggattgggatttttcacttggcttaattccctttgagattcattcaagttgttgtatgtatggctggttggtttctgtgtattgactggaagatttttgacccagccttagaccagaacactgcggaagaggaaatccatcatggaaacccgagagtgacaggacccttgcttggtgacaagtagagctggtcatgtcgacagccccctcttacctcgtcgcgtctcagcagatgtccatggggtcgtattgggagtgacttttgtaccagttggcttggctgattttggaaagagtggaagaacccccttcaccttgtgagttttgttcatctgtgttgcatgtgtttgcacagtgtacattgactgaaacatgaagaaacagcccttgggcttttgagtctcggttttctttcttggcgctcatgctctcagaataataatacgtgtggtgcaggcccggtgcaccaggcaagtgagggctgtgctggcatggtttctttaggaggaaggcctgttgcacctatgtggctttggcatgcttcagtgaaaactgtaaaattacaagtcccaagaatctaatctcacagtgaaaatgttgagttgttcattcagaaagcacgcttgccctgcattttgaacatacatacttgtgtgtatttatatgttcatcatgtgagaacagcatttgtgaattgctaccctcatgaacatccatgctgaaaggttgtccattctttccaaactgcagaaatgcggctgagcagttacatacgtgtgtaagttagttcaggattcccagtgttagtgacttgatgcgcatgaatcaatagataatatttctatgtcctttaggggctctgcagttattttttttcctgaatcaagactaaagccagccctgctgctgattgtaggcaagtgccctttgctttttggggagccaggactggaaggtctcttggttcacaggcctgggttagggtgggccgcaggttggtctggagtttggcttttctctcccatcccagattcccctggtaagaggctgcgtcacctgcatcgaggaccatcagagttgggtggtcggaactcactttggctgaatgtgaaggggctgctgtttgggaggtttcacctccgtgatgtgtttcttgagcctgggtgacagcgtggtgtggcgcaaggtggaaaggagtttgttgctgatggtctgggggacgcaggcctttttccccatttctagatgttgttgtattcgtttggcactgtgattaattcttaaaaatagaatgagttgcttctagagggaatatattttggacccgggaattcagttctgtctttgggtgcttccttcatggctgtgtttgcagagtttcttcatatgctattttctgtgatatacatagccttgaaatggattttttaaagtacagagtctgaaaagtgagtagtttgtacatggtgggtttagctgctgctccattccacagcaaggatactcttcattttcaattgaaatctcccccaaccttgaggtttgggttcataattcagtttaaaattaaatagaacccggtttccttcaggcctcttttctttccaggactgtggattctcgaattcaccaagccgtgtgagtaaagcatttggtatatgatacagctaacacttgggtgcctctggcgtgccaggcgccacgctgagcgctgtgcattggtattgcctgtgcttcccgctgtggccccatgagggaggtacaggtgaccacacctgggctcctgggggaagaagagaaagcagagggagagaacactctcctggggtgactcacagcctcacccaagggctccttaccatttggttggtctctgagctttgcaggataaaacttggattctgtctctgctctcatggatctgcccatctaaaccagttacagaacaggcagcccatttatgtaatgccttttgcaatagataaagggttgagggtgaggtcattgtcaggggaaggcaatgtgagagagtcagggtcaaggaaccgatatctggccaccttaattttactaacttcactttcccagtcagtattgcacatgtagtccattgatcaatagtgttgacatgggcagggcaattagctgggcttgggggcccgtgcctgtacaggaggctgagcccagaagaatacttgagcccgagaggtagaggctgtagtgaactatgatcatgccactgcactccagcctgagagacagagtgagaccctttctctaaagaaatgttgttggctggtggctcacaactgtaatcccagaacattgggaggccaaggcgggcagatcacctgagttcaggagtttgagagcagcctggccaacgtggcgaaaccctgtctctgcagaaaatagaaaaattagctgggcgtggtggtgcatgcctataatcccagctactcaggaggctgaggcaagagaatcacttgaacctgggaggtgcaagttgcagtaagccgagattgcaccactgcactccaacctgggcaacagggtgagactccgtctcaaaaaagaaaaaaagaaatggtgttgatatgtaaagctggtcacgcttgtaagtaatttttcagggactgtggactttgagccatttggttctcacttcatttgtttttaaatgccacttcctgctcatcttcctgctcatcctgctggagtctaatctgtggtcaaggacttggctggagcccactgggaagtctcctttggctgagccctgacaaggctttggctgtgcctctttcccggcatcagtcggggtcctagatcctcgctggggcaagggattctcgctgtgtctctccagcccaccaattctctcccaggttgattggctattggaattgagacatctgcattgaaatccccaagagaacatccttttctgtatcgaacttgcatgagggtggagggacacttggcttttttcaaaacccacctttgtagtacagcagccacgcagggacttacatcctaaatggggccactttacaatgttggtgtggcccgaaaacctgcaaggcaaagcagcccaggcagcagctcactttctgcaccccagcttcagagccctcctgacaggagctcacagctcacatttttccatattataggaaatcatgctctttgcagaaaatagaaaaatacaggaaagtataagaaataagtaaatgatagttatgttacacattgtaaaaatcctttttaatcttagcatggagaataacactttggatctattctgtctcttatgcatatacgtatatactaaaaatgagattcactgaagaatgttttaaaatatgtgagatttgaatacatgtttcatagtttattttccatttgacctataagtatttttcctatgtctttgaagtattttgaaatacttttagtaaatacataattgttgagatggatagtgtctgacatatccctgtacagctctatcaggagaaaatttatcctactctggtttccagcatggtctggtacatcttgaccacttttctaaggattccctagggggagagtggagtggggcatggaatctcaagtttacagaaaagatgcccactccttccaccgcagtgggagtgggggtcacaccctcgctgactcctcagagcagccagcatcctgcttttggtcaggggatcttgcattaaaacctgccagctttagaggttccatctctcgctgtggtatgggtgtgtgctctgaatgtctgaagacccctctgctcaccttctggccctgtgtagggcctatagtaaatatatagtctggcccttgttagatcaggtgtccttgggataccctgtggaaaggagctcagaaaacccctcttggtcaccctatcagggagaaagcaagaccggagcctgacaccaggatgccccagctggttagtagtggccaccagttggagtgagccatctcctatgtccgctccttctggcaggttcctgaccatctcacaggggtgtgtgcacctccaccagcagccgccttgtccacttacagtgtggaaccatggaagactagagacggataccttcaagtgcttctgagttgggatgtgttttctacttgtctttcggagctgcgcgcctttgcggggacctcagggccaggcttccctctgagccaggctgattttaagcgttccccatccccccctcccaccccccagcgcctccactgcactggtctctttcaagttcaggtgatttcctggcttgtctgtaagtaggactgtcgtgccccactcaggtacaggtgtgtgggggtgcagccaggccccatgagcctcaggtccagttgctcacaccggctgcctctgcttccatggcccacgggcagctttgggtgtgggaatgcagcttgaattcacaaaatgacgtcgttgtgtgggctgcttgctcgtggatccacttttcttcccccctttcaaaacttggcccatggcagccccgatcagcagcacccgtttatcaatttgttccttgttcctttctccagttgttgccaggactcccatctggcattctcccatctcacgcccttgtttatttctccgtcctggagccacttcggatggggcacttctagaagcctagctaatgccgcaagggcttcaagttcctccttgtcacccagctcgtctcaagtccgttggccctgtcatctagaaaagctgaaagctgaaagagcaggggaatggtcacattaattgactacatctgagacaacactggaaacatatcctattttatttttctttaaaaagtggcaggattccaagacttcccttccagttttccactggttggccttctattggaagacgagttctaaaatcttggctgttgggcctttttacattcttaaaaccagctgaatatatttaatattgtaaaatttccataaacactctctgacaaagactgtgtatgtaaagtttctgcctagagggcatttttcttctcagagttgagactcttgggcatcagggggtcataatgaagtgttgatttcacctgaagtgcctctgtgccaacgtggctgtatagggacatggaaagaattagctttcggggttgttgttttttccttccctgaataaaggataattgtttccaagctaattaatatggtttatttattactaggcaatagttggtggaattgaatctcgggaaggaataatccagcaatgctaaagtgacaacctctcgggtacaccctgttcattcctgtccagtgtgtatctgacactcagccctttggtagacgttgtcattttattgtatttcttttccccatgtgccaaccaaacttggactccacactgcttcatgcccagtgagcttggcctttctcagggtgggtttgtccttaaaggctggccaggcgcgtaattaatatggtgggcttggggggtgccgtcccaggcaacgttgagctgtgctgtcatggtagcagcctgaagtccttgttagagggcatgggtcacacgtgtaccccactgtgtggtgctcggtggcagagttgagaagtgaggagaggtggcatctcccactgccgtttgctcagggatgcctgtctttacccccagcagcccccaggactgcacatgacctcttcctgcagagccagctggcggccatcccagtgccaccccccactgcccccgttacaatgcgttgtactgcgcgtcctcactgcaactgaagagagtcggggcagaggagggttgggaaggccagggagcgggatgtcgccttgtgggagagcacaggtgtggcccgtgttcacacacaggtggccagagactgcactgagggtggctgggggtgtgtgaaccaggagccactgtggtacgcaggaaaggaggcgggcagctgagtgcctgtccctggtccttcagggaacccatgggtcctctgggctgcttctcatggcctcgagtcaagggccaccatcctgcctcatgctgctgtaggcaggtcagttttggggcagagcatttggcttcttgacaagattttgcccgaggcttttccttgaccgctgcccttgaacttgaaatcgttgggaggatctgctatgggatgtgtggggaaagcccctggcaccactttccatgccatccgctcagggactgggaaacagctacatgtcttccttgtggtcctaccattgagagtcctccccttcccacatactgactgataccccgaggcagtgccgtggtgctctagggagtgtcaggctaggagagggggcttgccctggggtatctgagctgtgtctggatgcctccgaggggtgggcgtgatccccagggctgtggctttagctcggcttctgatacagctcggcttctgtgggtcccacttttagcacccccatggtaagtcaccccttctgaagggggccagagtgttgggaggaggggcagagtgtggggagaagggtgggacatttcctgggtacccatgtgacgggcccattttgagaaggccgtcagcatgggtgccgagggagtgtctgtgaggcagagggcgttcactcgtcctaacagacaccatgcttccagaaacctcaggccagctgtggggcactgtgacctgcacactacccgtctctacgtgaggcgtgggtacaggccttggccccagagtttgcttgggaccttgtggcacagtcattcggtggtttgggcaacagtggggcgggggctgagtgctgggttcgggcctggagtcggtggcccctcctgagtccctggggcagggaccaggtttctgttttgctcctgtgcctctggggcttggcacagtcctggcactgagtaggtgctcaggaaatccctgttgaaaggatccaggagtttgaggtcatagttgatgttgcatctagtccagagaggtctctgaggaagcctggatgtttgtggtgggcaggggtgtggagtatagggggcgaagactgtagactactctgacctgctaccatgccctgtgcttggggcagaagtgcagaattctggatggttctttacgcaatccctcttttctgagcacagccataccacaggatggcagtgaggccacctttcaagggaggggaacgcttgggatgcctaaccattaaccatcaatgacctgattaggactattggattcttgtgctgaatgtcaactgtttatctcatgagttaggcagagatgagtttcttagaagaggtggataacggcctcagcctggagacatgtctggagtctgatgatgacacacagttattgagtgcttgctgtatgcaggccttgggacgaaccttccatgggttctctctttcaaagggcctgaccacctgtgaaggtagatgctgttacctccaaatcacaggcaggatactacttctcagccaccgatgctggcctgcggaacttgggattaattcttgctaactccttgttctttcccttgtcccttcccagagtccattacctgtgggaaacttttgatcgcctaagggatggttttgtggacacattccagttttctctttttagcagtaaacgtgaacggtgcttcctggagtgtgaggaacacagcgcacagtggtgctccgttcagccagacccgtggaaaccatgagtcagtttcagataaggctttccagggtgcaagggcccctttaggatcagtctttcttctcccctaatatatgcccacgctgagctgaagttctgctctctggctggtgtgacccagccgcagggccagcctcaagaggaggcagcaggaggtgccccaccttgaagcaggggtgatgaatccttcgccatccacggcgggacagtagtaggaggaggagcctagacagccaaaatgtgagttcaagcagaaagcctcaagtcctaacgagagctggcacatgtgagcttcagatggcagaaatatcactagaaatccctcctgcagagaaagcgtaggtaagcgggcacttggttagatgaatgctgctcacagcaggcggcatgggggggccaggccaggttgagctgctcgcctggcctctgttatctctgcatttgggtgggtgggtgggcaccccttccatgccatgcagagtacagaagctgttctgaaagaacgctatgagttcaagtgaaggcaggcccagtcctcctggaaggagccacaccagagtttctcagacgcccccatcaagacctttttagggctcattgaaggcttctaaaggttctagtctcatttagtttctaagaaaaggatttattcactacagacctaaaacgtaatttttgtatgcctgacttagtataagaacaaaacacccaagcagtggcggtggggtagggggtcctgtctaggtactgcagcctcagttgtgagtttcctatatgtggaaggtgcaggaactagctgaccacagtctggttgggactcccacccccaaatccatctctgggtgctgcggttctcttctgggatgtgtgagagtacacacccccctgtcatcagctgtaggcagatcacatttgccgcgggatgtttaataagttcacgcaggttgatggtacaggccagaaataggacccctgtctggcccgaagcagccacgtgaacttggagggggtgggcatgctgaccggcagttacacgctgaggccacttcagctcctgcggttgctggttcagaagtagtggtgattttaatcagctaagtcatttctgcgtctcgttgtatactcctggaagttcttagagaaatcctgccaagaaaatatcccctggtgaatcctcggggcactagtccacgccgcactgtcagcaagtatctgctgaaacaagtatttttgaatctttagcttttctgtagctccagtctttttaaagtacttcttttgaccttcaagtaacaacgagcacttgctttaaaattctgacagtcttccaagccttttaacattcttattccactaaataagctgtcgccgttcactgggacaggcagcacagttgcttgaacgcccggcttgaaattccacgaaatgtcacctcctctgtgaagccttctacaaggcagacttgtctatttcctacttaattttactatgaaatatctcaaattagaacctgtacccaccatcaagattaggtagatgttaacatgttgctacgtttgtcttcagacattgttcaaaaacaagtaatgttatagtcattgctaaggtgcacctccccagttccttttccatccctccttcctttccaaaagggactacttcctgaaaatagatacaatccctttatatttttggaaattctgtgtaaaccattggaaatggaaggagaaagcctgtgacatacgaagacaagcaacactaatcaggagtataaattctgttttgcagttaattaaatatttgattccctactatgtttcaaagataaataaaatgtgattaagtaaaaggcatttaacctttagagacttggagatgggcagggtatatagtagcctgccagctagagtagggaagatgttaaagaagataacctgtgagatgggttttgaagggtggataggagtttgccaggcaagctctgccacctcaaaaaaatagttccttggctgttagatgcttgtgtcactataggcttgggattactgaaaagctatgcttgtccctcccttcctaacacttctgaggctggaatgtctgtctcccatctacttccttaagaggtgtgggttacagtgtggtgtacagttgggagtgaattactacttgaccttgggtacatgataaccttgactgtagagtccatgcttttcctgagtagttcttcagagtccttcctgccagtgacttggttctaggtgtggagcaggagctggctgtcggaggactcattgaattcagtggaaacagcagggagcatggttttcttttgaatggaaaccatgagtgtagcagttcttctttatgacttgctacataatcatgcaggaaaatgcctgtcacgggattggatcctaggagattagccccattgctaattaaaagccccattaaaagaggggaagttcttttaggtatctacagcttcctaagatttgaatggtttacaaagcagaatgttggctgggcatggtggctcatgcctgtatcccagcactttgggaggccaaggcagacagatcagaaggtcaggagtttgataccagcctgaccaacatggtgaaacctcgtctatactaaaaatacaaaaattatccgggcatggtggcatgcgcctgtaatcccagctactagggaggctggggcaggagaatcccttggacctgggaggcggaggttgcagtgagccgagacggcgccattgcactccagcctgggtgacagagtgagactacgtctcaaaaaaaaaaaaaaaacgaaaaaggtagaatgatggctgggcgcggtggctcacgcctgtaatcccagcactttgggaggcccaggccagtggatcacttgaggtcagaagttcaagaccagcctgaccaacgtggtgaaaccccatctctactaaaaatacaaaaattagccaggtgtggtggcaggcgcctgtagtcccagctattcaggaggccgaggcaggagaattgcctgaactcaggaggcggagcttgcagtgagccgagatcgcgccattgcactccagcctgggtgacagagtgagactctttctcccaaaaaaaaaaaaaaaaaaaaagtcaaatgcagctgggaatgtggttcgtgcctttttgtatattaaccatttgaaacttggttgtaaggtggggttggcaatgtcaggcctggctgcagcagctcatgtctttagagtgtgcctcttccctctctcgtggggctcgagcaagactaccttcatacatgggctctccagttacatagcaactccagtgttaaattccatcttttcttcctggaaaagccgtagaaaggacacctggacatgcctgctgcacaggttgtctgccttccccatcagccgcagaaggaggaactttgctctcttctctcacagctgtgtgtgcataggaagtagttcggatgatgtgggtcccaccatgtattccttctctgttccatgtagagtaaaataaatgggagttctgtttaatgcatcacctcggttcatattgcatttgccaagaaagtgcaattttattgaacattaggattgaattcttaactgagtaatcaatttcagtagtaagttaaaatgccttctattaatggacaactgcaaccgttaatcagagttacagtagattaacagttgtcagcatttatgctaatagcacttataaaccgtgggctcatgatttgcactttataattccatatttctcaaaacagttggtaatactttttgcttgaaggtattgattcttttgtccctttgcttgctacttggagatgtagagaaagctaaatgacattttcacggtgatgacacaatatcaccttctgcttttgcacacttggctttgtgtcaaaatagatggaaagggttcatttgttctggtgctctactgtttaatttgatctggtgtgtgactaaagcaagacaaatagtatttttaatgaaaccatttaataacctctggtagcttagagtcgaaggcattggaaaaatgcaattaaaggatgcctagatgtaaacaaaaaaaaaaaatctctacttcatcttcactgactccattcattttgctttcagggtttcatcaccttaaatggttttgaaccaatgaaggtgtattcccttaaaaagacggacagcccatcgtgtgaactatagagtttgtggacagatttatattggtgagttattgtgaaatatctccaggtaaaagttcagttttctagaatcccctttgcaatgtgtgttcaattagttgatgagtatggattgcctgcagcctctggctgtttcattgggatgtctaatcgtgggatcatattgattgtctttcaattaattgcatctagtattttcatttatcaaaagcaaaatacatgtaattaactctgaagcaatatagttcagtgtaaagtgatttttgctgctgctgctgctatagagataagtcaacggaaattatgctacaaggaaactcaagtcagaatggaaatagtgttaggatttctcgatgtattaattaaaaagaataaaaatgaattagagaaaccatctcatgacaccccgagtcagtcataagtgatagatggatgtctttaggaagaaggcggcttgtggatactggcacctcttcagtcagcttaggcttttagtgttaccagcctctaggatgtcttgaacataccatgatttttctggcggagtagattgggaatgtgggtgcaggctgagatgagcattcaatccctaccacactcattgatggatggagttcaatcctgtgcccgtagcagggttttgggattctaagtttcatttcggcatgtctttagccatttttcacaaaacctggatctttcttaaagtctcaaagtggcaacttctctgatggaattgattttaatcttgctttttaaaaaaaaatgttttccccgtgaggtaacaacatcattcaaaagcaagggaaaccgctagccaattgtgtcctgtctctctcacctgtcacactcctagcagagccttgaggggactagctttggttcccagagaggtttaagtttgtgaccaggccctcaggcctggcttcctgagttgctggaggcagttagagacttggagcccaggggcacacatgggtgaccacctgagggggccaagctgaatctctgcctgaacctaagcagcacagtgggttgtaggatcaggaaaggatctctgtgtgtcccttccttttctccataaagtagatctagctggggaaactgaggtagctgacccagacctagacctccaaatattgcttaccagcttggtgactgagcaagtggtctctgctggcactcggaagccttatctgtgaatcgaacaggtggattgggctggtacccaggaccctccccaccctttaagcttgaatttgatgtagaaattcagaaccctttcctgggagtgctctgacagggctttgctgggccaaaggccatagcagagcgtgaagctcgagttgagttgtgtatgagaggggcccctcagtcatctttgaacacttaaggctcttagcattgaggaggatgaggaactggaagtctgatggaatgttctttggtggaaacctgagggaggtcaggaccgccactcgcaaccttattcagttcagcctttcaggacaaacgttgcttacttttctggctctcactctcagacctgtgtgctagaatctgcccgggtttctcaggcagagacaaagtcaccttgggcctggggttggcaaagatagttccagtgttgggtgctgggtccaaagatgttttcagtgggttgggtcatggtgatgtttccagttggacaccatggaactggccatgttggacatccacgctctttcacccagacaagtaccaggccctgcctgcctgggagcatctccgctggatggaccatcattacgtttcatagatgctcatttcagtgttggaaatcattttctctaaacagaaggatgtgggaacttggtgtataaggatgaaatggactttttaaatatcaaaaatggttgaatgaggacactttcatttgactcagtctaataaccagagccactctgggatcctgtttagcagtgatctccctctcagacagatgagttaacattctccaaatgcatccagaaccagaatgaaattgtgacacgcttcctgttaacaaatgtttcctgagtgctaagcagactcaagacacttacccttatgtggggttcccaccattcctgtatttttggcatccttttgggtaagagttttttatagcactttggaagagcttaagagacttggtgtggtactggagctggccatcactggagcatggtcactgtgctgtgacaacagctcatggtgtccacggcccacgcacacactgagtgtggccccactggcccacctgctccccgcccagcccaccccagaagcaggataaaacttctcccctgaccacttgcagatgctctcatggtggaattctcacatggccccagaaggcgtgtgtttgctctcagaccctttctgctctgtggaacgtcaccatgcccagggagttgtatccagctctgcctgctgtctacatgcagcaacacaaggaggtcatgtgggattgtaaccaaagtaaggaccacgtatggatttcaaccagagcccacctgttgagatctctggtctagacacatcttttaaaatgtgggcacagaagaaggaggtagatgaaaatcacgtgacaccatcagaggtaatggtgaatccgtgaggccctagagccatttatacatcgtttttgccctcttagtattttctttagcatgtcctaattttaaaagcatcccattcctgttgtgctagacttaatattttggtttatggccgtcttttttagtaacttgacgtcaaacacttcagccttctcctgacaagaggctcgttctctcagtaatgaatagtgacgtgctaaatttagatcggatgcatgttctgcttttactatctgttctgtatgttgctatttgtcagaatgaaagctcaatgtgccagatggctttgctggcttctcctggaaaaagacttcgttctccatcacttcagttgggtcatggttttttagtactattttgttgttaagcattaatatttgcagcagtacccaattatctttttttaacaaaagtgtcacagaaaaagtgtttttggttaaatgctcataaatgagggggaatgcaaatcaaatcccttaacttttattatattacgtaaaatggtggtagaatagttgcagctgtggttttgcaaagataggactgtttccggctgccatgcatgctgtattatgtattttgacagatctccaggatgatgtagaagcttggcctgccgaccagggcctctgggaaagacagtctgaggtgacacagtgctggaaactcagtgtgcttggtggtggaagaggggtttgccttgatctgctgtgggaactaggctggatttccatctgagttgtggctgtagcaggccacctagttgaggtcatcttcctgatcattggtcctctagcctgcttctggcaggacagatatcttttttccatgaaaaacagaaggaaagtattgaattactctggaaacacatacctaaaccttggggtccgattgtcaatggttgtgaagtggtggaggtgttggcgccatggccactgtgccactctggtcccagtgtgtggcccccagagtccttcgggcccttggcctcctgagctcctggcctgcatgcatccgtggggcctttgctagggccgtgtgatcctgctccagtgtttgggccagaagcaagactgccaacatccgaaaccacaaaccagaggaagatccacagggcctttcatctctggggttctctaggtgagaaacagtcaggaggctgagatggggcagtggggaagatgccagcgaagctttagccagccttcggagtaggggaggaggggcccccgctgaagctcttggttcttgcttggattttattcctgtgccttctggatgtgagttatgcttcggaatcccagcctccctccaccccccaaggataaatgggaggcattgattcagtgtttgttcttctctcctgagcatctcagcaacctagtgtggcctcccaagtagggatggagagatcaccccgtccattccccttctttttgctttagcatctacatgggtccagggtcacacaggggtcacgccctccattctcctggtgagtctggctttctgctgttactgttgttttccgcttcctgcgccaccctggctgctggttctcatcagagtggatttgcaaagtagggaggaagagaccaggcagaaggcctgaattttcccactgtgacccatgtgtcaacactgtgtggccggcctgggtgggttcctgctgagttgctccttcgctggaggggtacctccgagcagggcatctgcaggatggtgggcacacttgcctctcactcttggcggggccaggagtctctgttgccactgagtgacgttatgctgggaaatggaggcgtggtgtccgcttctctttccgtgatcctcatacccttcccaagacccccattttgttagtgaagaacttgacgcccagatccacctgccagcatgtgtggccttaggtatatctggcattcaggagccgatgaagcaaccccaaactcaggtcgccccgcgtcccttgctggtggaagcctttccggaaacactgtggtagtgagcctggcttcccatacactgcagggtccctttacagtgaagatggcttcccgggggctttgatattcctggaagctttctcaggtttgtcatggtaccgtccccacacccagggttgtgggaggaagagcacttggtccatgtgaagtggggccgcacatggggtgcatctttccgctgagagtgtggcagtgtgcagagaatgggcctctgctacccctcatcagccaaccctggtggagacccccttgtgccctagacaggcctggccactgaactgagggatggcagccctgttgtgtgggacagccagagacacgggtcagcggctgatttctctgaggcttggagcgtgtgtttgttaaaggcaagaagagtgggaaggagtggatggagtgagcggcagggccagagcctcacttgttgaagggagtggtggtgcattgtgtttactgtcaagtttcaggctggggcgtagatgccgatgtgcaaatgagtaggcagggaagtgagctttctcttattaaaatgttggcttactaatcaagtgttgctgggtgtgattagtggcagaggaaaaggttatttctttctgtaaatatttttgcttaacatttatgcgttaccattgctgattgtattaatactcttagaatgcattagaccaataacttgtttttttttaaaaaaatgtcttggttttaagcagtttcagttggtctttatggaaggacacacagcatttcactgaagcttgagggatctgccaggttcaagtgtaaaggggcattagtttcaacttagagcagctcccccagctacaaatgctgataaaatagctcagaagtgcaagagcctggttactttcagtaattttaggatttagtatctggatctgaattttgaccattgttgaaggagcagataattggatgcattttctaaagtaatgatttaggccaaggagggcagatcctttgagcccaggagtttgagaccagcctgggcaacatagcaagaccccatctctataaaaaaatttttttaaaaaatcagccaggtggtggtgtgtatctgtggtcctcaggttccagagtagctgggtgggaggattgtgtgagcctgggaggtcaaggctgcagtaagccatgattgcaccactgcactcagccttgggtgacagagggagaccccatctccagaaaatgtttttaaaactcggccaggtggcggcgcctgcctatgcctgggtggccagattgtgtgagcctgggagctcacgtctgcagtgcactgtgatcacacccctctacttagcctgagtgacagaggcagaccctgtctcaaataaattaataaataaataaaagtaacgatttaggaaatggctgagaattcccatgaccctcgtgtcctcgggcctggtgttttcacaggggtgggggcgggagaaggggagaaagaaggacgtgctgtctgtggcttccttcttcccaggcattcatttaacaccagctgaacacatttgctttattgattggttgattcatttatttttggcaaacttggcaacttccacctggccccatgctgttaaaaataaagtcttcttggtcgactgaatgcttttgcaattcattctttccatgtagcaattaagatgattcccctagccttgtaccagttaaggataaataggaggttttcaaagaaaatgctgcgtaattcatcggcatttgtgtgtgagcacacgggtaatacatgcgagtagcctccgtgagtggactcctgtgtaaggaggtaaaatggaacgtttttctgcacttatcctgagaagcagcccgaacagtgacatttatacatatttcataatgtggtttcttcaggcacgcggagcaaacaaatcaatttctcagcagtatactgtttaaaagaaacagcaacaacctgtggggaagttgcagaagctgttaaaattaattatatatggcaaaaagatagaacattagggggaaatgttaatgtgggaggatgaaaaaacacagccgtggatgagcagcagtgcagagcatctgatgacagtgtttaatttccgtttctttataaatgtatactgatgaacaacaatggcgcccgcacagggtcctcctgttccgtcctttctccaggccgctgggatcgaatgtccccgtgagcatccagtcagctccacgtggtgtgagccttgatttctgggaacggtaccgtgctgtcttttaatagggatttgtggaaaacgagaattggtggtgaaggtatcgaattcctgagccttgtaatgcaacacctttcccgtggtcaccttccctcttccggttcagctatacgttgtttaactcaaaggaaacctttgttgtcgtgggtagggtgtaacctgcaactccttgaaaaattcagcttgggtgatcagtttcctcagggatgtagggggagaggctcttcagcaggggtgggagggtgcttacaggagggtcccagagctgtgggacaggcttgccccctttcctgggggaagctcgcctctttcccggacactgcaggtttgtaggatataccccttggttcagctggtcatggcaagtgagtcctccctatcacccacttccgcggtggtgggacgcctggggggcatggatggggcctgcgtcctaggagaccttggctccagctgctcgaggccactttgtctcttctgcatgtcgcagaagcgtctgtacctcctggggttggctttcctgtgagcatttgggctccctctgcctgggtggcctgttgtctggagggagtcttcagtccctcttagtgcagcagccaagggtgtctcttctcactccctgagccttctgattcctgtatcaggggaagttaaaaagtgttgtaaatggacttggaccaaggagcaggactctgactacgaacttagaaccttccagagtgatttccgcagctccctgaagcagagctagctccttgagctcattgtccccttaattctgtgcatggcctgcatattgtagatgccccagaagtaattttttgaatgaatgaatccaggctgcagtggggccaggggggtgtggagtgggctgggcacatgtaggagcgcatcgcagcagctgtctggaaggctgggttggttctgtgttagctgggagtgttttctgcagacagaaggcaacccagcatgttatactacctgttcaggggaggtgtgcatgttctgagataatcacgccgtgttcttgagctttccaccgcagggaagtgaagtcatgcccccgcctctcctttgtgcaagtagggcggggagtctaaacccatgcaggtagggtgtggggacccagctgtactctcccgccacctgtgggtgctgctcttgcggcagcctcgtaggtgagggataatgtggttcagccaacctgactacatccaagctgggatgatgaggacagcaagaaggcccactggctctgcaagtcctgtaggcctgggtccctcgagacaaagctcagatggcttctgtatcaaattcaaggacccagcatggtggctgctgctttgctcaccttcagaggcctggaagctggtgtttcctgcatgtgtaactgacggccccagtcccacatttgttaaaaaaaaccttcactttgatgagagtacagtactcctggctttttgtaattcaattgaaactcactgccactccctcattacagcagaagatgacctctaaaccatgacacagggcgacagcttcctctgggaaggaggactcaacattgatttgtgctctgatccccacccccctgcaaaccctgggcttaagtggcagcactgcagaggcctgctgaaggccggaaagccctctctgcctgtgtgtttaaacagagcagattgatgcagagtttgatgtggccaggaagaattctttagcatggaattgcatcataacagtcactccctccaggagccccagcggctctggcacttcctcctgatgtttgcaaggggaaggtaatgattctaattgcacaggacttggtcctggccttggtgatggcaggagggcagagtcctcatggtatggccaaaaaatgtttacaacttgaccttgtcctcctctgatggtgttgaccttggacaaactatgcccctctgagcctagtgcctcagtttccccctcttgcaaatgcagcaggtagtagtgcttaatctcagagttgtggggattcaatgaaacagtactgaacggggcttaacagatacctggtacatgttaagagcttagtcaagaatgactgctgagtctggaatgacattatggggactgacgagggaggctgatgagaggtggcttggtgggtacaatgtgcattgtttcagcgatcgaggcactgaaggccctgacttcaccacaatgcaatgtatggatgtagaaaattgcacttgtaccccatgaatatatgtacacacacaaagatgattgctgcagtagcagcagtaaatgcacacagccaaaggcttagcatgtgggagatgccctgctcgcctggctgggctggaggggaaggtagtacaggttgcatctctccaagccggtacctgtggtctatgttgcaatgaacatttcgatgcaagacgaacggaactcaaacctttcttggtcgtgaaggtctgctgtgttcctgaaggttctgtcttccacctggcacttgggatgtgggttgctcactccttgcccatcgacctggtaataatgttttcctatcaagcagtgaaaggtttggggtttccatgaagcctttcccaaatgtcacgcattggggttttagttgtgagggtgtgctgatcccagccgcagccaaggcgaggtgctggcaccatgctgctgcacccgctcctatgcccacctggacatctgtttcgtaatggacatccttccctgggaacatgtctctactcctttaaatggcttgaggtctctgcaatttgcctgaacattaagtgtgaccaaagagcctgaggccagccatggagaggacgaagacatgaggctttctctcgagagccacactgggagaggccgggaacacggccacttcacatgaaaggcggttagattcaggtcactgggtctggactcctgcattttatggcaaagtctaaaaatgccgatttgtaacaaccaatgttaatgaattcagactgtttgaatttcacactgaataatggctggaattatcagagcccacagcttataagatccctggatcgtgtaatcttttctcaagatttaattgatagaatgatgtaatatcacattacttttattaaaagttctggccataaaagagaaacacctattaggatagaagaatttagtaaaaatagtagtaataacaagacagtttggaatatgtcatatattcagtaaatttcaaaagtcttcatctcatttaaaatacagtattgtgcccatagatcctgaatgcaatacctttgtaccctagggcttcctctttcctacactaaaaacattctatttaaatgcagattttgatttgcaatctaggaagaggattctggaagaatgggaagaaggacaactctgcatctattaattttagttttatgttattcgcgtttttcctctcatccttatctcctccagcccttccttcctgtaaaaggatcctttctaaacatacaaataaagacatgcttagaatttcagcacataagaatgttgttacgccttcttttatttttgtttaaaaattaaattaaaaaattttttttccaaaaatgtttgttcctttgatttgtgtacgtgtgtgcacgtgtatttgcccctgggttgtagccttgtcttgcttttccacacatgctcccagtatcttacctaggaaatgagcggaacagtggaattaccaagtgcagatggtagaacttcccttaccagagcccaagtgacttgtgtgatattgagctttggttactaaataaatggatttctggcttttgacattgtactctgagaattgggtggccaatcatcaaataccatttttttcactgttgtctgcatttaatacagcatcttctgccatacgcacttgtcaattcaaacatgagcgttacattttggtctttatgatctgtcaagggaaaatggaagtaaattctttataatatgctaattgatgtatttgggaatttttagatgtagacaacatctgtgcatgccgttaacacagttaatagctcccgttcttcaatatgagaaggttttcagagtctatgtgtgatctagatgagaccttctgtgtccgcccccccaggacttggcagtgtcaaatttaaggctgttttttctggtgccttaggactgaatctgagcctgcgcaaagtcctgttttgaggatgcttctggccacagtgtgctgggattgtgttggttctgggaagagcctggctggccagacctggtcttatctatcacccccatccctactccgtcctagcctggaccagactggctggagtgatgggtccagagaaagagaccgtggacctgaacagtccttgggacccttctgccactcttggaggtgccacctcccctggtagcttggcaccatttgggttctcctttagccatgggtttttgacaactcaagagcttattttccatacaaacttgttgatggttttctaaggcaggaagcattgctttattgagagtgaggaattgtaccctttgaaagctgccccctgaaaagggagtggagagagatggctccagttggagttcaggatgggggtatctttcagtgaacttggggggagggctgagtggtggagcttggggctcatgtcccaggccttctctggtcaggaaagcagagttgaaaagggcccttttaatctggagggcccagaatggtccagccagttgccccggaaaggaagcctcatgtggcatgcgtgccagacgctgcacagcttgagttggtcctatgtgtgtggcacagccttacaaggttgaggtatttacctttattcctataaattgatggataaggggggttaattgatttctcttggcacttggcaagaacagacgtcagatttgaacctaggtctaggtttcagttgcacacccagcatgttctgctccacagccttttcctaaaatagtttagatgttggtataaacctgtgcgtactgaacgtgcctgaccgtgtgctagtatgatggcttttctacagtgtctccctagactccatgcttgcagaccgacagcgcgtggaaaggaggctttctggcttggtaaatgctcagtcaggtgagcttgctgagtttattgtaagctttgcagttccattccccacacacccagtggtggggatggagggggcgcagggaggaggtggccccagagcagattgagccccttggtctttgctgtagccaggactccaggctaaagtagcacagggtgggcagctccgaggcctgggtgtctctctgtctctctctctgtctctctctctctctctctctctctctctgtctctctctctctctctctctctctgtctctctctctctctgtctctctctctctctctctctctctctctctctctctctctctctctctccccctcccccatttctctctctgttcacccgcagcagccccaggctgcgtcattggcactgtgaaggtgcagggcacaggtacaaataggggggtcttctggccatctttggacataaacccccatcctcggaagcatggcccgctcatccccaggtcctggccttcctaagggctgttaaacacacatcaaccaagtgatgccttacggaccacgcatataccagacgcagctgggtaccgtgtattctcttgatattactatattctcagccaccagggctagtgtatgtgggtgtcattgtcattagcagcctagggagggaatggaatttggggagtagtctgcctaagttccattccgttcactccaagagctgaacacgtgctgggtccacacacctgtggactgatggctgggaccgtctcagtgcttggcaaaaaagaaaacggggatagcaggcactttttgaacattgattactgactgctgctgctgttactggtattgttggcattttttgttcgtttggtttttgagacagagtctcgctctgtcgcccagactggagtgcagtggtgcgatctcggttcactgcgatctccgcctcctgggttcaagcagttctcctgcctcagcctccctagtagctgggactacaggcgcccgccgccacacccagctacttttagtagagatggggtttcaccatgttggccaggctgatctcaaactcctgacctcaagtgatccacctgcatgatccacctgccttggcctcccaaggtgctgtgctgggattacaggcgtgagccactgctcccagcctcgtcggccttttttgccttctgcttgtacctcaaccctttggcaaaaagtaggaactacagagggcctgtcattgagacttcaagttgccaatgcccctcacctattcatctgaactcaggcacatgtacatgctcacacgtgtgcatgctcacacgtgtgcacacatacatctgacatggacacactgatatgcacacgtgtacaaattgtgaatggtatggaccccacgtgaggcatgcacctaaggcgcgcctgtagcagcgggacagagaacaggcttccttgtaccctgtactcatcacgggggttgcgctggcttccttgggttggctttgaggagtgcggcttgtgacttctccacggtagagaactgaggccttagacaaatagtcatccattgtaactgttccctgcagtgttgatagaaatggtgttgggataattagactgtgctgctgctttctccttttctcccaggttgatgagtaggagcagtttaatttgagactagtaaattttgtaattggatttaaaagactgaaatgagcggacctggtttccatattacctttataccccagcgaggggaaatgcttgagtcaggtgtggatcagattattttattgtgccaacattaatattgggagcacacacataatctggagtcagcaggttcatccactactatctcattaaattttcaggcaaaagctgcaaaaattaattggaggcatgtaatagtttagaatgtgtgccagcttatggtaatataaattatgtgaagagaagacagttttatatactgagagagggaaaactggtttactttaatgagaagagatagaaatgtagagctattttttcattacagatacactctaaaatgtttggacttagttgatgaatagagttaattcgctgctacagttccaataattcatgttgcacagtttaatgacttctagataaaaacaggattgaaatgttaatttctcggaagaaattggggcactcttgtatatcagacatctcccccccacccccccattaaaccactagttaattccaccaaacaagtctctttgagctatttcatgccgtgtagacttttgtatttcttacctgggctggctggcttttttttaaaccttaatgtatatgataatcttaggtgacagaatgtgttagagctgtgtctaggcaacctgactcagcagagagtttcataccttttagttttgtaaatgaccacgtgctataacctgcattctcctgtccagtaactgtttcggcagggagggggtttactgggttgtggttagccatctgtttagtcgagtagcgatgttgtcccacttctgagctgggaaataggaagtattgatcagtcagctttagattcatgaggcgatagtctcaaatcatgcagagattttatcactatgttattttgcatctttgttttctttttcacttttcataacttggagacattttttccccatggggtaggttcagcaaagttcactgtcttctttctctttaacctactctcagaaaaaaagacgaaaaggaaatacgaagtatagtaatgaagtgttaactaatagtggggctacataattgagtactcggattttgttgccagagttcttagaacaagaatgcaaacatgtcttatttcaaccatgtgcgtgctgtgttttgctttttttgtgtttgacaaaggggacaaaagaataaccccctaagtattaaggagtggagggaaaggagatgagcccccactccctgcgctcccttcctggtttgcctttgggtgtacagttcatagggcttcctagaaacggctgcgttagggccgagggggtgaagacttggcaggacttcctggcagaggcaaggactcccctgcctcccacctcatgaccattgggccttagcaaggcttagtgaatcctgagtggggtcatctttagcctaaacctggagtcaccacagagcttttgtaaacagtgagaaacctactacttcctacagaaactgtgctgtctgcaaagctcagcgtctgctccagcctgaatccccaggccctgtccctgtacacacctagttttgaggtcaggacatcacaaaacatctgccaacatcgaaaagtcatcaggagccacccagacgtggggtgtattggtgggaagaaggagcatcttagtctgcttccttctgaggcccacagttccagaaggactagcgtcctcagagcatgtggtagtggctgttcttgtcttttcctggtggtggggcctggtgacccctaacaccaacggagctgttcccaggttcatttcgtccctttttctgtggtgagatgaggctcctcctgccctccttgctgggtggtctttctgttttgaccacatcccttggaagcgtggctgggctgcgtaactccagagcagcctggtggtagctggggctgccttctgagtttgggctggtggatgctgagtatttgcattcagagccttaggcattgaccttggctttctgggaccctacgcccctctgtttgcctttgtcagtagagaccttctcacatttagggattcattttttccaagatctgtttgctaggtgtgtgtcaaacttcctcccagagcagtgacatggatgggaattgtgagtgtgttgagagacctaccctaaaagatggggctgcagtcatcctcaggggacctcctgttctcagctccacctcagccacacttggctgtgggtcagcttcttctgaatcagcatccgcaggacagcgccacccagccctgccacacttgcttcctccgcgcttcttcagaggctggagcccacccccatgctcgtcgtctgttctgcttttttgatgcacttacttgtccctttcagcgtattgcttatgtcctatgttggttaaaaaaaaaaaaaaaattgccggtaatcagccccagccatttctcagcatttctagtttggaacttcagagacttcaacttacgattcctttaaggcaggagtttctactttggcactgttgacattttgggtctggtggttcttcattgtggggggctgtcctgtgcatcatacaatgttcaacagcatccctggcctctccccacccgatgccagtgttgcctccctccccaccccggcatgaccagagatgtcgccagatagggcccagtgtcccctgcttgagagcccctggtgaaggggtagaagttgattccatggcccttgtcacactgtacttgagccataccgtgcttggcacggaaaccaccctgtagccgttgtcagaggtggagcgtcctccctgaggtgcgtaacccccacatcatcgttgcttccttgggctgtgttctagcgattgcgtccgtccctttttctccttgattgcagatggaagggccctgctctgagccgtcgccacatgcctggtgcttggctccatgatgctcacatgggtgttcatgacagtgcatttgacagacagatttatttgtcaccttgtcagggtgacatgttgggatggctccaccacttgtgtgccattgacacttggctgtctgaaatcaggacaaagcatccctgagactgatccgaatgaggcttatcagcaccaggcgtaacttaccgcctgctttcctctgtttctttaacttttaattgaaaccatttagttaccacccctgctgctaggaatctggggacaattaggaaagtcccatctgtcctttgaaccacattatattgcgtttctcctcgcaatctcaagaagacggcacattctagcagcagtgtctttgccttgccgtctcgcctcccactggatggtttttatctcacttgaatgagttatagcaactctttaattcaattattttctccagtgcaggctttgagatgatttagttgaatcaaacacccgggttttccaatgcagagcagtgactcccagcgaggccgtgggagggtttttacattttcacttccagccacggttgcgcgcgttctgtgctgccccctgagcgtcctggcacaagcccctacttaccattccgaggagtagattggaaatggcagatgccgtgggctttgccagtctttccccaaggcaaggaattatctgtccagtgatattaggtcactgcattcccacccagctgtgtcgaaagaagggagggggtggggcagcctgggtgatgggcaggaaggccatttataaattcaagtgtggtaaacagtcgactctcctgctttggtatttgagtttgaattaaacaaagtgtcgtgggtgggaggtgtatcatacgatcattttaaccattgtgccttttaatgtggaaaatctgcccaaaataggacctgctgcagtggttttcacatatacaaagaagtggctagaatgttctctcagaacagcacacaggattagaaaggacatttggccgctggaattcttcagtgagaattcagtgattaagcctgccttctgttttccttgtgggccgcagggttcctgtggatgtccccaccctcagattgctggagtagaaaacttaactttccaaaacactgagttgttttcagcccagcattagaggttaaagatgctcatgtagaaagcacgcaggatggatctgacgaaggaaacagcttctgatacttgagcaggctttggacagtgcagatgaagggggctgagatactgaggcagtaaagagaacggtcagcttggggtctggagtcgctgggcactgagtgcgcgttctgagtgccattcaagcaccacgtaacggttggggctggtgttgggtcctgagatgggccatgggccaccgttaaactcaggaagcacgtgctgcccccccccactctagaaggcgggctgttttcctggcgctgtgtgtgccatgctttgtgtgaacatctcactgggtgtcgctctcatgtggtaactgggcatgttgtagaagtcgttgctcctaaacgtaagccagtgcccacattgggtacgttctggaagaaacagtgtggcccaacatgggcttatccagagacaggacacctgctgcctggtgacgtcaccacctcccgatggcaccactctgttctactccactgcccccggggcctgacttgctactatggaactaaccctgtaggatgaggccgccatgcccgtgtgtgtgtctgtccagatctgtccccacatacttgctggtggcgggtgggaagaaggttagataagttactgtcatagattgtgactatgaagtaatccattagaatcttcagacaaggaatgctgggagtggtggctcatgcctgtaatcccagcactttgggaggtggaggcaggatggatcacttgaggtcaggagttcgagaccaacgtggtgaaacccatctctactaaaaatacaaaaatgagctgggtgtgatggcacgtgactgcagtcccagctactagggaggctgaggcaggagaatctcttgaccccagaaggcagaggttgcagtgagcagagatcatagagatcatgccactgtactccagcctgggcaacaaagggaaacttcatctcaaaaaaaaaaaaaaaaaaaaaaagaatcttcagacaaggaaaccatgctctttgacctagtaatctcccttccccacccaatgccaagaaagctctaatgcaccaagattttagttatggtgttacttgacagcaaaaagacagatgactcaagcatccaacagtgggaaaacagctaattctttttcaaatgatgccttcacagtttgaaataagtagaatgcttgtcttaaaatgaaaagcttcaatatcaaatgttgaacatttatgaatagaaccataaaaataatcatgggggaaagctgatgaggagcagttcatagtgattatctttagttggtagaattttgggtgatttttttttccatacccactcctcctccccaaatgttctgtaatgaatatatgtttgggtttttttgtttttttccaagacagggtctcactctgtcacccaggctgtagtgcagtggcacagtcacagctcacagcagtcttgacctccgggctcaagcagtcctgcctcagctccccacatagctgggaccacaggcatgcatcacgatgcccagctaattttttgtttgtttgtagagatggggtctccctgtgttgcccagactggtctcaaactcccgggctcatgtgatcctcctgccttggcctcccaaagtgctgggattacaggtgtgagccactgcacctggcctatgttactttttaaatagggaataaaatagctggtcaccctgatgcttccaaaggaatcatgcatttgttgaagaggggaacagtgcaatgcaagatttacgaagacagagctgattaccttccctccccagtcctcagatactgtctttctccttgcctttaccaggacgtacaagtgcatctgagcatacggagggtgtctgtgttggcttaccgaaaggagtcctgttactcctgcattcccattcgatatggcagattgtgcatagatacctctgcagaccagtaggcctctccaatacttttctttccctcttactgcctttgggcatgtgtgcacacccaggattttacctaagtggaatctgtacttactatggttttggtttgtgttaagtcatatcctttgttttttcaattgtctcttttggcagaaccatgtatgctagcatccagctgcctgggctcaattcctgcctctgcctttggtagctgtgtggcattgggaaaatggctgatcttttctttgcgccaatttcctccttaaatataagtaataatagtacctgttttataagcttgtaaaggataaatgacttagtacctgcaaattacatggaccagtgcttggagacgtaagcactttgccaacttgctgtcagtgtggttggttattttcccccatctccccagttttgttttgttttgttttgttatttatttatttttttttttgagacaagatcttgctctgtcgtccagggtgagtgccagcacagcttactacagcctcgacgtcctgggctcaagcagtcctcccacctcagcctcccaaatagctgagactgcaggcatatgccaccatgcccagctaatctttaaacttttggtagaggtcgggtctcactatgttgcccaagctggtgtcaaactcctggcctcaagtgatccttccaccttggcctcccaaagtgctgggattacaggtgtgagccaccacgctggccctcctcagcttttttttttttttttaaataaccattattattccatattttttctatgaaatcatttataaacataaaatatcttaagtctgtaattcagtttatgatacatattcagttatgatacattctttgcatttcactgtttcatgtttcagccaaatcccatccccccaacctttttttttttttttttgagccagggactctctgtcgcccagactgtagtacagtggcatgatctcggctcaccgcagcctcttcctattaaagtactgggattataggtgtgagccaccgtgtctggcccctatccctctattaagtgcctttcagcaattctgtttttagaggaaaattcctttttgcttctgcttgctccttttaccacccctgcccatgaaagggggagttacctgtccagagcaagtatagctttggccgtgatcttcaaggactattgcattggtgctgactgctggggccccttggcccccaggttcccaccagtggagcaaacacgaagggtgcagcctagtcggaagtgttcccaaggacaacatcagtgtgcagacttccaggggaggggcatatgaaactgagccaacagaggccaagatgagaaccctcctgtgacatggtcccacccattaggccattcccttggtcagctggatggcaaatactagtagtgtatgctatggagcagacatttattaagtccctgctgtgtgtcaaggattgagctaggactctgcaggaaatgcatgtgtagttcagtcctggaagctgcccagcttccgcctcctggaagcatccttttctccccagctgctctcgcctgcacatcttacattctctggctggtccttctgggtgtgttcagccactttgagctgtgcctgcctgatctgcacactttgcaaatgtgtagactcagaaagagaaacagcccaaacagtggccagaaactgttcttggaggctctaggttgacaaaagggtcctttaatagctccaggttgacccctcccctagacacctgtgctccccctgagccacaccgtgacttcggaagttcaactgtcatccagtttggtcggctctttcacaaaataatttcactgattctgtcaggcattttcattactttgatttaaagtttttgtgtcaacctctggtactttagaatctccagatgttgaaaaacaaaatcccattggtaatgtttgttttcctttacacttatgaaaaaagcaacttttattctcgcctaaaatttattgtcgagagcacgtcttttaaagtaaaaaaatgtttgcagcatgtcatacggctctgaaatactatgtaggtcgcagcttgttttgaggcataagtgacaaatatacttgtgagagatgttattcttaccctattaaagaaattagaacatggcttttgtgtctctgatactgattttatatcttcgcaaccgaatttgtgaatcccagctagagtaaaagacacacgtgatgcatgaagaaagtgaaatggttctgtttggtatttatctcatcttgatctttggcttggaagaactgataatgaaactctctttgggaggacagagagctctggggcattcatctcccaactaggtctccgaatttggtgcagttcttgaaggcaggtgggtttacacagtggtgagaagtgggaagtatgaagggtgtgatcttcgccctctttttgtatgcccgttaacaaaactcaattgttaggcgttgagtagggctattgatttctagccaacggaaacacttactgtgtaatttccaggagagagacattttcaggtgatgtggactcattccctgcagttcagaaggtaatgagcaatagtgatcaatcctgaggttatccggggtgatttcagcttgtccattgcattgattgataaatggcatgctctgaggctgattgagtgatgaccagcagcatcaaagaaaaccctcagtttgcatggcgggtattagaagtggctgccttgatgcctcctgtcatcgtttgagtggtaaagagacattctttgtatgtttataactcttgatttggggtcatggttatcatctgtactaactgcacaggtcatcccgctcccatccctttttcattctttagaatcccccacagcggtccacgccccttgccaacttccttccactatcctggttctgttgttactcctgccgactgcagtgctgttccgtgagcttcttgaatgacatcgtacagtatctccgacgcacagtacgtaccagttacagttgtcttgacaggatctcctgtgatcttttgtcccttttcagtttagctcttggtggctccataggctctcaagcatcctggacagttctctgtgggctggcgtcctgggtcagattccagggccggatgtgagctgtgccttgaccatttgaagagctcaccgaaggaggtgggaatggacggtgcaggaaagtaactcaggcacccgaggctgctgagcccagagaagaagcacctgtccttggagtattgttccaggaaatggggaggcaaccggttccagagggcagaactgggttgggagacaaggaagcacagttcttgtaaatcaagaaaatttgtaaagccacataagctgtccaccagtgagagagagcatgtacatgctgtgagctgcagtcaggccgcctggccacaaggcatgttgtggcatgctgtgggagtcggcgttgaagcatcccagagacctcttgtgcttaaacaaagctgagttattcagcacactcctagatgtggggtctgattgttggtcaaactgaaggactcgagaaaatgaggactaagtggggggatgagagacatgtgagtgggtgttgggccagtagaatgacaaaaggagcaggcccaggctctttggaagacagacctttgcccttcagggggactgggggagtgtttcctggcaggtgtggacattcgtcctcatggatgtcttctttataataacctgtggaggacggcccagcgcatcatgccactgaccttcactgatgcttctgtacttaagaagtaatgtcccttggctgggcgcggtggctcatgcttgtaatcccagcactttgggagctggaggtgggcgaatcacctgaggtcaggagttcaagaccagcctgggcaacatggcgaaaccccgtctctactaaaaatacaaaaattaaccgggcatggtggcaggctataatcccaggtactcgggaggctgaggcgggagactcgcttgaacccaggagttggaagttgcagggagctgagatcacaccactgcactctagcctgggtgacagaacgagactctgtctcaaaaaaaaaaaaaaaaagaaagaaattgcccaaattttcctttcaaggttgaagttagggctgaagaatcagggctggctcatgatctcttcagactcagtcatccatccattcagagatcgtgtgtgtgggcgcacgtgtgtgtcgtggactgttcctcaggatccgcaggtgcagtggccgcgctcccactgaacttgtgttctagaggcggagccccctccctgagggcctggctttctcagtgtcaagtggagagcatgttgtcttagtctgctttggctactataacaaaattccataagcaggtggctcatagcaacagaaatttaattctcacaattcttgggaaatccaagaccaagatgccagcagattcgatgtctgatgagggcccaagttctggttcagagacggtactctctcgctatgtggaagggtcaaatgagatcttcctttttttttttttttttttttttaaataaaattttgctcgattgcccaggctggagtgcagtggtgtgatctcggctcaccgcaacctccacctcccaggttcaagcgattctcctgcctcatcctcccaagtagctgggattacagccgattaccagcacacttggcaaatttttgtattttctcctgcctcagtctcccgggtagctgagattacagggattgctggatcaaagtttaccacgctcgacaaatttttgtatttttagtagagatgaggtttcgctgtgttggccaggctggtctcgaactcctgacctcaggtgatccacttacctcggcctcccaaagtgctaggattacaggcattagccaccgagccttggccaaaagagctctttcatcaggcactaatcccgttcatgagtgctccaccctcatcatctaattaccactcaaaggcctcaccctctaataccaccaccttggggatgaggctttcagcataggaatttgcagggggacacaaacattaagaccagagagatactttggactgaggggaccctttggtgagaacacagggagtggttctctgtggggaggctgagattggcgtggcaggaggaggccagccatggggcatctggggaaaggtctggaggccgaggggctgtacccagggcaggagccagtgcggttgtggccctgtgagggcagacccggatcttgaccacgaaggcactgggcgttgctggagagcttccagacactgggctaggatcacatttcagtttccagtgagaatcctcctgggtgtctctggaaaatggcttggaaggcataagagcagaaacaaggggatcatttgagtgaactcatatagtagcagagctgtgcattgagattacccacaccccagctgcgagagtccctgttaatgcaaggtggccagtttaaagctgacaggactagatttccccatggagtgatttgctgaaggctttgggctggaagttccagcgcccgcagaaaacttactgttggaggttcttcgccctcgtttctgaaggaaagctcccagctctgcctggagcctgggatggaaattgtctctggttaataggatctttaagacagctaaatcctgcactaaagacttgatgcaactgctgttgcacacggaggtggctcccctgccatatgcccgcagagctttctttcattgtcattacagagagtcaggcgtgtgtacaggaaggagacgggatcctgccgtaatgactttgtcttcaccatcttttctcagctgcttaaattgctgtcagggcagcgtaggaatcttaaaggagggagttttctctcatataattatgctgttggtaaaaatgttggcggcttttctctacttttccccttagccaccaaaataaaactctttatcttggaactcggcagctgtttgcaatccgcctcatttctcctgctgatgtattggtgtcgcagcttgggtgatgggtggtgacgtgagggttgaaggtaatttctgtcgcagtcccatggtcatgagccaagacctggagtgctggaggtgcgccaggtcgggtcatctttgggttttgcccagtgagctgttgctaaggagagggctttgtttgcctagagctgggggaaatgttcaagggcaggcacacattggcagagatctgctgacgtggcgacggcggaactcatggctgtgtgtcaagcctgggcagtaacaggtggcgaaggccaaacctttgggggcagacttggggcagcagtggagacgtgttttggggatctcaaggcgtcttggtgggaaagagtgccggtgggtcaggaaggcgggggtgctgggacactgctgctgcttgggtggggtcaggacctgctacacagataccagacccaccctctgccaggggacacagaacgggcaaggagaagggctgtgcttctgagtgcttcactggtctggaaacccatgttttaactggggccacccccggacccctgagactgaggtggtgtgaacctcagggctggggaggtggcttccaggggaccacctcctcacgccctcccttcccagagaggatggggaaggtttgggcgggagcctccggactggtagggactccacctagaggccagcccctcctggggtaggcacagaggcctccagagcgcctccctctgagtcacattccttctcatttagtcacctttccttccacggggctgctgttggctcgaaatagaaggatgactggaccgttctccgtgcagcttcttccctgagatgttccccaagcccctcaaggcatcctttgtgatgcacttctaaacagcagccggctgggctcacagtggctcacacctgtaatcccacgactttgggaggccaaggcaggaggattgcttgagctcagaagttcaagaccagcatgggcaacatacataacatctctacaaaaaataaaataacatagtgggctctcttctctacaaaaaatcaaaaaacgtagctggggccaggcgccgtggctcacacctgtaatcctagcactttgggaggccaaggcgggcagatcatttgagattaggagttctagaccagcctggccaacatagtgaaaccccatatctactaaagaatacaaaaatcagctgggcgtggtggcgcatgcctctaatcccagctactcgggaagctgaggcaggaaaaatgcttaaaccagggaacggaggttgcagtgagcccagatcgcaccactgcactccagctggatgacagagcaagactccgtctcaaaaaaacaaaacaaaaaaaactttagctgggtgtgatggtgcgtgcctacagtcacagctacttgagaagctgacgtggcaggacggctggagtccaggaggtcaagactgcactccagcctgggaggcagagtgagatcctgccttaaaacaaacaaacaaacaacagcgagtgtatcctgggtgcttgttcggactaaggtgcaaacagagggctttgcgttatggtctttgatcctggtggcattttcattagactagatggtcacggtaatgtggtatcttttccttttttgtagacaggcgactgagtctcagagggcggtatcctcgcccaggtcgggggtctgcacatggctgtcagtgttgtgtcctcggacagccctgtcctgggaactcagaggctcagcagtggtgcctgtggaatgggcctctgttttcaccgagtagttgaccccatctggcacgacagggagactcttttttatccagaagccaaatcaagagaggcttttctgagtgacttggctgtgcttttttccagctttggaaagtatgttgagaatgcgtgctggccctggtggtcttacgttgttggtgtcagatgtaaacttgcgacgtgaaggcagaatttaagtctagctttatttagtccaacacgtgttctgcagcagccgctggctgcagagccaaggggataaccatcccctcccagtacttgcagtctggtggggaccaaccccccagagagatggaccctgtgctggctcagagagagagggcacttaaatcttgcttggtgtgctctgggaaaccctctcctggagcattggcttctgagctgaattttctggagtagaaggtaatgccgaggcctgctggacatatgtcctgtgaaaattctcagaaaggctgggtgcaggggctcacgcctataatcccagcacttcaggaggccgaggcgagcggatcatttgaggtctggcattcgagaccaccctggccaacatggtgaaaccccgtctctaccaaaaatacaaaaagttagccaggtgtggtggcgtgcacctgtggtcgcagctactcaggaggctaaggcacgaaaatcacttgatcccacgaggcggaggttgcagtgagctgagatcatgccacttcactctagcctgggcgacagagcaagactgtttcaaaaaaaaaaaaaaaaaagaggaaagctggcagaatgatcatggatacagtgtgcaaacgtgacttgtgcagccaccatactctcctcatgggggagtaaaaattagctggaaatgatacctgaggcaagaggcctattaaatcttattaataattgattttagtgggaagtacaagttcagtacataaagcaggagctttttggggaagttactgagttttttgtcttctccagagagaggccagaagggcagcatctccaaggtgaatctgcccattggctgtaaggagcatggacgaggacttaagaggcagcccatctggccacatctccaaggcgaggctgtccactggctgtaaggagcatggatggggattttgaagacagtgtgtcccggagccggcctgcagagacaggctgcctggggggaggagggcagcccccagctccggcgtggccagccctgaccttgggccatcagggagggcacgccaagctttgtgactttcaggtctgttcccttgcccacgggctggttctggctggtttctggactgtactgtggccgtgtggaattctctggcacacagcagcaggtacagagcctgcccctgggcagcgctgaccatgctggcctggggtttggatacttgagcctgggtagagacagggtgggttctcggtggccacttcctctgcagcagccaacagcagagacagaaggaggcctgggaccttgccctgcctgacccgcctgtctttccatctgaagcgcccctgacatgctgtgactcttactttatttttggtagtttaccttaaagagtaatgaaatcacattgcaaaaatttgggttctctgggaaaatatcagtcaatcttgattctaaaacttgaacacaatcactgtggccattcatgtctattttttttttccctttaactttttcttttgacataattacagacttacagaagagttgtaagaatggaacaaagaatttctaattaccctttacctagcctctccaaatgacattttaccacatttgcttgtgtttctctcatatacagaaacacacgcacagagtatataatcttcagatccctctgagatatttgcaaatatataaggctaaagtatttagggatggaggagttaatttttcctaaacacagtgcccattctttcacataagacaagtatcaaggtcaggaaattaacattgataatcatatctaatattcagatcttactgattttgccagtagtcccaataagatcctttatagcaaaagaaacttcggattctgcgttgcctctggtttccttgtctctttagtcatctttaatctggaaccgtttcttgtcctcctttgtaccatgacattgatgtttttgaagagagcagatgagtcattttgtagaatggccctcagttcagtttgtcctgtgttttttcctgattggagttgggcactttgggcgggaatgctcaggacccactgttgttgtcagcacagcggattaggagggcacatcatgtgaatttatcttattattggtggggttaactttgatcacttggctaagatcgagtccgtctttctccactgtaaagctattatctcaatctccttttttttttttttaagtcctgtacatgattttgtgcatcgtaacataccaggtctgggtatgggatgtgggaggcagcgctgtgcccttaatttgtggaggtgacgcatgtgcagttgcctccactgaacgttaaaagtgcactcctgtgaccctgagttgagttcagagactcctatcaggtcagaagagctcctgctgttgacctgcagggcacagcttgagacctaagtctggcccttccagatgggccatggctaaggttccctcattcaataaataattgatgacttcagctgctgtatgcatggatttcttgcgtgactatttttccccctttttaaatttcttatgtgcgtctggagaccctttggcagtggggcctggagctccttttagaaaagatccacaggagattgtgtttccaatgatgacagccaagatggcacaggtggcagccctcccatgctaggggtgttgtcaggtcgacagcgctcaatccccattgttccagaacggccagaggacagtgaccaggggcagaggagagtgcactctcatggcccagcccctcacttagcccacctgccctgggctgggtgcactggtggctaccactgcttggtaagaggtacgggtgacagatgtcttggttgacggtgtgggtgtgtgttttttttttacccctaatccaaggaaactgggtgtatttctctttgtgagttttgactgctgttcccctaagtcaagttatatggaagcatgatttatcttctccaaaaaatatgggcccctcagtgaagttaaacagagtataaaatgccttcatggtagttaaatttatactctgttaaaatgatttgtgcactttgcagtaagctgtgatattaagtgcataaatatacagcggagttaacttggaggaacgttttatttgacaggatcacttaaatgctcaggtacagtatcgaaaccatttagcatggttaccaggaatggagggtgagccgactctgtttaaaatctgcagaaaacattcagaatccaaaggaaagcttgtaagtaagtacttctccatggagtgcttaatcgtggaagtggttttcatcacaggagagaggattgcaatttctaaatcagtctccctgcatcatgtgagaaaatgccttgtaaataaactctccattggaatagtcacttgtcctaagcgtggaactgattctattcaaattagcaaccattatagatattttggtcttctattgtcaatgacaatacattttcctgtgggaataggttatttagtccatattgggacattacaggagaattaataattaatgacatgctagtgctcggcccacccttctgtttttgtagccaaggcttgattggattttctgtatgtataatgggctgtttcaaaatggtcttgcctcattgtttcttcatatcttattgaaaccaacccactgttgatctcaatctgtgtaaggagaatgcggagtatggcattcgcaggactgaatccctagattttaagtttggaaggagatccaaccgggcagatgaattgaccggtggtgaatattctgtagcattttcctccctggagaggaatgccgccaccgctgggaaccgtggactggcatgtgagccagtggctgtgaaaggcgctgtgccctgtgtcctccgtgtactttagagcaggagcgtcacacatggtggagccgggtgatatcccgggcaggctcccgaaagctcctggtggcccatcaggggctggtttttccaccttttttttttttttttttttttcctcgagacaaggtctcactctgtcacccaggcaggagtgcagtggcatgatcttgactcactgcaacctttgcctcctgggttcaagcaattctcgttccttagcctcccgagtagctggcattacaggcactcgtcaccatgcccggctcgtttttttttttttgtatttttagtagagacagggtttcaccatgttggccaggctggtcttgaactcctgaccccaaaatgatctgcccgcctcagcctcccagaatgctgggattacaagcacgagccaccgtgccaggcctggttattccaaattttttgattggtctaaaatttgtaatgaatggtaggaaaacacagcaggaaaaagaaagaacattattattggtaagggtcagattaagccctgggtgagagtcatgagtccctagaggtatctgaagaagtcctcctggctttggccatctctacaggatccggtgattgctccgcctccagagctgtccccaaccatcgcagcttggcttgtctgtgacctcgtgtcaactcaaaacagcactttccccccgacactttgaagtcaaccctggtagaatttgtgaggaaatggccagtgtgtgttgggtttaaaaaaaaaaaaaggctgtggaagtagaacaatcttggggttgccacagaacaggcagtttgaggtgacgaagtggctttgtaatcaataataattgataagaccttgtttctagcaggctgtagacaaaaataatcttcttggacctatcttcgcctaggaaatatgtcctagaacctccctcctctgttgatctcaacgcccaagcccatcctcccatgagaaaggtttttttttttttttttttttgagacggagtctcgctctgtcgcccaggctggagtgcagaggcgcgatctcggctcactacaagctccgcctgccaggttcatgccattctcctgcctcagcctccagagtaactgggactacaggcgcctgccaccatgcctggctaattttttgtatttttagtagagacggggtttcaccgtgttagccaggatggtgtcgatctcctgacctcgtgatctgcccgtcttggcctcccaaagtgctgggattacaggcgtgagccaccgcgcccggcctgagaaaggttcttatgggaattgtgatgaaggggtcagagcagcccccacctccccccatcagcaccacccagggctgaatctgaagtcagacttggctgcttaagccacaacctaagataactttgaataccaggtgctgaaatcacagaacagactccaaatggtggccccgtttggactaaatgagaggtgagctgaggttgaacacgggaggcagagggccaggggtcccgtgggcatcagctggggtgggcatcaccacggtgcccccagctttttcatgggtgatttcttcagctgacctgggttttcagggttcttttaggcaggctcccagttgtttgtgtcagagagccctttttgttggtaatcccaagcccagaactttccagaatgtgctgttggatgtggctttattctttgatcccttcaaaaaatgaaccacaccgattactattggctgccaggcctggtgagggggtgagtgagccctttctgcgagcccggggagtttggagccagatgggggttcttccttccccgtctccagtcctgttgctctaagaacacagataagggagtcactccatccccaacaggtgccgccttatccctgctgatgtcagaaaccaactctgcagaaaccaactcttccccagctcacacatgctggaaacgctgaatgtgtcttataccctgcatctcattacatgtgtcttgaaaatgtggcttttctttatgtatataaacctacattcacagctctgcacaatcagtggcttgttttccgcttacaatagcgacattttggtggtagcggtgcctgacacgcatttcatttttatttaacttataaaaccttggggtgagtgcttctggacacacaaaagctttcatggagtgcaagagtggtgaattttttctcttttcaaaatggaggcgtggcgcatctggacacacacatcagttggcctgacctgtgcgttcgctacaggaagtaaaagtttggatgacatcactgcagggttatttcttgttattgtaattaatggaccagcaggaagtagcgagacagatgattcttggcagaaatgaccatttaaagggggaaggatgaagagggtctgggaaggaagaaacctttctggacatttaaactctccagggatgaaatagggaaatacgtagacagtgcacaaggaacgagccatctcttgccagagtggatataaaattgttaacccctgctacaactcagtttctgtttttctctctgccttctcagaacaacgccgacctgactggcactgggttttgtctggtccttttgtgccaagtgtgtcttccacgtcaggtcggtggcaggagaactcggaaagtgaagtctgtgctgcgtggagaggcgcgctgcctctcaagtcccaggtgctcttttgtgtgagtggaaggagctggaaggagtgtggggctgtgatgaaagaagggaggtggccgagttcctggggaaagagctgagtggtgacagtgttcctggacagaactgaacctagaggagatcttctggacccagaggagatcttgaccctccttgaagttgagcctcccatggtgtgtaggggccagagctgactgggcgatggccgtgctcccaaagtggttgagctggggctagaacccagctgctgcctggaccagccttccagggccagtgtcacaccccagcccacctgagtggagttgacagggttggagccttaagccacgtttgctcagggtcgtcttctgtggcccagaggtggatgctgcctgtggtgttaagggatgatagtggggtaatgggggtctggagcttgggaaaagaaaggaatagaggaggctcctcatgggagggagggagggagtagttcatttctgtgtacggttccattgtgtgatgatagcacagattatacacccattctgtgcgtggtcatttgggatttgtagctttgagctgttagggatgctgctgccatgatcatgtcatttggtgcacatgtgctacacgcatgtctgttgagcacatacctagaagaagattgctggcccattgggatacacatgctcagctttggtagaaaccgcctggtggttttctagaagagttgtaccgatttccactcctgccagctgcgcatgggagttgtgttccacagctttggcaattcttagcattatcctctgcatttggcaattctggtgcatttgtagtagaacctcagcacgttttaatctatattttcctggtgcatattagataccttttcattggctatttgggtattctcttaagttcctgtcaagtcttttgcctgttctaaaaattgctttgtctggatttttttcttaccgtgtcttagtccattttgtgctgctgtaacagaataccacagaatgagtaatttataatgaatagaaattggcttgcagtttttgaggttgggaagtccaagatcacaaggttggcatctggcgagggtcttcttggtgtgtcattccctgaccaaggggcaaagagagaggagaaagagaaaagggaataaaattcacctttttataaggaacccactcgcacgataacagcattgattcattaatgggggtagagcctcatggcctaatcacctcattaacgccccacctcccagaatgatgggggattaagtttccagcatactcttcttgggggccatatgcgaactgtggtatactggaactgtagaaattcttgatatattctagatggaagaccattgttgcatatttttactgaaatatgttcttactttgtattgtcactctataatctttttgatgagcagaagctttttatgatggctagtcttagattttatggttgatgcatttgtgtcttagatcaccgttgtctacccaagatccttaggacattctcctttgttttcttttaaaagtttggtttactttattgagtctgcctggcgtcagttaggagtccaggttcccacctattattgttttctcggctccgcctgtggaagtcgtagtcaaggtaggactcatggttccacaggtggctccagtgtcactgtgccattgagctgccatctcagctcattgtacttctctgccaggttaaacctgtagctgatgaggaacagccctgagtgatgtgtggggtccaagttgttgagaagggccaaggaaacggaagtactacacagagtgcttcaaggtaagaaagaagttactggagaacaacactgaatacatgctgtgcactctgaaacgtacacccagtcacacttacttcaatgtgaaaaggacagtgttcgccaggcactgtggctcatgcctgtaacccagcactttgggaggccgaggcgggcggatcacctgaagtcaggagtttgagaccagccacggtgaaaccccgtctctaccaaaaatacaaaaattgctgggtgtgatggcgggcgcctgtgatcccagctactcaggaggctgaggcaggagaatcgcttgaacccgcgaggcagaggttgcagtgagcagagaatgcaccactgcactccagcctgggtgaaaagtgcaaaactctgtctcaaagaaaaagaaagaaaaaaagacagtgttcactgcagagggtgcatcccagctaggtcttcatggtgcaccagacaggtcattgcctacagccaattgtctgcaggggatccttgttgccctgagctattttgttacattcttccttatgttcactatattctctgagaccttcatgtagctgctgctttcaggagactttgccttgagggactgattatcatattcagagagggggaatgctgctggtatctagagggtagaggccaggcttatgaacataccacaatgcacaggaaggccccccaccacaaataattgttaagcctaaaataccaacagtgctgagggggagagatacagctgaacaggtactgagaacatccccagcattctgtggtgctgggtgggattgaagatcagggttcacggtttccacgcctgggccgtgggagtaagaacagaccgtcctgggaaagatgacatcagacagactccaaccagcaccagaccctgattgggaggagttttccctctcatatgtcgccatgtccggaccctttccggggggcagcacgcagagatgctggccattttatgtgtccagtcctggtgaacttcactatgttctaagagaaatttacttgtatctttctttttggtgaaacttagctgctatagccataacaatttgtataaatgcctatatgaatcaaggcagttgactttccacctaaaaattgtttgccacgtacaaatcggtttccaattttattaacatgtttatcttactttaaaaaataaatcccatttgaaagaggtgcagaaaccagccatgcatgatggctcacgcctgtaatcccagcactttggggggccaaggcgggcggatcacttgaggtcaagagttgaccagcctggccaacatggtgaagccctgtctctactaaaaatacaaaatatagctgggtgtggtggtgcacgcttgtaattccagttactcaggagcctgaggcaggagaatcgcttgaacctggtcaattgaactcgggaggctgcggtgagccaagatggcgtcactgcactccagcctggcgacagagggagactccatctcaaaaaaaagagagatgcagaagccattgaagaaatctcatcgtgtttttgagcttctaagtggacatcatcaacattgagattaagaaagaaagatgatgtaaaatgtaagagagtggcccttgccattgcagacactgatttattgggcagggccacatctgaagacttgggcgagccggcgtggaactgctgtggctgttagctttctctgacactgtgttcttgggctctggaggtgggatctcagctgtttgccattctgtcatctctatttattgcatccaaccgttagtaatgacttaaatgatgattgccaaaactgtagtcaacagttttgttagtgatttggggccttgtaaaataattagtcctgagacatgtatcaaggggaacatactgaatatctgagactagcttttacttgatttgagcctgcaggtcctgctacaagatcctgtgtgtgctccagggacctgcaggcagttacttggggaatcagccatgccagtggtaggtggtagttcctccccagctaccatgagggccccaagcaattggcatctgtttctttgttttggccttcttgtcagtttcctttttttttttttttttttttttcttttcttttttgagacagagtctcactctgcactctgttgtccaggctggagtgcagtggtgcaatcctggctcactgcagcctccgcttcccaggttagagcaattctcttgcctcagtctcccgaggacctgggattacaggcgcctgccatcacacctgactaattgtttttgtttttagtagagatgaggtttcaccatgttggcaaggctggtgtcaaactcctgacctcaggtaattcacccaccttggcctctcaaaatgctggaattacagacgtgagtcactgcacccagcttcgtcaatttccttttcttgcaggacagataggagctgtacgtggattcctttttcttttttgagacggagtctctccaggctggagtgcagtggcgccatcttggctcactgcaaccacagcctcccgagtagctggaactacaggcgcacgccaccatgcctggctaatttttgtatttttagtagagatggggtttcaccatattggccaggctggtctcgaactcctgacctcgtgagccaccgtgcccggccatgtatgtggattatgttctggccagaaaagcccatgtccaggtctcagggtttgtccatggtgtggatgtctagggcccagactggccaccctcagcccagaggaagtgcctgtcttgacctcttgtcttccaccaagtaccctgcgggcagctgactgttccggcccattcccctcaacaacagttgccagattccgtttcctgcttgcatcctctgtttcttaatctgcagcatttgcaaaggtgcagggtctgctttgggaatgtttgggggtggtggtacgcatttcacggtatctgggaatttggttttgtgatggaaggaagaaccattggaccattaactatggttttagagagttactgtctttcttctaagcgttttattcttcactggctctagtcagccttgctttctaaaaaagctcttcaaaacctggcggactggtccattctcctgttccttggccagctgtcatcaccattagctctgttttaatttgcatcttgtaagtttttactgccatctttcaggtcttacttcacttttggggtgggaccccttcgccttgttccagcagttggaactcaggtcttcagcatgttggattaatttcctgtcccacttgggctcaggctcactgtaccaatgaccaatttgttagccggctttgctgcttcctccatcaggagcacacagcaagtgttctgcattttattaatatttcctggtttttccatcatccctgaatccctggctggccccctagtccagtgccaagggccgtccagtggccttcaaccaggctctcatgttcttgggccttcccgcaaatgctccttcccttcccagagcagggagcctgcccctcgctgcctctgtttcccctctcagcaggcggtggttgcatgggtgagtggggcacagatacgaggtcgtggcagccctggcacacggctcgggagcatctggatgtgcctggaatatgcttccatgcaacagagagcagcatctgctcagaattggggagggaagcaatcaccgcatacggggcattttgtctttgcaggaatgcagtgtgagggaagtgggtgattttctttttttctttggttaaaaagtttttattttagaaaaattttaggccaagcatggtggctcgcacccgtaatcctggcactttgggagactgagagcagcctggccaacgtgaaatcctgcctctactaaaaatacaaaattagccgggcgtggcggcagatgcctgtaatcccagcaacttgggaggctgaggcaggagaatcacttgaactccagaagcggaggctgcagtgagctgagatcacaccactgcactccagcctgggcaacagaacgagactccctctcaaaaaatagaaaaaattttagatttacataaaaattgtgatgataatacagatttcatatacctcacacccagttttccgtattaaaattggtaatcattattattattattatcattatcattttttagaaattgagtctcactgtcacccaggctggaatgtagtggccccatcatagctcgctgaagtctgtagtttctggactcaagctatcctgccggctcagcctcccaaagctctgggattacaggcatgagccaccccacctggcctttccctataattaacatcttacattagtacgatacatttgttttttgtttgtttgtttgagacagagtctctctctgtcactcaggctggagtgcagtggcacgatctcggctcactgcaacatctgcctccccagttcaagggattctcctgcctcagcctcccaagtatctgggcctgcaggcacgtgccaccacacctggctaattttttgtatttttagtagagaccgggtttcaccttgttagccagggtggtgtagatctcctgactttgtgatccgcctgcctcggcctcccaaagtgctgggactacaggcctgagccacccgtgcccagccggtatgatgcatttgttacaattaatgacccatatatatatataaaactgctgagctcaagtgattggcccagctaggcctcccaaagtaattgatccattgttatccaaagtctgtagttacttagggtaactttttatctttctatattcacttcttttggggtttgtgtgggggggggaggggggcagggtatggaaaaggaagtaattttacatctttactttctgtcaacttcctgatggtggtggagttggggagtagggaaacaacaaaatactctgtgagaacctccattaaaggggagactctcagcagaaatctccatgtcctgattagatggcacaacaaacagaaatgaccgtgtcctggcttggggatttaatattggaaaacaagcttgtcttaatggaaactttcagccagtaattttgttttcttgtttgtttgagatgaagtctcactctgtcgcccaggctggtgtgcaatggcacgatctcaggctcactacaacctctgcctcctgggttcgtggcagttctcctgcctcagcctcctgagtagctgggattacaggtgtgcaccacaacgcccagctaatttttgtattttcagtagagatggggtttcaccatgttggccaggctggtcttgaactcccaacctcagttgatccacgcacctcggcctcccaaagtgctgggataacgggtgtgagccaccgcacttggccataggcagtatttttgtgtgtttgaaactcatcattgtgggcgtttacaagttggactaattccaatactgattttggaatttaaagctttataaaatcataacgcaatttgtagtgttgtcaatagaaggtcctgatttgtaggagctggctggcaggcagctattaggggaggtggtcactcagccaagacaggcagggaacaggaaacccttggtcctgagaaaggcccctggaagaggccagccccgagactgtttggctagtggtgggggtgggcaccagctctaccccagccctgtgagtgcatcgttcccttctgttcctgtagctgatctccctgccccagcctgcgatgggaggatcagcagtaaaataagttgtctaaggtcgcgtgtcaggatccaaaggagaacccggtgctccagctggctgaggggagagtggggcctcggagacagcaggggcagattcccccagcagggcaaagcaaccctgacctccaagttgcaagggaataggtgactcagggagtacctcctgcagccctgctggtctcaagactcccaccttccagggcctggtcctgtgctcagaaacccctctgcatagggtgctgatgagtcctctgcagctccctcacccaagggaccacactgggaaacccagtagttgtctcggccatggcactaagacctttgcaccctggccatcttgttccgggacagccagcatctgtggtgtggtatagagacaaagctgccacctccaggacacttgctccttcctggccttcctgctgccctgaaacctgtggcctgtgtgttagtggaaacattctcagtttcattgctcagtaaaccttaggttatccaaactgcaaataaaatgttctctactttctagatttttataacttgctattttgagagaaaggggatggggttatgtgtgcaaattaacattttcttttggtttatataactccctgtctacgtagtttgaattctttaatgtagatgaagtttcacactcctgaatttgggaatggtcattgtatggtgttcaccctgtgcctagcagaggctcagtgaacatctgtggtcagaatggacgtgtccttcgcagatcaggatggtcgtggggcagaactctggtgcagctgtgaagcttcccaaaatcctctggagtctgtgggcctgggccgcatggtgaaattggctgtcatcttcctcgctttgctttctggctgcttgttggggctgagttgaggcccatctgactgtctggaggtagtgggtattcatccgttgttgcttggcaccagagggcaggtagatcctgtggcaagtggacaggtgagaggcccaccaaggagaggtgaaattgggggtgcctcctagggtatacatcggacccgccctgggtctgcagcccggtggcttcttgggcagacactgcacttggcggcttcagaggtgagggcacagaatgacgcgggtcagggagtcccaccatgggccctgcccatgggacttgatgcttgggtcagtgtacaggtcagggccttccttgaactaaaggctacgtgcacagactgacagctgacacttgctataacttactgctttgagagaaagagaatgagggttatgcgtgccattaatattttcctttgatttctctcatattttggtttacattatatcctttgcctgggttttgagatggtaagataagaagtttgataaatggcatatataaaagcagttttttcccttctaaatggatatttttaagaacagtttgatttacagaaacgtctagaaggttacatggagagttccgtatctcctcacctagtttccttattatcatttgacattacattagtatgagacatttattaaaattaatgaaccaattatcaatacattaatattaactgaagtctacattgtattctgatgatctgatatcctttttccatcccagaatcctgtccagtttttcaccttgtatgtcactgtctttctccttaggccccacatggcggtggcagtttcacagtctttccttatttttgatgaccttgacagttttgattatgatagtatattttgtggattgtccctctactgcagtttgtgtgatgtttttctcattcctgggctgggttatgggtttcacagaagactttttttgtgtaatctctaaataaaaaaattcttgaaagaaaaaagtgtaagcctttgccggccaataatgaatcgccccacatagcaggtggacgtggggggtgtctggttgtccatcagtaggagtcgcccttcccttatacctgggcctggtggtcaggcggggacttcaggaattcagcagccttgcctgcgttcagctgaccaaagacttttccatggagctgggaagactgcccaggggagataggaagaggcacgtcgcacacactgggcttccctggagacttctggattctcgagttcaccctgaggcatttactgatcgacacatgggctagttccttttttgttacattttaaaattctggtgaggtcgttccatttatggataagaaacccccaggtgtgaagggctcaggtgatgtacccagagtcacacagctcacgagtcagtggcaggactggagattacactgaaggttggtgcactgtgctccctggcttctgtgcaggtgtcaccctcctccaccaggcagactttgagtcgtgcaaacagaaaagatgctgcccacacttcagggccatgcttccagtccccgtgagctacccccagcaggctcctgtacgaaacatgacagcactttctagggtgcttggccgtgcctgcttcccccgttacatctgcgcaccctgcttgccttccgttcctgccctgcactcacctagcatggtgcatgcacctgactgcttagaaggcacgggacgttctgacttgatgttttcccgatttctcgctggtcctgatgttggtagctccatgtgacacaaagcattgagtctctggctctgctggggttaggatttgggatgtggcttggtagaggggtggctgcctgtgcctagccatcgccatgttaacagaagctgtgatgtaggggctcatagctcacatccctcagccaagagccactggtcactcagacgttgtcctgggtgttaggacatcagcctgagcattagagggagttcaccatcaagaagatgacggctttttttttttggctagagtgccatggcacaatcagggctcactgtaacctctgccttctgggctcaagcgatcctcccacctcagccacctgggtagctgggattacaggcgcatgccaccaagccaggctaatttttgtatttttcttaggacagggtttcgccatgttgcccaggctggtctcaagctatcctaggctcaagctatccgcccacctcagcctcccaaagtgttgggattataggtgagagtcaccacacccagccgatgatggcatttttctgatagactggaaagccagctgaatgaaatagctagaagaggacagtgaccctcagcttcttcatatggagcacgaatggatgtaaatttagtgggatttcttttccactggggctggccacaagagctggcagtgtgctcctacagtgagtccctcctctaactttacctcccactttctccctccggcccccttagctctcagctcagagacccacaaaaacaaatcctggggagctgactgcgcaggatgtggacttggtatttccctgatactggcatttgttagccggatcctgcctcttcccttcgccacctcgccttccccaaagcccctgcgggctttgctcttccttccctttattttgctgaagttgacagtcaggtatgagctgcattaaaatgttgactcatccttgggttgttttcaattttttaaaaagtgcacattgagaaaagcacagattcatgtgtgcagcacaggaaatcatcacaaagagaacaaggctcttgttgggggcatttgagttcaagcagagtgccccagttgcaagacttccatttggatctgatgatggctggacctccctggaaagactggaacctgaagagcccagtcaaagaacagtctgtcaagcagcccctccgcaaccacagtttttgtgcagagtggtttggggagcccatggaatggggacagtacgatgtattttctagtggcaaacatttcatcatcaagtgagagtttctttgctgggcatttcctgttctgtgtgaaacagttgtggttacctgtgggtgtgtttcagataatcattagagcatattctctgctcgttaagcagtaaaaccagtgaggtggggaagcttgtgaaactgaaatcccaaatatgcaaaacttggcaagaaagtagagaagagccagaccagctctgagctaagtcaccaaaccagaaaggtttcattctttgtcttttcttcctctgtctttaaccacaagccttgggctgaatccccacatctcactacacagtcagggaagcagggtcaaggctgactggggacactggcgtggcgggaatgggtgaagtctcctgggtggatagtcacctctctgccttttttgaaactaaacttctctgatttttatttcaagttgtcctgaagaacatgattctaaaacagattcagagcacgcactctgactataaatagaacataaggcaaacttggacaatggattgtggcacttttttttcatgtacctgaaattcttagagttggggctctcttcccttgagaagtagaactgctattcttcggagaccgatgggtgacctcagcattgtcctcaccaagaacgctgtttccccagggattgcacccctcccaccacagttatttttctctgaaggcctgagtttggaagaagtacttgcctgttcccgtaattatggaaaccggaaggtaacttacctgtttgtgcctggcctaattcagattagaaaaagatcaatccattgttgtctaatggacaggggacaaatgatgaagaaaacagaaatagcccataaaatgatagggatgtcccggctcccaggcaaactctggtgaaaaccgaggagactatggtgttccctgaggtattcaccatctaactgtcttccacaccatatatataagctgtttataaattctttgtcctggccaaaaatacaaaacctactggcagtgatttatttttttaatgcattttaaataactggattcctatgtggaattggagttggataattaaattacgatggcctctaaagttggggtgcggggggttgagggcttcagcagagagcacccctggaaggtggcactgcagcctgggggtgggggaaaaccgtgcctgatggagttgctgcaggggtccctacacggggtgtccacccttcttgcccagacaccctgtggctttgagaatcgctgtgacatagccacgggagagctgtgtctgcttaatgcttttgtttactttggaagtttgtcctacatgaatgaattcgcaaaacttacattccccgtaaagctgtcactgagagaaaacacagcaataactcaggtgatgtagttaaaccaccattgagtttgcgccatccatgagctgataaatcgtacagcttcatttggtaggaatcagcaattttatgtggcaattaatttttactactgtaggggagccagaggatgagcattttacttcggttttgtgtgtgttgagagaaacttaacggttttgccacagcaagaaaggatcgtgcatgaggcctttcgcacgagtcgacgtgtttgggtgttatcctggggtgtccttgccagcttttgttggttcctcacgtgggcagaagagtgaatgctcagtccccatcggggtgccacaggcctcatgacgtgtggggtaaaacacgtatgtggcttgcggagaaataaattctccgtatttcttaagtatgatgtttttccccaccagaccgattcgcccatgctgtttccacatcagagatgaagatgtgcgcagagtaacacgtaattagctttccagattgcttcgtagaaggataatgtgataattttcccattgttcgtttttggttccaccaatgatggccatttagcacagcacacagttgcggctgaggtccagctcgaggctggccgaggctgtgcacagctgcccagggccctgcctcgctgctggggagctgtcctttctttggctgagctctcttcctgtggaggcccagcctgctcactggaacgccagaaagatcatctgagcatagttgtctgttcagccagcctctcttggggccattaggaaaacgggtgcacagcagatgttgttccttgggtgccctcagtggtttattttttattttattttatttttttgagatagagtctcgctttgttgcccaggcgcccagtggcgcaatctcagctcagtgcaacctccatctcccaggttcaagagattatcctgcctcaaccctcctgagtagctgggattacaggcgtgtgccaccgcacccggctaattttttgtatttttagtagagaggaggtttcatcatgttgaccaggctggtcttaaactgacctcaggtgatccagctgccttggcttcccaaagtgctgggattataggtgtgagctaccgcacccggtccctccgtattttttattactgatggcagcgaccctaaccctaactctaacccctcgcgctgagttctgctgcgtgctgccagcgggtgtctgctgtcccagaacctccccgcagccttcagagttgtccccacgttacagtgttagagctttaaacaggacagacttaaaaaagcagatgtcctcatcaccctcatttcacgtgcgttctcttacagacacaccctactaggccattatacagtaaaccctagcttctattacatcaacaaatagttcagtgtattttcctaaaataaaaggactaacatttgctgagttttgagagcacccctgtgtccccccattcaggggcacctctttctagtagtccagaaccgaggctggactcagtcgtcccctgctcaccccgttttcccctgtaggcaccgttttgagtccgctgggttctgcttctccagccctggtgggagcagtcgctaagggccctctcggtttagcaattgaaacaggaagtgaaacacacaggagtttaggtccatcacaaactcagggcgtggacgatccctgggctacccggcttcggtcccacctccaccccagctgtgtctttggcccgttgttttctaccctgggcctctgtttagtcattttagatgaggaaagcatacctggttcctaagactgttgggaggaatgagtgaattcatgcaaagtgacgggaacagtgtccaggatgccgtgagccggggagcctgcttattgctacagctgctcctctcagtaagggtgtgacagttgcagtgaccgtgaggaggtggcacctcaccgaggtgcatctgagaacccaggaatgcaggccagctcacaggtccaggatgctgcacgggggctccgtctggcctgtggtaccagctctcagttgcctctggcttggtgtgggggcctcaggctttgctgccgtagacgctgttatatcctcccatacccagatcacctggtgtctgagtcccaggccactcctggaactgggatgtgtgggatttggtgtcaaactggctgttccttggagcaaggaggaggagaggtgagggaggtcctgttcctggcgctgcagggcctgtaccccttcctgtccacaggccttctctggccttcccctggggcagctaggggtgtggagcagggcggctgccagtggagccaccgtcaagggaagtgtgggtgtcgccccggatgcccagcgagagctttcccctgaaccagagtgtctggtgccaacagcgccaccagagggggccgttccactggaagtcctatcgggaagtatttttacagcgcttggctgtccttgcagacgaaaataagatgtttgctttagcaatttgcttagccctgaaaacattcctagacaatgccagggccttagttgaaaatagtatgctcagcttgctgggatggtcccaggaaggatgttttgagtgaaaataaaatggtacataccagggctgtttgccaccgcaggaatcctgggagagttcagcattgagggttgccgggagccgggatctagcaggggctggctatgggctgccctagcgtgcacccctggggccgaccggaagattccagaacagggagaactgtctgcaggtgtcaccctgcatgttgctctttcctccctttgcaccttagcacaccagcccccgcgggtcaagaggggtctccagctgcggtccacagtcctggcctcggcttcgtgtcctctaggttggggcaccggcctctctggggaagcctgcccgtgtgcttcttattcctcgactgtgagaaacttctttatccatctgcaatctctcctcttggcttcccctctctcctggtcatggttctgcccacgcagaatacacccaatccctcttccgcatgactgccctgcacataatcacaggcagagatggaaactcgggaacgttccctgctggggatgagcattgccattctcttccacaacacatttgcaagtttttcacttgctcagaaccagtgttgcaggtaagccgcaacagacacacacatgtacacacacacacacacacacacacacacacacacacacgtggggggaatggaatatcatgaccagtagttaaggaaaaatgcatttctgtttaaaagccatgttttaagaaaaagtacttgaactcaaataatgacgagtgacttatttcatgacatttgtctctgagacaaggtggcaaatagtatgctatgatcatttgtcgtgtgaagagtgaagtcagagtaacccgctcagctccagagctttgttttcctctgcggattcccttggcagcatttctgtggaggataaaaatagcacacggtgccttaaaataaatggctgtggggaatgcttgtgtacatcagctgcgtggccacatatgttcacattctccatattgttcactcttcaaaagagtgactgggatagacggttcgaatctgcccgccatatgataactaaagtgacatggaagagcctttggcccccgggaaggatgactccagggatgggcagtggggcaggctcaggtgtgtcagactcgtggctaacccgcgaggtcctgcaggtgagccttttctgtcctttaccccatttcatcctaagtgtctccccacaaaagatcagcaaagccagacccaacacaagctcccaaacaggccccttcctgactcccagtgaatccagacaaacgctgacaagctgacagattccgcctcctggagctggtgggggtgggcgggcaggaaattggcggggcgagaggggcagcacactgagctgcccactgatgcagtgtcagtggccttggagcatggcttctggggtcgacgtcaaaaaacagtgtgaaaatcttagcgtggacattaggctaatgggtccaggtcaggtgtggatcaggatgggttggtggtgacaagccttgggtctggagtaaattccatctaaatcatgtcacttttggctggagtgcagtgatgcaatctctgctcactgcaacctccacctcccaggttcaagccattctaatgcttcagcctcccgagtagctgggattacaggcgtgcaccaccacacccggctaattttttgtattttaagtagagacggggttttgctatgttggccaggttggtgttgaactcctgacctcaagtgacctgcccgcctcagcctcccaaagtgctgggattccaagcgtgaaacaccatgcccggcctcaattcacatttctgaagtgaaattgcgtatgtcttacccctcacgtaccttcatatcgctgattttctcctctataagccaacaaaacccagcaggatcctgaaacaactagcattgcttgtgtctcctttttacttaaacacgcctcccacccccaccgcccacactttgtttagcaccagcaaaggagacaaaagtgacagtgccgtctccagaaggttcacgcagtgagcctccggtatccatgcagaagcctccccctgcccatcctagtggtaaggaaatctcctgaaggtcctcgtcacctgcctgaccgtggggatgtgcttttggtggtggtggaatctccgtgtgaagaatttggtagacttgattctctgatctctctgtgcctttttattttgagacagagtctcaccctgtcgcccaggctggagtgcagtggcataatcttggttcactgcagccaccgcctcccgggttcaaatgattcttctgcctcagcgtcctgagttgtggagattacaggtgtgtgccaccacacctggctaatttttgtatttttagtagagacgggtttcgtcatgttggccgggctagtctcgaactcccggcctcaggtgatctgcccaccgcgccaccacacctgactaatctttgtatttttagtagagttggggttttgccatgttggccaggctggtctcaaactcctgacctcaggtgatctgcccgcctcagcctcccaaagtgctgggattacaggtgtaagccaccgcgcccggccgtggcttcacatttcaacaggggaatagttgcgacacacgcccatgcctcgctgtgtgaacaccgtcctccagatccttggcggttagcttggaaaaggcaaaactcagggggagaggaatggatggttagatcaggtgagagcacctttatgggacggtgcccaggaggcatcttgtgaggacgcagcactgtgtgtgcaatcgtatcacgtgaagaacttttaacatctttctggagttttctggtgcctgtattctttatagtgggtgactttggggagggcgcagctgcatattccaggctggctgggtgcaactgggacctccactttgcctactgcacagtggtcaagttcaggtgacagtccaagagtttctccccgtcagggctcctgtaaaactctgtaacagttcataaagaacaagcagaatactaactccgagaggcctccaagttagaaatgctttagaggagaaggctgaaaaagcacctcccgccacccagctcgttgatggcatgaaagcaccaggcctcattcctgccacggccctgagcctggcttcccgtgagaccctcttgggggcctgtggacaggaagtgggacggccaggacccagacctgtgacctgcgtcagagtgtaacgaagtccaggccagtctgttgcccgaagcactgggatgctttttactgaaggagtgtttaaaaggtaagctggatctcagacaaagctcctccaagaggcttccagaggctggagttttgtcaacaaatgaaacaggccctattttaagccacgctgtgtaccaggacttcctgtttttccagagaaacttcttgttttggtttttgtgatgatggatttattgaaacatttgctattcaagtgaccctctttgtgttccaaggaaaaagtcaagctggagattctgtggcctggaaaagggatacgcactcacagcaaaaacgtcatccccaaaagactcagtcggggggagtctgggcctcagtggccgatcagtgaatggacaaagagctaattgccagtcaggggcccagacggatttcatagctcggggtttggcctgttgtttagagggaggcgggggctggtcacaggacaattgaaaggggtttttgttgttcctctcaggctaagttaagccatgtgtgtgtctctctttcgaggagtgctggtctggccaatcccagccacgtaaatcccactcacttcctgctgaccttttgacaccaacagatgttttttcttacaagtgtcattagggcctctctactcgctgacctcatcagattgtgttgaagtcgttttcatcggttttgtctctaacaatccgtttaacccttcctgggtgcctctctgggaataagattgcactgccttctggccttgctgtctccctcctgcccccaggacctggcatggggaacggagcccaacccagagggcagagaggcatgcttccccggctgggggctgccctgtgtaccccggggacagagggacccttgtgtcttcctcgggaaggtgtgatggagaaagcaatgaggggctcaacaggtccctcggagagaaccttccagagctctgcctgtggatacatgctctgatcacacagctcatcaagcactggggccacagacacggactgggaggtgggtccccatggcacttgtgtgacctgtccgcattgctgcccgtgatggggttgggagcgatggagttggaggtcctaaggccacggaagtttctgtagccaacatccctcgactaagagtgcagactgtcatctgacctgactctgtggccgttctagaggcaggaggatggcgttggtcatttaacctttccatgaagctgaggcacaaagagcagctgtggggctggcgggtgactagagggagtgagttttcagcagatgaccctgactcctgggccgctgtgttgtgatgttatcttacaggctctgggcctcctgggctccttagagccaatggcacactcttctgaaggcatctggggtggagggggagtgtgtgtatcctgcctgcacctgaggtttcggggactcacctgaagcctcatccagagctgacagacatctgtgctgggcgtgtcctcctccatggcgtgcacgccttcactgtgcaaaccagcccagcagaatggaattgctggctgcttatgcattgtgtcagttactactcacagccgcttagaatagttctcatcgcacatggagcattctagaagtggtagctgcttttgtttattagttattattattattattactattattattattattattatttttatttttgagacacaatctcgctgtattgcccaggctggagtgcagtggcgtgatctcggcacactgtaacctctgcctgtcaggctgaagcaattctcctgccttagcctcctgagtagctgggactacaggcacgtgccaccacacctggctagtttttgtatttttagtacacacggggtttcaccatgttggccaggctggtctcgaactcctggactcatgatctgcccacctcggcctcccaaagtgctgggattgcaggtgtgagctgccacgcctggccagttagctgcttttaaagtcatgcatgcagctaaaaagcgttccagcctcttggagcctcctccttcccacagtcccactcctcagagggactcccctgccaacagttgggtatgtgtctacctgcctctttgatttttttcttttcatgattttacatgctagtctggctttttgcttctgcagatgttctgtgtctgctctggagagctctcccttggagtgtggttcggggattgtggggtgtggctttgtgagacgtagccgtgttttgcatctggctggtgtggctcagtctgactccacaagcctctgcagtgctgcttctgggggagcgggagatgtacatcggggtcctaaggacataggactaggagtgacctggccatgttgagtctcaggttctctgaagtttggatttggtgacctctacaatctcagaaggctccagaaatgccgtgatcctaggaaatcatccagggccacccaagcatctgggcacatgagggcatggcacctgcgtggtttttgcagccttcccatttctgccccttgtgttgcagttgaggccagctcctgcctcggctcatggtgttccctgtctcagaagcggctgtgtttgtgccctgaacctctgtgcagactgccttcaatatttacctacatgctctttttctctgagagctcagacttaatcgtagctgcagttcaaggaccacttttaagaaaaagcaagaaggtctgtttacccagtgaattaccattcagaggggggtctaggaggctgcattcttaatgtggggcccaggctctgatagatctttttaatgttccccagatttatgggtgtgcgtgagtcagagtggagaccccagggtgcctgagttaactctgtgcatgttgagcgtagccctggaatttattttaagcatctggggtaagtgaacataacagcagactttccgttccttcagcttgtacgcattgctgttgtgaggagaatagcgtttaccccaagagtttacagaagtggatatatcacagacctcatgtcagtctgggcagcggaggatttagagggtttcgcttgttttttgttagtgttctctgtcctgtaggtagtataaactagacgccatgcattacaaatgtattactgtttttatcttttctgttgaactgtactgtgtcagtgaccatagtcagtgtgatagtttgtgtaaagggttgtattagttatctattgctgtgtgacaaattacctcaaaatgtaaaggcttaaaacaacaaaactttattgtcttgcactgtctatgggacaggaacctgcacagcttagcttggtgcctcctgctagggccctgacaatgttgcattcaggatgtcagtggggttgtggtctcatctgaaggcccggctcggggagggttcagcttctcatggactgttgggactgagggccttggtttcctgttccgtgggtctctccttagggcagctggcatggcagctggcctctgggagggagggaagttggcagggaagatgggaggatgcccacactggtagccacagtctcttttaacctaatctcagaagtgacatcccctcacctgtgtatactgtttactgtttgtttagaagcagagcttgtacaaggacatgaattccaaaaggttgggggtccccgggggccatgggattgattctttttctggcatccacagtgtagatgggatctgccttattcagggagagggtcatgttcagcttggaaagctctcagtgggcctctggggaggggcagtgattcagaaaagcctccatggccctcaattcatggccctctactgttttgtgggcacgcctgtgtcaccggtgggtggctgtgcagagctatccggcttcggattccccagaagtcctgtaggggctggaaaggtcactgagataatgtgtgtgcaacctcagtgagggtccctgtgtggaatctgatcctctgccgggtccctggtttcttgtggagctgggcatgaagggcagtctgtggccagtgccctgcccttcggaactatgtggcatctctccttttccaagtgaagttcccatttcccttcctgtcttcccactcatcagacccgtctacaccttcggctctgggctgagatctcccctcccatcttcaggagcgtgtctgagatgttcaccccggcatcatctgaagtgctgtctctgaagcccagagggtctaacctcagaccttccaaaaaccaaaacctattagcctcaccccttctctgcctctcttgagctgagcctgttgatttcccaagggccttgggagtggagcaggctgagcccaggagccactcatccctgggtgtcctccctgggagaacctctgggaggggcctggagaggacagagggccttccttgcactgctgtgttgggggatgccaggaggggctgcaagaatctggactgcaaaagacctttcactgtgtcctcttgctctctgttcggcgggcagtgaggttgccattcaaaagatagagtggcgggtcattttcagtgggctcctcctgctcccatgtcctttgtgttgacaatgcactggatccttcctggaggtgagggagccccggccctccagagatgaacccccagtcgtactccagaaacctgggagaatgctgcacctgccctgaggggcagccttggcttcggtggccccgtggattcatgcttgaattatcctggaagttgtgtggggttttgttttctttttttttctctctcttcgaataagccttttgtactcctaaagttctgtgttttgaagaaataagtacacttggggtcagcggctgcatgctgcgtgatgcgtattcataaacttcattctgggggaagaatttgagaatggaccggagagaatgctttgacagtcagaaaagtttttctcaaaatttcccatgaacttgggaagtgtggagatgcacgtggctgtcccaaagccatatgaatggagttgatccaagcgcccaattccagcctgagatccagtgggcgctccgtctgggctcccatgggaatgtgttggggctgccgccaagcaggaaccgatggtgcctgtgattgtggaccccagattcctgctggagcccacactatgatacacaaagcccggactgaggcattcaaaggcacaatcaccatccgtttgctgctggaccccaagggcgttcttgataggttcttccctcctctgtgggccgtgtggggatcacctttctttgatctcccaaccctggcatgaggctgatggaatcttctgggtgttgttaacacagacaacacaaaggcaggacggtccaaacaatgaaatcccagacatggagcacagaaaacagcttaagggaaataaggttagaacattccctcctgggtctctcccctggcgaacacaggtctgagcctctcaggaggctgctccctgcgtgttgtgggggtcagctctgggacctgcagcccctctgaccactgctgggaaatggccacgggcacacctcaggccgtgcgtgttgagctgtctggggcgagattggagggtgaaggttgcctctccccataaagcaggcttgggttgacttggagctttttaataaagccaggattctgcacagattgctgcccctgcatcacaaccaggcttcctgccggggggtcctgagcttgcaggtctcagcagcgcagacccccaccgataggtgcgagcctcccgtctgttggcatgtgttggcgtgctcgggttgctgaaagaaggttccacagacaggccaggacagagatgtgttttctcagagttctagaggctggaagtctgagataaggcatccgcaggggtgcttccttccaaggatttgagagaagccctgtctccgtagcttttagatgccatcttcacgtcgtcttccccctgtctgtgtctaagtgtccaactgtcctcctttttatgagaatattcgtcttggattagagtccactctaatgacctgtttaatttgattgccgctgtaacgaccttatcttcaaataaggttccattctgaggtcctggggcttagaactttaacataattaggggggtccataattcaacctgtaacagtcagtgtgtgacctgtgggcatttaattgaaaaggtttcttttttttttttttggttggttggtttctattttgagacagagtctcactctgttgcccaggctagtgtgcagtggcgtgatctcagttcactgcaagctctgtcccctgggttcaagcaattctcctgcctcagcctcctgagtagctgggattacaggtgcccaccaccacacctggctaatttttgtatttttagtagagatggggttttgccatgttggccaggcttgtctcaaactcctgacctcaagtgatccacccaccttggcctcccaaagtgctgggattacaggcgtgagccaccatgcctggcctgaaaaggtattttaattgctttggggacttaattgacatcaagaccataaatgttcaggcttggatgactatggcaggaagtacatgaggagtgggcctccagggacctgcctttccctaagggtctccatgtaccgttttcgaatggtgtctggggtggggacataaacttgggatccaggtatcctgagtcctcggaccttttttcccatttatttgtctggcttgggctctaacatgcacaatatccccataaaatgtctcagagcagatttttaaatggccattaccttgtcaagaattctccagtgggatttcatgtaaaattaggatccctgatggtagctcacgatgagctgtaattctccacataggtgactgtattcatgggcaccatccaccctcctcatccagatgtctccctctccagaggactttggtgcaggaggcctgtgaggaccccagttcattatgacaaggttgcagttctctagaagattctcatcaggagccttgtctactcctccccagcaacctctttccactaacttatattttagctatagcctggaacattctgagctatgatgagtgttaaaatggggtggtgtactcgtcagagacctggagaccgggactggaagccactgtgaaacaggtgaaatgattcaagaagacagctgaaccccagcgacaccccataacagaaacaaaagaactcttgtgagccgcacccccacccttccttttcccggcatttgataggcaaagatgaatttgtgtgacacgggagtgtcccaccctcctcctccccatcagactctgcgagacgcccgctctccctttgggtgcagtcatggataccaaacaaagccttcatccctctgggtttccgttacgtagccgtcttccacgtgaaaaccgtgttaagcaaaatgaatagctgcaagctattttatttcatgttaaataactgtggataagactaagatttttctctttatgactcaggttgaaaagataaggtctgggaagcggtgtctttgaatctagagattttctggagttagggatgtctgatttctacatatcatttccacgacctgtcgcaggagacagggtaccggtgccccatgatgctgcagagcggcttttggtgatagagacgcattatggaatgtgtatacttgtaaggacccaggcatagagtatctgccctcataaagcaaacataatcctccactcctgaggtctgagttggctctcctggatgccagcctttgcatgatgagtgatgccttagttgaaatgaaggatgggccaccccaggtgcctggagcacttttatcccagtgcatgcccaaactactggtgtcctaaacagttggccccacagacgtggggtttggggagctgagctgtgcactggggcggtggctacactggcctggtcacgtcaggctgggcagaagagttggagcggggtggctcaagagtcttgatttggtttgactctataacttggctggcatggaacttggaaggctgggtccccactccttcagcaggtgggcccctttggagggagccgttcctgcttgtttttgagataatctctccggacacttggcagcccagccagcgtttgctttgatagcttatctctgcccgtccagcttgaactcccctttcccaccatcttcgaccatgcctgcgggtctccacctctccctggccaccatgtagccctcattccttgctgaaggttccacactgaagtgggttgtacagaggaacctcgtcctggaaagtgaaagcaagtcccactgaatgtgacttggagcaagcttgtgaggtattcgtggcatcagagccatgaagagaaggtggagaggcgctgcctgggggaggtggcaccggagctcaggtgggggctccccaggatccgcacgtgtgtggggtctatccaaaggcatcctctgccaaatcaggccaagcatgtgctgtatcactcagtggtatcctgctgctgtgacaactgtggcgactttgaaatgatggtaagaaagagtgtcctgtgacggtggggactgaattaggcacatctgtctcccgtagtggggcattagtgggctacaccagcccctcccattcttctccaaccagaaactgtcaggtaccctgccagtgtggagaagaggtggccagcatcttagaacttggtgaaaggggtgttgtgtgtgtatgtgtgtggtcaggtggacgtgtgtgtgtgtgtgtgtgtgtgtgtgtgtgtgtgtgtgtgtgtgtctgtggtcaggcgggcaaattgaggccagagagcacattaatgtgcattctggccagaatcaattcctggggaaagttggaaaaatctcctttcctttctaaattagtgtctaccaggaaaaaaagttgtatatcttaagatcatacttgtctcacagcaaactgatcctggtgttgagtcaaattgagcctgttgatcaggtgtgcatagtgctccagaggctgtcatttgtaatggaaagcctaaggggcatttgcggagcagcccagccggcccctccccagcaccgtcctctctgtgtgtgttccgtctctgccaagttgtttccaattttcaacactaactggttgctgtcagcagacgtaatggaaaaatcatttgtcagggtggcccctggctccctggggtcggggactccacaccctgggcagggagcctccctccttcttggcctgtacctccagtcactccgctgtgaaagtgggacccccagctagcgtctcgggagataaacaagtaggcgctggcgctgcatcccctttcccctggcatatcatgctcctagaaacgaagcatctgctgctggaacggtgagaccttctgcctctttcacatctggaactttcggggaaatgcagcatctcatccatgggcccaggccttcccttctaggagtagctgatcttattttctccaggtgcttgtagagcttaagttgggatagaaatgaggatggtggctcatggctgtctctgcagcctctggaaggccatgcagggtgtgcagtgccctctgctggccaaagggccccatcgctggacaccaggcctcccttgggctgggccagctcccaggaagggctgcaacaggaaaaggtcagcccacgtgggggtttccattggttttgagagcaagcagagactgcagagagcatgtccttatacaagcattctggaccctacggtgtcaagagatgagtgggctgggatctcagaaggccagttgggttcccctaaggacagtagaggccccataaaatcagtcgaggattccaggcctctctgaggcaaaattcaaaggcaaacatcttaaaaatctaacctgaagattttttttacaaattcatatctcatcattgcaatttgtttgataagtagctaattcctataattgcctttatttgatatttaaatacaagggcaattcatgtgttaagtgtaagctaaataattaaaagttaggaggattaaatcttcccccatttcatatattaagacagcaatgtttaacattatctcattaataatttattatatactatatgatacatataacacagtgttctataatatggttacaattgacagttgaatacatagtctaataaattgtattaagttttgcataggtttagcatataacctccagatatttctctccaagaagtgtagcttggtggctcttgcctttgcaagtcctcaagttcaaaacccttagtggccatcagtcccctgtgcttttacaccatgctggacacagcagatgtattgtgtgtgcccaattgtattgtgtgtgcccagtttctctgcatgacgttcagatataaacattctggaatcatttcttgcacactgtatgtaacaaaagatgagttttctggtggaaccacttctgtctgcctaaaatttgagatcactaattttttttatctgttcaaccagtcttctcggctacagatcaaaattttcatgccagagtaggaaagagaaaactagaaaaggaaaaattgatctgcattcctgattcctcaagtctaaacagacaggaataagaggtgtcatttagtttgtttgcttatttgcttttatccctttttttttgcttaacctttattattaaataacactattaaaactaatatacagtttatttttaaggcatatttggaagacaagttcttttaaactgtgtgaaaatcctaaacacaagaatggctcattttctttagcaacaaagaccaacacttaatttccattatgacacaaatcaaacaaccaattaggaaaatcacaaattctttctgctcaagtcttctgttcttgattatagcttttagcaagtgaaaatatttagaattttggagtcttgcatttaacacgaggaaatgtattttcgtgtgctaacaacccttaaccaaaacgggaggatttactcagctttgttggccaagggaaagcctggtttttagatttgctcacctccttctgtgtggcagcccagagcctcatagtgtgccctctcctagcactgactccatgtgctcagagacttgctgtgtacatttctttgatgtttcttactctgtgtaacttacaggggcttcacttttaattttttggtcatttcaaagcccctaagaatgttttggtgggagttagatggacagaacagaatcacagatccacattccttagcctcatatccaaattcttttttttttttttttttgagatagagtctcactctgtcactcaggctggagtgcagtggcgggatctcagctgactacaacctacacttcctgggttcaagcgattctcatgcctcagcctccccagtagctgggattacaggcgtgcaccaccatgcctggctaattttttgtatttttagtagagatggggtttcaccatgttggccaggctggtctcgaacttctgacctcatgtgatccaccctccttggcctcccagtgtgctaggattacaggtatgagccactacgcctggccctcatatccaaattctaaaatactctgatagcggcagaatttgacctgccctaaattgttgagtctattttttatattctttcttaatgcagttgggtcagtatgattatctgttctggcacaggcatttagatgatttggggggtacaccgtaatagattgtggaagccatgtattttttttttaaacccaagcacttgtgaattctgtagcatacctagccttggggtgtgggaagtggattgtagccctgtgttggctacagctgggtttcctgcattgcatcagccctagggaattagagggtggggcccttggaactgatcgagggcatgtgaccagggtgtgaccatgtcactctggggttgggctgctgggtgctccctggggaaatatgagctccctagcctttctttgatggtggaaccagagtgaaacttcaatgtgtatattagaaagggtcacgactgggcttggtggctcacgcctgtaatcccagcactttgggaggccgaggggtcaggacacctgaagtcaggagtttgagaccagcctggccaacgtggtgaaaccctgtgtctactaaaaatacaaaaatttgctgggcttggtggcttgtgcccagctacttgggaggctacagcaggagaatcacttgaactcgagaagtggaggttgcagtcagctgagattccctgggcaacaaagtgagaatctgtctccaaaaaagaaagaaagggtcctgctagttacctttagggcatggtatgggggcccttggagagggagattttcctgtacgcctctttattggtagtgtataggaagtcagacaccctcttaattcccaaaaacataaaactaaatttgcaaaaattaataaataatcaggaagcaatattcacttttggccattgtcttagttcgggctgctgtaagaaaaataccatcgactgagtggctttatttctcacagctctggagcctaggaaatgtaaaactaatgatctggcagatccaggatctgggagggcctgcttgctggctgtagacctcctggctgtatcctcgcgtggggcagcaagatcatctattgggtactacggactgggtaataatcctgttcctgagggcagagcctcatgaatcacctccagaggcccagcacccagatacaatcactgtgggcattagggtttgcacattcacgaatccagcattcagcatggaagaattttagggtacacaagcattcggtccatagctgccgttctgaaaattggctccattaagctcatttcctatcctgattttctcaaaaagcttcatttccttcctttaaagtacagttttagtaattttgttattaattgtggtgttgcggttgccatttaatcaaaggctgggccagtgctttttgacccactgatccctgactcctttaggacgtttattttgttatatctggctttgctgttgctttaagtttgagacaggctctcactgggtggcccaggctggagtgcagtggctttattcacaggtgcgatcgtggcacatcacagcctcaagagagctgcccgtctcagccttctgaggagggagactagaggcacacgccactgtgccctgcttatatctggtttttagtagttttttccaagtgtagtttacaaaataaaatgctcatcacccgttcagaagattctacccagctctcttcctaagaaagacatctgttgcacaagtttggcttctgaagcctatggaatgtgctcttttgaggtggcctgagcacatgtggctgttaactccggatgaaaagtcagagtgttttctgggcagaagtcattggtgggctggcgttctcaaggccctgttaactggcaccgtatctgcagatgtgccgccagcaccacaccagcaggatcctcggctatgtgtgcaagagctgggtgtcaccaccgcctggactgttgctgtctcctcatcttggcacagtggtcgcacaggctcctggatgagcctgtgggtgcactgagaggccctgtaggctgcggtgaaggaagctttccaggagtgagtcctgtcgtttgggatcccaggctcagaagggtggtggaccttgtgcattgatgcggccatctgggttgcagggaatcttttcttcctgcattggatcgcctcaacctctcaaacagaaagtctgcgccccactcatgcttaacagtgagatctgagttctccggggacacactcagagaactttggcaggacttgcttaactacgatgatattaatttgtgagcatattgtgaaactcggtctgcctttattaacagaatgtttaaatagatttccttgaaagaattgaaagccatcatcatgtttaactggatttgagagaaatttcattttgaagaaaggcactgtcaaaggcatgcacttactctataaatcccttcagctgcctattcttgatgaaggctaggaagtggagtcaagaaatcgagagggtcggccgggcacggttgcttacacctataatcccagcactttgggaggctgaggcagacagatcacgaggtcaggagatcgagaccatcctggctaacacggtgaaacccagtctctactaaaagtacaaaaagtagccgggcgtggtggcggcacttgtagtcccagctactcgggaggctgtgagggaggagaatggcgtgaacctgggaggcggagcttgcagtgagcccagattgcgcccctgcactccagcctgggcgacagagcaagactccttctcaaaaaagaaaaagaaatagaaaaagaaaagaaatcgagagggtctataaaactgagttgatcccaggtttttgtgctgtgtaaccttaagggcgcttggtagagaacctcatgatggtggcgaggagctggtgatggtcattgagtaaaattaacctgcccagattttagactgtgcttgatgaggggaaccctcccctttcccctgcccttgattctggatatgttggagtttgatagccaagcaagggtttgtaaaatgtgccgtttttcctttttgttctctcacgtcttcaaaaatgtcacattctctgtgatacctccacggaacaaatcttccatacccgtcccctctggaaacaaccaagtatctacaagtggctttcttttccaagccttgttcatcttcagaaatgagttgaatttcttggcaccaaatatttcagccctagatcacagccctcacttaaagcaaataaaatttaaggtccacgtttctgatctttggttggagtttggcctgtgatacccgtaactttccttttgggaggaggtagtgtttcttgtgcggtttggcttcagggcactcttcttccttttgaaaagatacagctttcctgttgaccttgaccttcactgaggtttacctcccagcctcagccagaagggaatgattattcgctgcggggatgagtgtgcaagggggtgtcaaaggaaaggcaggagcagctcacagagacctgcaggctcccaccgagtgtttttgtgcatatcctcactggctggtcctcactgccactctgggacatcacagtgacatcccattctacagacaaggagcctgagtctccagaacagctcatccaagctcattccacgagtggggtctagaactccctccacccacgattccgcccctggcatgatttgaggaacaatttcagcagaagtggaatagtgaaacacgttccctctgcttttgttccttccttatttgtgcccgtattgtttggtgtttaggggggaaaaattgatttatgagtggagcctggttttcatagcaggcatcaccaagagagctgtgatgtcagggagcccagagccagcgtggatcgggggtgctggcttgctcagcatggagaccagctggaggccgctgtgtgcagctcagctctaaggagggcctgtggctgtcattggaagatggttatgttaattaagtcctcgtaaatagcttgctccttgggagggctaaggaggaaaatgtcacatttcatacattctttttgcacaagagatatcgggggagaggattgaggctacacaagtcaatggtcactgcccagaccagacccagaggctggtggccttgggagccaagatggccagccctaaacatgggtcggtgccactggcctggggtgtgcagaaaggaacccacagaaggtccagaacagagtgacccccctcccccacccccacccccaaaaaagccagacatgggagtcagcctctttttttttttttaatagtggaatattggcgtttgtggaagctgatggctgatctttcctttgattgcatgattgagattctacttatcaatttttcaggaagccatctaattatacaaattaaaattcaaaggaaagcaaaaggaatgattacgcctcactcgggggttgggggaggagggtgtgaaaccccccttgcctcagattataatgctgtcatttttcatctccgaggtcttcacaaaaattaactgattaattctcttccccccttggatgacgcagctgatgtggaaatctgtttttacaacagagtcaaggaggggccagactgcagtttgaccatcagagcttgcgcctgagcaaatgacaattgctggcccgagcctccctggtcagcctcacctagagtcacttgtgggtggggggggggggggtggggatggacaaaagctcagatcaataggtttggccccccgcccccactccaataactcttaagttggctatagttagggactctttttttgtgtggttacctttcagaaagcccagcactggctaggcgcagtggctcacacctgtaatcccagcactttgggaggctgaggtgggtggatcacttgagttcaggagttcgagaccagtctgggcaacatggtgtgaaaccccatctcttcaaaaaatacaaaaattagccaggcatgttggcacatgcctgtagtaccacctattaaggaggtgaggtgggaggattgcttgagcctgggaggttgaggctgcagtgagccatgagcttgcccctgcattccagcctgagtgaagaacagaccctgtctcaccaaaaataaaaaagccaacactagcaaaaccaatttttaaaatacgtccacatggatctgctcaagggtaaccccacacattctatgacaacctccatctcctgactgatccgatatggtcagtccccgttttgggggaacttcccaatcgttgaaagggtttggtatctcagggatgttacattaattatttatgtgattggaaattgtgctttttcgtagctcttttatggagaatcacgtaattatcgccataaatctttcggatgccttttcagcttcgttgctgggaaattagccgttaacttacagaaacctggtagacctgcagtctgaccttttgataaagtaactcttaatgttttgcataactgatgaccgtacatcattatcctcatttctaccccttgggcctcatttttatctttatctctcctctttctttctgctagatcactgagaaccactttttctgtgtgtgtgtgtgtgtgtgtgtgtgtatgtggttgtggtggtggtcttaaaataagactgatttaattgtattccttgggaaaaaaaaaatacagaagacaatagagtgggccttaaatgttgtttcccagttgagattcaagccacctttttttttttttttttttttttaaagacagagtcttgctctgtcaccaggttggagtgcagtggtacaacctcagctcactgcaacctccacctcccagattcacgtgattcttttgcctcagcctcccaagtagctgggattacaggtgcctgccagcatacccggctaatttttgtatttttagtagagacgggattttaccatgttggccaggctggtctcgaactcctgacctcaggtgatctgcccgcctcggcctcccaaacttctgggcttacaggcatgagccaccgtgcctggccaagattcattaagcctcctttaatcaatgtaaagaatgcagttccagagcagtgacttaaaagctgggatattggggacagctgttaatgatctggacctcaccgggcacattggtgacagtcagaggcttccaaagtgctcagatcctcctgagaaggaggatgggcagcagctcctcttccccaggccgcagtcaggtctccctctagagaatcccacataccccaaaccacatgggagacctttcttgcctcctccatcagcctcacctctacctgaaacgtcatggggatggttacactctcacactaagaaatacttcagcccatatagctggaaccaagtgtcaaggccagcagcctgggaccctgcccttgctggtgctgactgcggtcccctccagctgcaaggaaggttcaggaaggcggcatcggaggaacgttggttaggagctgctggggcttcccacccgcgttctcacgtggtagagtcagggttttgtgttgtgctgagctgtggctttgacccctgacccctgcgcggctgttttggaaagcattgttgtaactcacctggcagcaggccttcgcagagcccctcgagtcgccacggtgtgcgtctgcatctcagtgtgagtgcgtttggggcaggtccaactggctgtcacttggtctctgccactggaatataatttattacacttcaaattggtcagtaaattggaatttatagccctaaagttaaaagcaagagatctgttggaatttgctgcttccagaaataactgacgattgtcttgtgtgcattcacttgctttctattatgagataagaagcaggaggcggctgagatgcacttggtgcagcctccattcccagtgctttgggaaaagagcaagtcccatgtgtccgcatggcaggttcccttatagaaagtagcagttaagtccccagtgagctgttgtcctgtgcccagagggtctccagagagtaaggattcttttctccttgtttcagggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtaagagcgtgtttggcggtttttaccaaacatacgtagtccctcactcaaatcttcgctggctgctcccttgagttggctgtgccactccccaagccagagtccctcctccgattccaacactgcataccattggcaccctctgctgggtgtccttggccgtgggcctggccttggcttaggacaaggcctggcttctggggcggggttggggactaggaggacagtttcagggctggtgggccctgaggtctatgtcttccatgtacctaaggttattttgcatataaaagatggtgttgattaggaccatcttttttcacttcctgaaatctcaggactttacctgttttggattaagatatttacaatgctgaattccctgatactatgagattcctgaagagcccagcattgcccctcgtggtgtgttcatgtccctggtatctttggaaatgtctggaagtgttctgttcatgaaaggaaaaataaacataattaaaatctaatggaaacctggggacaaaactctgaagtgttgattaagcactgcgctcttccagctagcgggtggtaagaaaccagcgtgtgggttcgggtttaggggtgagtgcacctgccagatggggtcagtgctacagggctgctctttgctcagggtgattgctggtactgccctacagggtggctctcggagggaagcgaagatggctccgcagccccctctgcacccttcacgcacacgctgaagtttagtagctgacccaccagtttgtggacaggaatatgcaacccacagggcttcccctgcagctgcccatatggaattgtctgtcctataagtagatgtggctcatgccacacggggtggggacatcatagacattctgctgagtgactccatggcctcacagaactctgcgctgcaagaacacaaaagcactgacattcctggggttcagtataaggagtttggcgttaaagggtttttttaaagtaaacattcacaaattataaaaacctacagagaggttggtaggatggtacagtgaacaccaatattccattcagttttccagattcttttgaggggagataaagatagagatatacatataaatagacactgtgtgagtagatgatggattttcttccagaaccatctgaaaaaattcaggggcagcactttactctggactacctatggcatggcaccttttatccaatttcgtactgctcccagtaccggaatgaaccccaggaatctaacctcagggacagtattgtctagtataggctgcatattcgcatttcctccacgtctctttgcctgtgcaatagataagggtcacgcattgtgtttagttgttacatctctctagtctccttagtctaaaattatcccctgggcttttttgactttcagagacattggacttactgaagagcccaggccccattgatttgtagactattccacagtataggttcaccagattgtatggggagttgtaaaatttactcttgacttccactgtaaaggtgcttgattgaggttactgagtacttgcttctggaacacgctcgtgactcagctttccaaggttactagcaggaatgcctctggggctgactccaccccctgcacccaggattctccagggatgttgcatcagaaactagaatgggattgaagagctagcagcgtttcctctgtgtgtttccatggctgtataaacctgacttgggcaaaaccattgtctgcttgcagaccctctgtcccatccagacaggtgctgaaggatggttcaccaaccttcccacccccttcatgtgtaataggaaattttcagccaattttttataacagaagtttgcattaccttgtctatgcatggtgttccagatacatttgcagttatatattttaaatttctcaataactatcaacgcagacaggccaaaatgcagttactccagtgtgggtcaccatctatatgtcagctccctaggcatctcattaagtactcacagttggtcccaagtgctttgttggtgctcctcctatgtataagctgacttagtccttgtggcacctgttatgggtcaggacaggtggcacccatctcacaggtgctgccagagaggcgttgagcagtaggcagtttgcacccaggaacccgggcagtctgtttttttctgtttggccttctctcataccagcttgttggattcagctctttcttccacctgaaggccttgaacatctaacacacacaaacacacacacacacacacacacacacacacacacacacacacacacaccccctctagctttgaattctcaccatgtttctattctatcaactacttgtagaatgttctgtattgatatgcagagagcctgtcaaactgtttttttctccctccccactgcctacacctgacacagggacttctgcgtcccttaggtttgttttttttttctttctaaatgattaaaagcatgaagctgccatgttctgctgtgcttacccggtctgctcccaggcttgtaggaactttgtcttcctgctcttggtgtctggatacaccagctccttaaaattcgtcccctcccgcctgctacacaatgccaacatcaagccctggtcgtgggtccctaggctggaatcaggcaggcctctccagggtcccactccaggtactccgctggaatctgagcatcacccctgcacagatacttgtacaacctttccctgttttctaaggcctgtccagccccttcctctttgaaacttttcaaagcaagaaaaagtggcatggagcttgatccttctgtgtgcccagaatctgccgtggggattcactccgccaggctgtgtctctactcggagagcaggacacagacagtctttgggactccagccaaatgagctggaataatggtctttctagccaatgtaaaagccacattttaatttttttaatgtaactctttgagtttgctatttataattgttccttttttttctgatgcctgctatcaagcaatcctataataccatgtaagaattattacgaaggagccctctcgtaacacaggctgatcagaacaagattgtggtctcctcattctcaagtataatggagatcttcctatctgtttagtctgctgacataattgacattgtgaactgcaccagctggagggttttagtacctactttatcgcattatgccagagctcctttggtttgccccaaacatctattggttggaaatgagggctagctaacaatcactcagcattgcaaagggaacccagaagagcatcttgcagagccctgggtttgtagaacttaataaaccacaatggctgttgttggtggtaactttttgttagagctgcttcttgtggattatgatagaatcagtctgtaaacactgctcccctttcctgcggctgttgcgattgcaacttgaaaaaagtatgtgtttcgttttactgcgttttgttcgaatgtgttagagacgtggaaaatggtcccccgaggatggtatcagctgagttgtgagtagtccccttgtaacatgactcagggagggtgcttctccatttcctctgcaaaaataaaagggacctcctcttaaataaacaagctcatgaaacattccgcacctctggaatgttctcacgaccacagaggataaaaggaatgagaacgttgagctggttgggtggatatgaggaaaaaggagacaagctggtttctgtgaaacacatagatagttagaaagtctgggaatctcattctgcatcacctttgtcgcaggaggatgagaagtctgagaagatgctgccggggatgaggtggaagggagtttccccagtgggtctcttctgtgtcgcgggctcttctgctcttctcagtgggttgaacttgccatggtggaagcacatgtcagtgggatgtacccccaagaaaggtcatccatacgtataaggaacaaagacaggcgcctccagggtcagcaaggttacccaagtggtctagaagtccctctggctctttccttcttccagcagcctccttgcctggcaaacacccatcagagcctccaggatgagagagtgactttctctttccccgaggaaagaacataatccacagagtgttgacaaatggttttgtttggtatttaagatttatttgtttttgttctgagtagctgttttcttttcacctatctttgtacagatgcattataaaatcaggacttgttttgtttttgtttgtttttttaaagcactttgagcgcttcgtaaagaaacagagttgaagcctgcctataggtagtccacaaacagttctaataaataactttaaatagccccaaaatgtggattttaaaaatgggattcataatgttgctatacattataattatatgttgggatcaggcaattatgcacatttccagcaattatgtgattagctgtaattacattagctatgtaaatatacaatagtcaactagacatgccttaaaaccccaaagcacaaatgaacatacccaaacaatcttatgcaaaggtaaaggttcaggaaacagccaaggcaaagcttcacagacaaaagtgcggttctttgcaaggggtaaagtttcatgttttgccttatctgtccccggctttaagagaaactcagagtgggggacccctccccagggaacccctcaccccacctgttcctccaccgactctggggatggggttcatagactgccctcccgttctgcagctgtgaatcaggttcggtgttttatttctctgttgttactcatttctcaagcacaaacataagcgtctctttgcaccggtcagtttggtgatgggcggatgtcttcatactcaccacttttttctaatagcaacatgttaaggccactttgcttttatttggggggccagggatgtgtagtgcaactggagtctgtggctggggtttgggggttcatcaccgtcttctagtttggttctgcagctgcggttttcagctcctgcccctaccacagtgaatcgcgctgtttcccaccgcctggttggtggtgccctgtctccatcgatgattgagttgaaacctcccacagtgtggcccggagcccctgggcccagctgcccagggctttactctcagtgcctgtcctcttggtcccggcacctttgggaaaagagcatctctagtttcaggccaagtcagtgccttgaggggagcagtgcttggggtgggcagggggaaggagtgccgcggggggaacagtgcatccgtagtctccgtgtttggaggaggccccagggtagccagacagcagcagacagcagcccgcacgaatgcggagaaccttctgcgcgcttcacacagctcaacctaattgacaggtatttggggtgactgtgaaccagaaccccaagatacattttgctgccggcttcttgccctctctccttttccagaacgtacagtgttaaagctgtgaaatgagactcctctctgattggtttctaccacttggctcgcttgctactaaagctcaggcaccttggcgtgcgcgctcgagggcgttcctctgtctctgtctcatctccatctacagagtgacctcacgtgcctttctcagcccttccacatccagcaggagcctggctgagcaccccagctgggctgtgaagatgccgagaggggagagcattctgggtgtccagcgctggggcacagtgggatcccacactccctgtccctccagcctgtttctcatcacctgagggttttgttttccgtgttccggttgaagagatgtctgtgccaggagggttcctcccttcccatttgcaacctgggatgggtgacgcagatttatccgagacttgggagtgaggctgagagtcagttctttcgtatcctaagaaaggctgaccgtcccatcaaggcccgtgtgctgaaactgtccgtgtgcaggctcaggtggagcaggtctctgtcaggcagccatttgtatttgggcggtgggtgctttgcctagcttagtgcctaccatgcccaggcttgcaaatggggctgtttgggctttgatgtgggctcaggctcagagggctgaagtggttgtggggaggggcttctggggactgtgtccatgtctctgtcgtttttccccatcacaccgtacactcccttgaggccagccgtccatcaccattgagtcatagtcgacagtttgatttacagcccgggtgtcaaacaaaatgaaaagcacgtgatgaatggagggagcacgtgctgtggagggaggggtgcgctccgctccgcaggtcaggggctaagcggccatgccttggcctgtctctacaggcacatgcatgccctggactatttttggggtgcctttctcatcttgaggagtggcaggttttttggactaaggacaaagtgacagaattggactgagaaaggttcatgggggagggctcgctgagccagccctgattaggagcattgctcacaaaaccagaggaaggacggcatcctgggaccttctgatcgcaggacagccgaggagacctcaaacagtggagtgtgatggggcgggtcaccatggaggtgaggtggagactttgggaatctgcaggaaaagctgctaaagagcagaaggggtggtgttcattgagcacctactgtgcggagcgtcttgtgccgggtgctgtccagagctgagcacagcctcttgaggttgagtgtgttccattgctagaaatgggaatcctgacatggtccaaggtgaggcctgtcctgcatcccagctggggtcccgttgcacactttggctccaccaacactttcaaaatgggcagtgcaagagaatgggcttgtttttttttttcttttgaaaccccataatgagtggtctaattttcataatgcagttcccaggaagctttacaatatagttaagaaattgagtcagaagcaatgtgcaggcctttgttttcacttaccatggctaaatactgagagacatgaggactggggcttcttaggatgcagctaatctgaaaaaggctgggttggttcagacactcgacgtcactctcctgacttcctttggcgcgttgcgtgggtgcccaagcctccgcgctccaggcccagaaattggtgagagcactcagtgtgcaagcaagggtgcacggtgcactcagcccctttgatacctgaaacgatgtctgggcagttttgctaattgttgctgtgtgcttgcgtgatttagacgaaggctgctttaaaacccagccagactttgtgtttgctatgtaaccagtgcatttggtgtggcctcccaccctttgcgttagattagccaacttggctactttgggttgaggacgttcgggggcagggggtagggggttgatgagaggaaagactttttttttttttttttttttttttgaaatggagtcttgctctgttgcccaggctggaatgcaatggttctgtctcggctcactgcaacctgcacctcccgggttcacgccattctcctgcctcagcctcccgagtagctgggattacaggcacccgccaccacgcccggctaatttttgtatttttagtagagacagggtttcgccatgttggccaggatggtctccatctcctgacatcaggtgatccgccccactcagtctcccaaagtgctgggattacaggcatgagccacggcacccggcccaagaaaacttttttaatggcacaaattccacaacacttaacttgacagaagcagacaaaaatccagcacaggctgtccacatttaaaagcaggaaatgggtatgccataggccgatttttctgccctgtgtctgccagaaaaccgtgttacccgctaacttctgcagcctccctagggaagcgctcgctgtgggagacgtagagggcactgtggtggctccgtcctgggatgcagcaggcgctgaagagcctcctgagatgttatttccgctatcaccttcagagctgccctggccctttgtgttggtggaggcaggatcagggaatggaagcccaggcaggtgcaggacccccctggggaagctgttccttaagttccttcagttgggaacttaagttgcctcctgagaatgagctattccctgagaaggccttgagacaaacctggcagcccaccaagtgggcgggtgacaacacagttaagagggacacaccattgagccaaatggccctcatgttactgcaaccttcagactcactgatcccacctgttcttctttttctataaaagtgagaattagaccccagagtcatgttttctctctcatttcaagcagtttcctgcatgattattccaatgggaacatgaaatgcttgttggcagtttgtccaaagactgctccgtcggagggtacccactgatcatccccatcctggcctctcttcccagctcttctggaactgtctggatccatctctggaattgtctggatctctgtaggtctctgttgttaattgacaccttgtgtcgcacagggacttcagaattggctttgggtggacatcgcctctctccccgacacagctatgttacacaatcatcttatttttacttgacataatttctatagtgagggttttggcagaattaaaaaattaagcccgtgagatgtattactctaatgggtcccatctcacttttagtcaacatgagaatttttaagaaaagcagtcctttctaaaagactggagtgtggtgtgtgtgtgtgtgtgtgtgtggtgtttgtgtaaccagagtgtttggaaaagtgagtccagttacaggtgtttttacctagcgcaggaaaacatctgtcataatatttgtcaaatctcagagccaaggctgtgcgagtttgggtggtttccaagcagaacaggttgaaagttgatagaaatggaagctgggcctcctggttcaatgggaggctgatgctgccccaaagcgcatctgcccacatctgccctgctcctgcgatcaccccttggacaccagctcagtaacctctctgaagaatcattactggtttcttaggcgctaccgggtaaacattcttctatagagccctgtttacatttgagaacttgctgagctgaaaaccagatagcaaagaagctggtgagtcaacagagctacctcaccctgctacaaaaaagacttggcatgggggattttcccggaatgctccaagtttatccacccatctttgaggggtgtgcatgcaccatgagtggggtagcatagtactaacaccacataaggtcatgttgttcattacaacaaggggaggaaagaaattggcaaggtggcttaatcctgaggcgctggccaggcgcagtggctcatgcctgtaatcccagcaccttgggaggctgaggtgggtggatcacctgaggtcaggagtttgagaccagtctggccaacatggtgaagtagatagagtagagacatggtaggctctactaaaaatataaaaattagctgggtgtggtggtgcacacctgtaatcccagctacttgtgaggctgaggcaggagaattgcttgaacccaggaggcggagactgcagtgagccgagatcgcgccattgcactccagcctgagaaacgagcaaaactcggtctcaaaaaaaaaaaaaaactgtgtctcaaaaaaaaaaaatttaaagactggtatttctctttagaagattctagtagagtgctagattgagagagatgtgagtgaggaacagcactcgggtttaatgcttgcaggtatgcatgttgtctcattttaaagtgctttcaatgtatacagcctttgtagcttcctaatcaccggcttttatttttgctatgaattctttgtcatgggaatcctgcagttgcagggcaggaacctaccgtgttagtctgggatgttgcttctctggtactgttccatatgtttaaggaaatgtcttaatacttcggggcactcctttatctaaataactgctgttctttgcattattgcgcctgaagtcctttgtggactctgaaagcttaatccatgtgaatatggaaaagcatctgcaggatctaagcctgctggaattaggcttttcatcctgacatacctaaaggaagatgagatattcagatgcagccgcttcccagttctgctttgcagtgtaaggtttagtcacccatcctcctgttcctgtgacctctgttgcagtcactttaaatcccagattacacacgcccttccctggcactccccggccccccggcagcatgagcccatctgtgtttcacagtaataaggtaaagaatgcatttgggcttgagctcggaaacctgtttgattcacaaccaaagagtcgtctcaaagccagatctcagtattatcaaagcatcaggtttcagagctggcccttttttgggctaggcatccatggcctaggatcacgtgtggacctttttctgtttatccatgtttaatttgtgtttagctgtgccatggattaacgtttcatcacggtggattaagagtggactgacattgaagcagccttattttgcttctgttacctctcaggaatcagtggcaggggtgggaacagccccttccagagggggaggcagggttcatcctaaaagtaccctggtgcttggaagagggagtataaacctgagcgtcagtgtggaagtaaatcccagttgcagcttgggagggctggatagagcaagccaccggcttcatcagtctaacgagatgtcacatggaacaaagctttagggttttatttagctcctaatccgcatgctgagagagccctggtccatgtgagcacaccagccaggaagggggacctggcaggctggggacagcctcctctccgggactgagctgtaaggaacagacctctctggctatcgttggggagtgaggcaaagttaccgtgagtcttatgttttgtctgctaaggtttcggaggattaataattcaggccatgctttgaaacagaaaacccccagttggttgtccctgccgtctcggaagggttagcacacagccaggtctgtttttgatgtatgtaattgaagatttataaagaaaagcttctcctctgcctcatccgcagtcattttttttccaatgccagttcccagcaggcatataaatattggtcgttctcagagctgggatgctgctgggtggtacgagggcccctgggagaacgccgagtccctgcggcctctggggaggagaagctccctgacgtatggcacagcagaggggacttggtttgagccaaaccaccgaccacaggacgctgccctgcccgtggccgccgagccctacctgtaccgggaggccgtttataactcagtggctgcaagaaaggggtctactcctgacttcaccttctacgacagcagacaggcagtgatgtctggtcgcagccccctgctgccacgggagtactacagtgatccgtctggagctgctagggtacccaaagagcctcccctctatcgggacccaggagtcagccggccggtccccagctacggagtgcttggcagcagaacgtcatgggatccaatgcaaggccggtcacctgccctgcaggacgccggtcacctgtaccgggatcctggaggtaaaatgatccctcaggggcggcagacacagagcagggctgcatctcccgggcggtatggacgggagcagcccgacaccaggtatggggcggaggtgcctgcctaccccctcagccaggtcttcagcgacatcagcgaaagacccattgaccctgcccctgccagacaggtggccccgacgtgcctggttgtggaccccagttcagctgctgcccccgaaggcagcacaggggtggccccaggggccctgaatcgtggctacgggcctgcccgggaaagcatcccatccaagatggcttacgagacttacgaagctgacctgtccaccttccagggtcctggtggcaagaggaccgtgctccctgagttcctggcctttctgcgggcggaggggctggcagaggccacgctgggagccctactgcagcagggctttgactccccggccgtcctggctaccctggaggacgcggatatcaagtctgtcgcacccaacctgggccaggcccgtgttctgagccgcctggccaatagctgcaggaccgaaatgcagctgcggaggcaggaccgggggggcccgctgccccgggcgcggtccagcagcttcagccaccgaagcgaactgctccatggtgacttggcttctctgggcgctgcggctcctctgcagacagcatccccccgagctggagacccggctcgccgtccctccagcgcaccatctcagcacctcctggagacggcagccacctattctgcccctggcgtgggcacccatgccccacacttcccctccaactccgggtacagctctcccaccccttgcgccctgacagcgcgtctgagccccacgtaccccctgcaggcaggggtggccttgactaacccgggcccctcaaacccccttcacccaggccccagaacagcctactccacggcatacacggtgcccatggagctgctaaagagggagcgcaacgtggccgcctctccgctgcccagccctcacggcagcccccaggtcttgcggaagccaggtgcacccctggggccatccaccctgccgccggccagccagagcctccacacgcctcactcaccgtaccagaaggtggcccggcgcacaggggcacccatcatcgtgtccaccatgcttgcaccagaaccaagtaatacatcctccccgcctgccctgcctggggacctggggggagcaggggggtgcggggttgtagaagtttgaacataggatggcaagtcctcactcaccaggccacacacacacacaccaccaaacaagaaggacgcagcactgtggccagttgacacggcttctcttaagttaatcagatttgtgtgtcaggccagatctgctggggcagcagtgccctcctgttctttagttgaggtcgggttgatgtgtagatttcccattacggtggtaaaactcaactgtgtttcttggagaaagtcgcaagtcactcagaacagactgcagccttgagctcacgaggggtggccctttctgtagttcacactagggaactttggagaaggcaggaacgtttcatcaaatgctggctgtaaagtgtgcatcctccatttagaagggcgtgatcgtgtggaaacgtacctctcacgggtccgcacgccgtatcagaggcagtgattacccaccgtggagatgaaaatgtgtgtgtttgcatacttgtgggttaaacaaagcaagatgttgaaatccctcagaactcagtttcaaaaacagatttagtctctcatatcagaaaatacagttgggaattccgcgtgcttgaagggaaggatatatttccaagtccaggaaagggagagtgatggtaggtggttttcttcacaacatgtgccaggtgtgatttatggcgtgtgtttccttggacattgtggatgaagtcctaggtgggcgtcctcagagcaccatttacaatttttattttaactctagagtcttgaccacaaatttaaaatgtaaatcagttttcttcctttcaaacataattctttcctccccgccagcctcccctacgtcattcagaaaacagaatccttttcaaatgatttttttttttcctgaatagcttgtgaaaatcaggatgaaacaataagatctacctttttgaaaatagccctgaagcagctgtaggcggggaccgaggcgctggacctcacaaccctgcagagaccaccttaagtttctctgccatcgctgtgtggcccgtgtgtgctattaatattacctcctagagatgacctccaggcattttgcattttgtttccaagtggagactgagcaactggcctgattttctgctttgtcgtatagattctgattttgtctcatggatttttttgaagtctgatcacatcattatttgactttctcaaatacatgtgcggcaggagggacgtcagataatttttccgagggcctgtgcctgctctctcagtcaaacattctttctttgcaaccaactgatttgcatggcgatgacatttgttgctccagtaatttcatctgataatggccgggcttgcaaagcggatctgaaaacatattccttaattatgtgttgctaagtgacaggagggtttggtcataatcacagaaagattatctcctcacccaagtcgtggaaaggttttgccgaaggaggaacctgtaagattgccttttcttttcttttctttttcctgtttattttagacttgccttttaacaaaaacattcgccattatttgggtatggagtgaggggtattatataagttgtttgcagtgtgattgctaacacgatgttttacagaccggaggatattgatttttacttaatttgcgtggcagcgagccagtgccagggaagtctgcaggcagaagccagccagcaaatcaaatgtctctgttaaatgatccaccccatagctgcagtttccctcctcattccttatcgtatgctgattgtggcattatcccccacaccctgtcgggaagggggcaggggctggcgtccctggtagcgcttcagctgtgtacatggctgtacgttttgtacagtaggttccacagaatccgcagtcacatttggatctgtcggagccagcagggaaagtagacggtgtgtgtgtggaggataatgttgacatttcaggaaagcacaggctgggcagtcccgccggcctctggtccaggacgcggccatctggaaatccagtgttgcttgtttgggacgccgccagcctgaacgcatcttcgttctggtgccgcctaactcaagtgcttccctcccatcggagggacaaggaacgcccttctggaagttgactctcttctccccttcgggatgggcggtgttgcactgcttatagtggggtggtttggggtttggggattgttttcagtatctattttattttcggatgctttggctatttttaatgtatgtttgctttttctcagtccacgaactacctgccttatcttggtgggttttgtgcatacacacaataggctcctatttctagtccagtttgctggccaagcagtccagagtgacaacgtgaggaaggcgtatgctgcggggaccccagtgcggcccaccagccccggtgacacagacaaatgggggctccaggcccgcgtgagtggcagcacctggcaggtggtggggtcggctgtcgctctcaggctgacctggccggctatggcacaagtcgcggagccctccggcggtggctgcgagccagcaatctccccgtgtcacgtgctgtcacccgagccctgcctgcaccagatgcagcagggatcatcagaaacaacgaacgaatggggctgcggccattttcatatctttgtcttcacaaaatacagccaagcctgcagcctgcacagggctcagctcaggacacaccctgggggcaaagtttcagatgtgagaaacgcagtcccagcccaaagagccacaaaaagatctttctgagctttttccattttcttccagccgtttttcttgatgcaactggattaatgggggcacatgtgacccctgtctagttgcttagggtcactgcctgaggactccaggatggagggaggagcgcgtggtctgtgtggaggggctgttgaggaggctgatggttgtgacagttacctgtcaccagagctggtcactctcatggcttcttttcgtgtggcctcggtttccagcaactggaggtgtgaacgctgatctcctaggtagaaagcacctccatcaataattttagccctatcagaatctgtatagagggtcgccgccatcggcccacacccctgctgctgagtcctcaagcagccttgcctcttgtttgagactcctctgcaccttgaggtctgtcctggggcagaggacgcactgctcttgagggtcttgacccttaaaccttcggcaggcttcccccatctcagagcacaaggacatttgggggtgaggtccaggggctgtgaccccaggctggccctgcagaccagcagagggatgagtccagcccttcctgtgtgctggccatgcagtccagccagagagagttgtaagggagcaaggaaacctcttccgggctgcccccaggacccctgagtcctggacacagaccactgccctgggcagagcccagcgtgagcttagaggcttgttcacttcttccttccttcctcattgacctgtcccctgctgttccttccttccttcctcattgacctgtacccctgctgttcttccttctttccatccttcctcattgacctgtcccctgctatgtgccaggcctgtggccagatgtttggggctcccaggtgggcaagacccaaggcttgtgtttaggtgctctctggtctgggggccaggaaaggcaattcataaaaggacagttaactgtgactatgtatagcaggcaccaagatggggcctgtggagcacctggagctccagggcttcttggccactcctatgcttggaagagcgtccctacagcgcatgtgtgtgcaccggcagggaagcaggagaagggcagagctcagcaccgcagccagactggggccaggggagaggccaccgcccaggccggcgtggggcagatggaagtgtgtgcgtgagctgtcgtgtgcaagggcagctaagggcctgactggtgttttgagactccctgtggcgtctcttttcttgcagagtaatctatgcctgcgtagtaaaaacattccagcattgtggagccacatagccaggactctgcccctaccccagcctggtagagcaagaacctcggcatggcctcccttccaaatccaagagcagctgaacggttcccaggtgctgacagctcagccttttctagcaaaacattgaacacacccgacatcagtgagctctgcgggccttccgtttggcttttgtacttgatcagtcattgggtttcatggcccggtgttccctgcattcagtgtgcccctgggcaagtcacctgctactggcctctgtgcctctgaggccctggttgtgactgatgcctgacctcctgagactcccagcccttcttgtgacctcgccagatcaccctccgccttcatggcagaacagcagtgatcatccctcctgcccgttgctgccctgaagtattcgcatcttggttgtgcccccttaccagactgaactcagcgagtgcctgaacctggcctcaccctttgttcatggagctcattctgctaggctagactgggtttcttggtcccctttcaggctcctggacgtgccgtagaccccaggaatatgatttcagcccaggagcataaagtagttgaatgcatggcccgaaggagtgccacctgctttgtgtttgggcaagtatgttgagttctctgtgcttctatttccatgtctgtcaaagggggtaggtcttgaacctgtttcctctgcttctgggagagcagtgagcagagaaggaagagagggcttgtgtgttgaggttggagctgcctggcctcagcggggaatggcgcttttcttgtcgtggttgacccttggcctcttctcacactggactactgaggccctcggggtctcaggggccaaacttgtcccccagctctgccgccttcacagcacttcctctgaccccgtgggtgtggatttcattctgtccatggaggacgtggggtgagccatgccgggacaactagacagcggccaagctgctgaagaaggccctgctgtggtcctcagttttgtgcaaagactgctctcctaggcctctgtcttgttaaagcttagtgggccttttttcaaaagtgagtatctgggaatttctgtaagcccaccttgcatagagtgtgtccccctcgacagcgcagaccccctccacactggtgggtgggtgatctgaccaggagtctggccagagagtaacgtggatgcttggtgtcagctggctggggtcgtgagtctcaggccttgtgcgtaacaggctgggctcctcgccgcatctggagagctccaagggggaagaggtcgacaaatgatttctgccgggcgtggtgcaggactcagagcaggtggtgaatgaggtcggcgcttgctgttggtttaaagggattgacccgtgttttcatgggaggccatgtcagccaagactgctgctgggaccttggccagctctgcccgcgttccagtcaccagaccctcttctgtctgtctccacaaggcccgcgttgactgacctcctcatgtctacaggggcgttctgtcttcctggtttagaaagcagttccacatggagtagggaggtcttggccagcggaccctctgctttccaggaagcaggtcatggggccatagcttcagtttctagataatagttttgtgtggctgtgctgtccccatcccatccccccaacccccacccagtgctgtgagaaccacatcacacctggaactctgtgcatggccaagctcagggcctcctaaacccctccagggattgttgctcctctgaaatctttaaaagctgttgatcttggccaaggtatggttcctattttcctggaaggtttgcggagccaagggcataagtacctgagcagattccacagaccaggtgagtggccccatgttcacctggccataaaaacaaccaatgggcccctacgctattttgctttaactctactttcaaatgtggcctttgctcttgagtgtccagtgtccatcctggggctccacaagtcacatttcagctctgtcaacctcagtgcttgagttgagggtcttcctgggtcatggggcccaggctttttggtgtcaggcacacagtttggaaatagttctcccccattctgtggttgttttttcaatttcttgatagtgtccttgaagcatgaaagttttaatttggagtcttacgtatttgcttatgccgttggtgtgacatctaagaaaccattgcttaatcgagggtcatgaagatatattcttatgttgtcctccaggaatgttagttttagctctgacattgaggtcttgatctgctttgagtaaagttctgcatatggtgtgaggtaggggtcccattcagccagttgtcccagtgtttgctttgtgctttgcagaagctgagctgtggagagctgggctgggtagagcaaaattagagcttcacgccagacttcttgcatttggaaactaacattctaaggaagaaagacgtggtttttttttttaagtgagaaagccaacatatattaacaggaaagcttttcaggtgtttggcacaaatttatttacccccaagaacatacgaagccagaattctaaagctttttcacagattccttgctcatacgtgggagaggtttttttggtaagtttatgaaagagaaatagtacttgtaatccataactaattagcccacgttagcgatgtagaaacgagtgtgattaaacgtgcagttgtcaggtgtgtgtttcccactctgaggctggcttcaacaaagggctttctagttgttttttacataaaggataaaaaaactagccttcgttcacttttcttgccccctccagtgggagggaggaactgctgaaggaacaggaaggtacactgtagttaaatttagcccaacagcagctttcagcatgtgaataaaacaacttttgccaaattgttaggagagcaaaaaatccaacctagaaacacccgtccccactgacagagtgggcggccccctgggacatgttctcctgagagccatggagaaattcatcccaggagggtttgcaaatgtcaatgggacatggggcagcctgtggctgagttagcaccctgggtgtgcttcaccagaaggggcaagagtaggaaccctgattcctggtcccccaatgcagttgtgtgggatgccagtggcgttggcggggagcgcgtcctgcaataccagctagatatgaacacggtgcctccgcagggctggtggggtgcacctaccccaggtggcccatggaatgtgcctcttgcccctttgccagggccgaggtaggggaaaccagccttgagagaatctagggccctgactgagttcagtaaatattagtaattgtcactattgtggagtttgtttgtttgtttgtttgtttgtttgtttgttggttggtttggtttggtctggtgctttttttggtttttggtttttggtttgtttttgtttttttgagacagagtcttgctctgtcacccaggctggagtgcagtggaacaatctcggctcactgcaacctctgcttcccaagaagctgagaccacaggtgcccactaccatacctggttaatttttgtattagtagagatgggatttctccatgttggccaggctggtctcaaactcctgacctcaggtgatccccccgcctcagcctcccaaagtgttgggattacaggcgtgagccactgcacctggcctattgtggagcatttgacaaggatgatcccccatctgaaatcccaggaagactctggacatttttcctctgacagactcagagaggttcaccccctaccctgagtcccacagcagggggtggcccatgccatgatgatcctcaggcacggtgcattagcacagcaagggaaaatcaacaatggtatacacttggggaggagacaccagtccgagctggaagccaaggtctgtgtcagcaagaggaaacaggacaaagtggctgggctctggagcaagagtcatgacgggctctggagcagcagtcatcatgatgggctctgaggctcgcttcccatgggtaacactggggtgatggtgcccaccctacctgccccccacggctctgagaaccgcatcacaccggagctgtgtgcatggcaagctcagggtccccagctggctccacgagcacctgctggtgtttgcctggctccagctgctgccctcaagaccatgctgcatctgagctgctccgactgcggggccaaactccttgccctggatcatgctgctgcctgggagagttcagggaattaattctcccagtgaagagcaaatgccattcttttgtgtgattaaatggaatgtaaaatgttctttggtcataagaggatttaagctggctgttgggaacagctgtaacacacacaagggtaaagttttaataaatggaaaagtaaatgtaggaaaaggtgagggagggtggtagggccggaacacagcatcccgtgcaatcctgtacacaaggataggtgggaattctgctctgagcttcctagcaaccaaagaaagagggaaactgatcacatagaagaatcacactgcatgtaagatgggaccgatgaacccgttgctcagaagcagaggtgagtttctcctgcctttatcgcctctccaaagaagcggcatcagcgctggtttgcagtttgctttctggcattacctccctgctcctcagcctgcaccttcctccgctacccgtcgacagcctcctgcgtgtcaccttctgatttcaccagggcctcatcctggttgaagttgttaagctcttcttgcactttggctggatacagtcagctgttctttggcgctgacttcccccggggttcctacctcctcttctggccctgcctcattaagggattgcattaagggatttttcgtggtggaaggaagctctgcctgcggaactgaatgttggcaccaactgcccagcgcaggccagtccattccccttccatccacagtgcttagagctgacctctggcctctcaacccaacacgtttccccactggggatttgcctattagatgctttttatatgaaggaataaatatgcctttgtgatgggttctagtgttttcctgtaaactgggctctgagcctgggatgctgtagaagttactagattttaagaaaaagttagagaagaaagaagagtggaggcggcatccagccagctgttgtgctgagaatgttcacttcctggctgtgagctgggcctgggcgcagcgctcttggcccttggcctgccggacagcagtcctcgcggatcactttcctcttgggttttaggaccactcgaaaaacgagagtgtgctgcaagcatgaggcttctccctctcccatctcagccttggctgccatagctaaggaggagggtgttattttgcttttgtggacattcaccctgggaaataaggtgagaaaattaagactgggtctgccaggctacaggctactcagggtccttttgcgggaggacgtgttgttcatttctctggaacactggtggaattggtccatctgattccaagggacaagccagcagccagggcggccatccagagggctcctggtcccggcactcatgggcagccatcccctcgggcagtgactcagtggtggcccctggaacttggcagtggcactcggctcgctgcaggttcatggaacatccagggcgtttgccctcctggttgctgctacttcctgtaccttggaggaaaagtcccttggggcactgggaagggtgggcggggcctcatggccttcctcagcctgatcgggacccaccaaagggtcccagaccccagtctcactgcaccctgaccatccccttccccgtcaccccgggtggtgccagagcctttttgtgaggtgcagggatccgggtacccagcgcacagtaggcgttctcaaactttcacacagtgagaagtcagactgagccatccatctctgggttgcctgtggcctttttagattcctgcagaatctcacccagccccgtgtgtgtccacactggacacgctgccagcccagcacccagcctcttgtgcggccggcgagtgagtgtgcagcagctggccgctctgccagattcctctggcaacaattcgtacttttctcttctctattttcccttatttttctcaaacatccccttctgttgttgtcaggggcacatttttagaacttgagagctgttcacccaacacctccaccagcggtatccacacagcgggcgggcgaggcgccttcttggaagtgcttcggggagcactgaggccagcccatccctcctcagcctcgagccagagggagtcctctagggtttgggctgcatgggcttccgggacgccctcccaactgcaagaccgggagtggacggagggagccctgggagcccggctgtggccccagcgaggcaggggaggatggccaggccacaccagggaccgcacagcaaaggctctgtttcaaaaacagacgtcacgtttcctgcttgtggcctgtggggttgtcactgattttttgcattgatatgaaaaccagcagtgcttcttttccatctgggccatggctcttctggggacagtgcaggactcgaagagaagctaatggccttgcttgggtggggatgactagttttttcttttgtgttggtcacttgctggcaagcgggttttcccacctcactggctggttgtccagcagcgtgaatccgctgcctgagaagtgagtctccaaacaatcacagcgggactgaccacgcaggtttccccattactgcgctatgaagctccctcgggctccggtcactcagacctaatgtcgaggaacgtggagcacatttttttcctctacccaaggaagcagatgtgtggtagctggtaaacatcctccacaccgcagagtatcttctaggaaaactgcctggtacggggagcttgggttgacgaacgctcacttttcttggtttttattcgcttggaggtgagatctgatgattggcccttctctctggttattgctgaaaaggacagaagggcgtccctgccggccaaggcggctgctggtggctcaacctggagagcctggattctgagcagccgtggtcactggtcttgtccaccacggctcagaactgggtgaaactcagctccccaaactcattcttcccgagactttaggggaagtgcttccttccaagtcagtgctttctggagggctggtgttcccgtctcggcaagttctgcctggccagaggcctacgggctcaggcatctgaggcacagggcatttgggccatttgccaggaggccgccaagaggttgctccccgtaaggaaggtcaacctcgtgtgcattgaatcttgcattaaccctcttagaggccagtgttaagggccaagttgacatagatccatttcttggatcaggtgtttgttttttcagttaattttttagagccaagtctcactctgtcacccaggctgaagtgcagtggcacactcatagctcactgcagccttgaactcctgggctcaagggatccacctgcctcagcctcctaagtagctgggactacaggcacgtggcaccacgcccagtaaattttgtagagatgggatttcactgtgtcgtccaggttaggacaaggtttcttatcaccggggccatgaatgcctgctgggccaataggacaccgtgaggaggaccgtgtgtccctgcatccagcttggggagtggggccagcacacacgtgttactatcctgtggcgtctcggtcttgcttggatgtgcccttctgttctccgccgttctgataacagttaccatgatgacgtctcttttaggctgcaagatctagagagacacccgggtgggaagagcgcatgcctcacgtgagaagcctcaggcccttggttcttgattttgtgtgcctggttgatagatcgaacaatcacattcctgcagtaaaagagagagaactttaagacctacctcagcctgccgaggcaagatcacctgtctgtttcctagggccaggcctgatgatgtctgtctttccagtgtccagagcttgttgagttgaaccaatccagcaggtggtttgcactgcggtggaccctggggttgcatgcttggtctctggtgtcagagagacctgagtttgagtcctgactccatcacttacttgctgtgtgaccccgggcaagttccccccgcctccgttacctgctggggaaacagcagcgcctacggcacagggttgtgtggagggtgcaagagaagtggccgtgaccatccttctaaatgggacaggctgtattccatggtcatgatgctcagcatatggtataaggagctaactgtttaccatccctttgttaccagaaacttgactccctgtgtgtttgggttcttggtgcataggtgattttattgctgcaataaagtattgaaaaccaattaagtaaaagaggctgacggcagcggtgcccgcacgagactattttacaacttcgggcgtttccagtctcaggtatttccccagcttccaggcacatcctgggaaagtctagtctgtgtctaattactgtggcacagaatgcaccctgcccacatgggatatgtaaagtaggggtatcccaggcggccccttggctacaggcagctggttttcattacaggtgaggctgagcagatggtgggcattcttggtggtctttccaacaggctccagaccacctcacaactcggagcttgggcctttgaactgagaatctcatagtttaggagctgtgggctggaaccacatgctggcagctgccaccctcgagacagaaggcccatcgccatagtcatagcattctttgctgctggctggcagcttggagaggcgaggtgggcacctcccaaggaggaatgagttaggtggaccagccagtcctggttttgacgactgagttcaccagggtgaacagatagtcatatgggagcccctttttgtccttggcaggtttgtgcttcttttggccgggcgcggtggctcatgcctgtaatcccagcactttgggaggccgaggcgggcggatcacctgagttcagaagtttgagacctgcttggccaacttggtgaaaccccatctggaaggctgaggcaggagaatcacgtgagcccaggaggcggaggttgcagtgagccgagatcgcgccactgcactccagcctggacaacagcgtgagactccatctcaaaacaacaacaacaacaatttttagtctttggcgatgccctgaggctcatctcttccacagaggcttggaggatcggccacacgagtggggtatgcagaggcacaggcaggtgggggagtgagaaccccagggcgcatctgaccttggcgtgccggcaggaagagaacaagcagtcctcctggaagattccaccagaactgtttattggacaggggactcagacgatgtgtgtccccagccacagtggtggctgagagtgtccctatcctgtgcatgagatcctgaccacccgtccctgcagggaccgtccccgtgttgggaagcaggagggtatgtcgcagagcctcacccagtgggagccacaatccttattccttgctcctcaggcttggatgttgctccggcttctatcccccacatcctgtcctccctcccggagcccagggaccacccatgtgaggctgggccactggggaaatctcgcacacgtagcgcgtctcaccagaaatagaagcagagcctcacgtccttggctgcttcgctgtgggaatgccttctaaggcgccgtttttggtgatgtcccttcacggatctttcaggcccagtgagtcagcagtgtctgcattcacacaggctgggtggggttgttggatctgccccgggtggatggcacctgctccctcagggcaaaaattcaccccagaacatgagctgcacccggggttaggtgaaggtgacggagcctgaacactcaacaccagaggcagccaacaggacggtgtctgggcttccaaaaagccaccagtgcctaaaaacactttcaagcacctaacatcactcttggttttgtttttattttaaactccattacaaaccgggaaatagctgtcactttcctgtgttctgggcccgctgtgctcctccgttccgcatagcgcggacactgcagggtgcgggctgcagcttccccaggggctctgaggaacccgttgaagtgactgcacgtgcttgtctttctagggttgcagatgagcttcgttttcaggggggtttgtattttgtgttttttctgaacttgatggtgtgggtctggacatctctttccaaccctggaagataccacacatgctcttcgttattaacatgatcacccagaaagcttttgggggcctgagaacatggcccaggctctggggagcatcagactgcacctgactggctggataaagacaggggtacctggagcctcctgcctcgccagctctgtgtccagctgtcacctgagctacaagggagattacctgggagcctctcatgtgtcacatcgtgactcattcagatacatgttttatttaagaagcaaatctatttatcagggtgttcctgtggccatttcttcaccaaacctccagctgactttgcagagaatgccaaactcagaagccgaggagtagcttaaaactaggttccccatggggcacatccagccttctggggagcccacttggtgtggggcaccccaaacagcacagcccctgggtgctcagaggccttggtgaagctagatttcccaacactcgattttttccctccttacagaaaagcagggggaacttgagggataattcacatgaaacctttgccataaacccttttaaattgttcacaagtaagagcccaactttggaagattaagatcctggcgtttttagtgtgaggagtgggctggctgaatatgctgcagattgtgagctttttcctacctggttgtacctcactggaggaaaaataaggataatccctatagctgctaaggatgtacacggtgatggcacagccatcaccgctttctaagtttagaaggtgtgcttcatgctttaaattccccggcactcattttgtaccacgctgctctctcattctctcctcatgctgtcttccagtgcctggttcaggccagtccttgtccaaggttgagttaaatcattttcagctgggccaggtcttcaacagcttggtgtgtgtgatgccactccagggctgaggtcctggcttcaggaagaatgtggggatcgattagtgatgtctgccatgaatgcagaaagagagataagggttgcgcatttgcattgcatggtgggaggaggagtgtgcacatgagccagggaatctgttgggcgtgtcaggtgatacttaaaactcaaggattgggttctccattctgggggagcacatactacctatacattactgagactgtaaaatgaaatcgcagcctctgggaagctgggcaaagaagtggacgcagcattgggagagcttcccagaagcaacacagagagaaagcccatttgccaaatgaaaaagcagataacaacgtagaaacaaagctgagatttccaatagcagttgctttttttttttttttttttttttaaccttaaaatagtgccactcttagcaacacagattttcttccaaattatgccttgaagctgctcccggagccacccgctcatcagcaccctgctcctgtggtccttctcgtgaaaggcagaggggagatgcctgttgcccgcagtcttctctgcagctgccgtgggaacaggcaccttcccggctgctggggacacaaggagggggagtcaccgtggcttgctcactttccagatcagccaactgcagaacatttgttgttgtttagatcccacgtctgacggtttagaacagcttttataacatggttaaacatgtttacaaagcaagggagacatctcttaccttgacaacacgaggctcccacagaccgccttcccccactcagagctccacagccctgtgtgctgggctggcctgtagacccactgaggcagctgtgtttacaagtctaacgccaagtgtctgagaggcacttgcgtacgtcccagcatcagaatctggcccccagcttggccctgtcacgattttcagttttatgttgtagaaacccaagcctctgaaataacactgttagcaggccttagttctgattctgtgtctggctttctagaaatcaggtctgctgagctcagccagtggggatcgggtcatgctggattgcagaaagcggccacttaattggggagcaggccgcatttaagaggaagcttttctgagggtggtgggatcggtgggatattaagtggggcttccttggaggcaggcggggcctcaggttcggctgtgttgggtcactccctgtcccgccccggcctctggagtttgtgtggttttgtctcctctttcttcctggatcattgtgcatgaggctgggagccacaccggctgcttaggctcctcctgcctcccaggccacctgcaggtcacaggggctgatgaagccgtgaatcgcttggctctgtttggaatgctcgttccccggtgccataaagaaatagcacttgaacataaatttaatttacttagtaaggccatttttactttctgcagaaagggtacactctccagcagttttcccacgagagttcacccaacaaaggacacagggtcatttataacctgacacgtccaccctaccgctgtgtccagtttccgttggctggaaagggacctcacattctctatttgtcccgattggctagcaacttagaacttttttaaagaggcaaaggtagaggggaacaaaggaaggaggaagtaacttgtggaatgttgagaaaggtaaaaacaccttcaaataaggaagaggaacaggctatgacctaatgcttgcttggaccagtataagcatgctaaggcaaatatttaggctaaattgcgggagctaagaacataacgtacattgatttccttattacggctagcaaatatttaagaatgttagcacagatctttgaataaattttgcctctaagagaagttagtatttattcctaattagacggggaggaaagtctttgaagaggaacctctgctttactctgtacagctcggagctgcttgcagcactctgacaccttctgtcgggatctttggaagacctgcctggatctcccgtctgtggaaggatccaggtacttcttacaacatctgtgttagggcagctggtgacggcacccggcaaattccagcaactgccctcattccacagaggctccctcctgcaaggccactactgtgactctgagcagcggttcttctcatgaatgtgatagctcggtcagctctaagactgcaacctgcagggacttcatggggcaaccctggggtatgtggccagtgtctgtccttgggcagccgtagcccctgtcaggaacagggagtgactcaggcactggtgtcttgagactgctacggtgtcaggaaacttccataaaatctagtgcgttttaaaaaaagaggccagagccggccaggcacggtggcttattgcctgtaatcccagcattttgggagaccgaggcaggtggatcacctgaggtcaggggttcgaagccagcctggccaacatcgcgaaaccctgtctctgctaaaaatacaaaattagccaggcatggtggcacatgcctgtagtctcagctatttgggaggctaaggcaggagaatcacttgaacctgggaggtggaggttgcagtgagcggagatcgtgccactgcattccagcctgggcaacaaaagtgaaactctgtctccaaaaaaaaaaaagccagagccagcctttgcctcctatgtcagaaatgatcatttgcagctgctttgctttggggtagaagcctcaaatcctgaaaccctttaccctggggcaggttgtcttgtgctgtaagcaacagaaacccatttagatcatttttaaataatgagaatttctgttggaaggatgtcggcttagctcacacagtgtctaggaagactggaaaatgggtctcagaaacactgcaggcagctttgtgtggcaggatcaatccagttccttcttggtgactgctcaggggaacatcccatttgccttgcatggtactgagccagaaggtcaactccaggcctgtctgcctgtatccgagaaagcagcagctccccacaatgaaatgtagcgttttccagctccggatccttccgccatcctccctgagatctacctgccttaggatctgtgagatccacgcactttgcttttcctgggtgtctggttactgttcacaaaagtccagcagtttggcctggtgttgtctttgtttttgactgagcatctctcatttcacaagtatttattgcagctgcagctctaagcaataccaggcccagggatgggcgtcagcactgccttgagctggtgcacagcacatcccggacggaggggcagggccgtcctggtgcacacgcaagcctgaaaccagatagtaattgataccaggggagccggcagggctttctgctctacacagttaatgtgggcaagctgtcaacagtaaggcactgatgtcatttccgtgatgtgtccagttgcagctggaattgtcctgaaatggacaaggcaggtttactggcgggagacggtagaaaggaaaaatagcgcatagagggcaccagggccctgtgaccctcgtccgcaagtgtctcctcatacctcgtggttgcgcaccgtggtacggggccaccctgagcgctgactcccgggctgtgaagtgggaagaacagcagcactgcaggactcttgtcagccttgtggtctgtacgcatggaaaaggccgtcagctgtgcatagcaactggaagccatggctttttagcataaagcccagttcttcggaagccctcattacgtactgcgccttgggctttctcctcgcaaattcccaatcctgccccactgggcctggggaccccacgtccctgaaagggtcgtgttccatcttaatgtatatgaatcttactctgtgtgtcagttacatcctaataggttaaaaacttgctcaaatggtcagaagcctgaaagaggcgtcaggaatcctgtgtgaggtaagatgggggatctgtttgcaccttcatctctccatatgagatcttccatatgagctcttccagaaacctctgccccaggctccagcaagcctgtagggcagcggctgctaggcaagggcttgaatttcagtccagattctctggtgtgtgggtggacagtttccttctgggactgaaggagcacttggaagatggtgctttcccttctagagcaaaccttggcattgtcccagctaagctctcatgcccagggcttgggggtctcctgtggcctccatatccctgcacctcatgcagggcacgcaagcatcccacccactcccaaccccccacctccagccgtcgtgcccggcatcttttcccagcatgagaacccgttggcttttctcttttcccgccttgccatgaaggacctgctgccaggattcgagcctcagaccttggacaggtctcgggccagcctcagccacgttctgcgtgcccggccatcagggagggtagagggtgggtttcaccaaggagaaaggcaacccgtgtcggggagggagccgatcgctaggcaacctggagtttgttaccctggtaacggatccatgcactgatgatgctgcggatggacatcttgtgacaatggcctctcaggctccccagacgcatcagcggctctggattcccaccttgcgcccagcgtggttttcctgtgtggctaccatttaacgaacagcttggatttcttataatcaggcactctctccgataaccatcctgccagcacccctgaaagtgaagttggggtgttcctcactgtgtgtgggcgaccgcctggggcatgagaccaggacttccaggccccacagggttgtgcgctcagacctcaagtaggggccagaagagtgtactgaaacagaaggaatcttgtggaatttggcagttgtaccattttcttagcagaaaacaggagcccaggtgggagccatgtgtgtcgggttcctcgtcaggtgacggtgctgttgcggatctcgcggatgagctgagggggtatccagctttgtgctgcacgcttcctgtccactcatacaggtcgtgggctggtgaggacacgggggtgttggccctcgtccctgccttattttccccctcccctgccctgttttcctggtgcagaaggatgttggagtgcggatccatgcggacaccctgtttggggacctgggtgtcggggcagcagcaggagtgactgggtgcacgtgtgcctttggtgtctgagcgtcaggtgcagctgccgctcagggctgagaggggccatgatttctcccagccgggggtggcaggagaactgcacttagcttgggggccatgcggggctggctgtggacctggctaccccagcccattcttctgaggctgggacaaaagccttttttgtactttgtgctcaaagagacaattatcccaagtcccactggccgagcacggccttccatgcagggctggtgcaggtgctctgggccgtccctccccagcaccgtgtatagtcttaacaggatgcagtcacggccccagtggagggggatttccttcctcgtctccgagcgtgtggctaacggaatatgagccttggtggtccagcaggagcccccccgtggctggggtcccagtcatcgtccccaccaagtggccagcttggggactactaagagcccttgaggaggttagggatggaaggcgaggccacacagatgaagttggcctttgtggaaggctcctgcttttgcctgtgggaccctgagcctgctgccttgtgctcaaaggccagtgatcccgggaatgtcacaccttcctggttgggttacccatggtgggtcaccaggctgggctcagcctggagcaatggcctggaccgtccagcctcagagggagggaggggatggggatgtaaggccgccgtcagggttgatctggatatctgaaaagttgatgagccccaaagttttaatctgaggctaaagagttctaatttgacaagagacattgccccttcctggcatctcggcggattgcacctctggaactcaggtagttgttctcttgtgtccagggtgtgggtcttgaagatgtgaggtttgggcagatggtcaggaggacctacgaaatccaaggatggatttgaagggggcagtttttgttggagaaaatgctgcttctctgtctctgaggtcttcggagcctgctgggtttgctgcacagaataaagagagaaaagaggccctgaggctctcgctgcatcctgggcgggccccgcagggtgtctgccctgtatgtgcacggggcgcaagcatgcgcgtctgtagtgtggcaggtaaggccttccaccaccctgctgaacgtctagatgcagccgcgctggtccagatgaagttgctagagaatttgtacttggacttgtgggaaggaccactggggcccttcctggggtcacccctgcccctctgtcctcacagctgtcccttcaccttgttggcagcaccaggaaatctgtcaggattaatatgatggctctggcctgtctagagagctgcttgctgtgtggtcctttgagaagtttgctctcctgagcccctagaggcctcctgccctcaggcataccttccctgccccagacccgccatttctcctcacccagcgcaggtgagaggggctggaggagcctgcccaggccgcctgtttgtgcagggcctgtccaggaagttcctttggacgcacacgccttatcccctgtcatagtgtgtgaggggcagctggtgccggtgcaggcagggaggcacgcggtgcagggacccgtcctgtgctggactagcctgtgctggcctcggggccccatggtcctgaggctctcgggactatggtctgctggcagggaagcagccgtgtgcgtctccagccagagccgcaagtggatgggaagtggctcctcttcgtgtcagtggctccctggaaggtgatgcaggtggaggcggtgccctcgctgctccgccaccctcgcttgcccaagccctgccctgagtgatgagtggggagctgcccctccacgcaccctgtggccccagccacccacccactgtgctcaccccttccctcctggcaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggtgggcccaccctgcccggccggggcctgcactgaccttgggcagtttcctccccagcatccccccattagatcgccccaagtcaccggcaggccccagaacccctgttccctgctttcctgctgaactcctctgcctcaggttcaagggtgatagggccagggggccaggccaagtggtgccggtgggctgcacggggtggggctccgaccctgtgctctgttcccacgcaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggtgagtgcgaggcagcgctggctgcctggagttgtccggagctctgtgggccctgctcgggtgggcttggagaagcagctggaactgggaccacggagcagccgcttctggctgtagcaaggtggctgcctccaggccgggctgtggagcaccttgcggccctgccttcacatgacacaggtaggatagtccctgctggcccttgtgtggggtctgcggggctgtgaggcatctctgccctcagagcaacacccagctggcacaggctcaatttggagacacccagtgccgcctccagaggggagaatgcgactggccacatgtcctctaaaccacccctgctgggtgcgtcccctaaatgacccctgccgtgtgtgtcccctaaactgcccctgccgtgtgcacagctctaggcccctgtccacatgggaacctgggcctcccgttctgggagggcagccttagcagcatgtggtccaggtcagcaccaaagcaggtgggcccctgcccaacacagttgatgacagaggcttccgaagaaaagcagaggcagcaggcgggaacccagagttgggggcttcaaagctgcttatcggccccatgcacttgcggctgggggtgcatgttgaggggggcctctgcccagcaccccgtgtgagctcgtgagtgctgagtgcagaggcacaagaagcagaccgctggcatcgagcgtcctcgggagagggccaggtgggcactgtgcttgctctgtgtttggaacacgccacccctgcattttgggggtgggggctgtactctgccttacgagtgctgaggtgccccaaattcatgaggcaccatgaattccaaggcagcagcctggccttggaacagctcttcctgtgctccaggaatagcccaggcgctatttccccacctctctcccatcggctaaggccccagtgggccccggtgcttccgggacgggctgggtgtcagatgggctctgtgtgtgagcggagtgttacatacatctgagaatcctgctctcgggcaccaccggccacgttttcagggaggccacccccatgggctccagctgtctctccacagccttagcctggggcatggagtgtatgggtcagaatcttagttgaatccttcacggccagtcggggcagcacccaggtaccggaagcactgggtgggtcttggtgtcaggagcagggctggggagccgggcgagcagggagctgcccgtacactcacaggggtcaggacgcagtggggtggggctgccccacgggcaaatcccaaagcaaaaggccagggaaggagagagagtcactcagattccacaccccttagggtcctggaagcagcagcttcacacatccacccctcaccctccccacacccctcacttgctaccagccacggcgtccttccgagcccctctgttggaacaaagacactccagaagatgtgagtcttcaaaggcgtgtttaatataaactaaaattttccatctttccctggcacaaacaaggatatttttgtttgaaaacaaatgtcctttgtgctctgggtagagctgaaatcccaagtttcaacagcagaggagaatacagcttcatgtgccaggggctctcaaatccttgtcccccgcacctcttgcttctccagcacgtcggcccctcaccacacagctcccaggcccatacgggtgctgaccctgcccttcctcggctggaccagacgctgctttccagggagagaggggaggtccttgcctgtggaacttcctatttctccatttctagaagtgccccgcacaggcagtggggccagaaaggcaccaaggcctcaatgacagggggcctgggagggccgagatgggaggttgtgttccctgagttctgagacccacagaagacgaccaggaccagggactgcggttttggaaaatgtagaagggctgtgagtggtggattttcattgatcctggtcccatctgataagggcgcttggaagacatctgcggggcccttttaaagggcacttttcgaatgtagactctggaggcggaaaatgagcctctgtccagacgtcctttgtctccgaatgcatattccccacatcatgcggtcaacgggccttttgtgctgagggctgggagcggcaggtggctgcaggcaggccctctcctgatgaaagagggtccctcgcaggcccagaaaacaaggccctccatgttgcacgaggcagcacactaggcctctggtgacaccttctgggatcgcaaggctctgagctgtcagccctggaatgacaggcgagagtcagcgcttcacggcaagagcagggcaaggcttgaggaagctgctcacctgcacttctccccacgagccgggaagacctcgagagggccctacacccctccccacccccgccgcctctagcaagctggtttatgtggtttccttgccagcggcagtcatgaagggattaaagcacgatggcactgaccgtgagagaaaagcagcttgcctctttggggccgttttccaggctccgtggatgctgggaggcccagcctgcgagtatcagagccacccatcgtgtggcacttgaaggatcagcttgactcatccagaagggaggctgcatccacagagcgatagaggacagctaagaagatgctccctccgagagagcggtgagggttatggaggttcctggcagtggcgccgccgcggtctgggtgggaaggttctgccatcccaggcagtggctgcagctcttcctcctgcaccatctccccgtcctgggactctgcactccggtgagcagtggaaccacggagctgaatgtccaagttcggtgagaagactgaccagatgtcctgcctcaacctgcctttttgtgccacccacccacccgggtgcctttacacacgtggccttgtggggtctcccagccagcatcagctcatctcctaggaggaggtgctgctgttgacgccaggcagcactgccgagccagccccggcagcagcacggagccagcgtccttgagggtgattctgctgcggggcctccctgctgggctttagcctgcccgaggaatgaaaattgtcccagccgccaaagattttcttgaacctctggcatcagcctcagtctgtctgacttaataataacatggcatgtgatcaagccccagcttctctgctgagctatttcaaatgaatgaggccagtttcctgcaagattcctggcatccagctcgtgggaaagttggtcggcctcagtcaccgtcaaccacactggtcccttggcaggggtcggtggcccagaggagccctcagtggccacgttgggtgggtgggtgacctgctcacagtggcttcaccttctctgagctgtgtgtcttgctaagcgggtcactctcaaggccctagacctaggggtggcccttgtggggagacagccacgcagccatctagaaagtgggtttgtggcacccactggtcttgtttcctgtccagtagagccgaagaagctgccttggtgattgccgtccccaccccaatctgtccccaccccaatcttcaggacttaagatagaggaatcctgggctgccttaaaggtggccctgtcccagtgccttgggcaccccttgctgggagagacactctcctaagggtcccaaagctgggattaggagggaaccatttcacttgggctgacgtgatgcccagatagccacacccctcctcagagagctcaactgggagccacaggctggctgctgagcccaccctctggggccccgcccctggctcggcccctctggtctctgctgcaagcaggcctctggatctccacctgtcgggtgtagggaggggccgttcccagcctggccctctgcctacttgcacccctgttgtatctggcagtcattcattcttccccagacaccctctggctgaggagggtaaatggcagggccctttctgcctatgacttgggttaactctccatgccacagctgctttgtgctgggagatacttgaccctggtctctgcagctcgtgtggggccagagggctcaccccaagccaccctcggccctgacctgaaggctgctccacggggcagggagggcatcctgtctgctctgagttcttcccagcagagcagggtgctgagcacatgaccacagggcgattgtgcacacgcttcggccatcggttccgttcccggggccagcccttgcatccgtgtgggggtggaggtgtttttttaaaaccagtatgtttaaaacgtatgttttttgcatcaaactgttagcatagcttaaaaccaaaagccattctttgtcaccctgccagctccatgagggagaccctgaggggtttgaggctgagtggggtccacttggaggagtctggtctgaggcccactggcttcctgccactccgggtcctttcttgggactcagtgcaagcccaggaggaagccagtcaggcccaaaatcagccataggagttgggttggtcatgagccacgtcctggagcaaaagtcctccttgggagggaggggtagatgttggggctagagcttcccatgcatcagagccagagggcctaccgcccacgtgcccagccccgcgtctgctagacgataaggtgggcctcccccggtgccaacaaccgagtctcaggagggcgggctgggagccctggggcttccccactgatcttgaggttttctcatctccggccttggcctcatccctttcaggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtacgtgccaccctctgcgctgacccccaacccctccgacactggggctggtgtagtggggacccctcgggaaaggcaaccccagcctgctcttgaggagccagggcaggcagggccagcaccctccccgtgttgcacggggtaggagatcggagtcaagacccatcaggcaactcaccctagaggcaggatctgggctggttctggaagaatgcgtgtccactgctgtctgtagtgtctggcaggacagcattctttgctgtggggcagcgggcaaggcgctgtgcccagtaaatttccctgggcaggggtgaagggcaggggctgtatggaggtgtgtcgtaaagcagcagccaggcttggggctcgtgtaggggctggcgtagggttcagtggagacgcgggttatggacatggcctcactcctgaaggccttcaaatgccaggttggggtggcacagtcaggccatcagcttggaaagctctcctgagagaggggcaggaaaaggagacgtgaggagaggcccaggagggtcttcagcagggtggtaggggccggtgccacggagaaggtgatggtaagcagcctgattccatgggggctcgaggaggtccccaccctgctcaccatcagggtccacaccacacccaggagacctcggcccattgccactgaatctcaaccccaccgcttaccagctctgtggccttgtgggaattacctgagctttttgcctcaatttcccaatctgtaagtagatatttggtgggatacgtggtatctgccttttgggactccaagaaggcgcatgtgcacacggggccagtaatgttctggcctccgggagactcccagctgctgctcagcccttgcttggagctccgcgcctccgaggacgaagcccccgtgctcctctccccacaagccccgctctggacctggggtgccacttgaacaagagagaagttgctggacgcttccaggagtgcacacctttctgtccccgctacaggctgtgatctcctgggtctggcctcgcccgacgcctggagtctgagttgaagtgtcgggtgctggggatcttctgaaaggacccaccgtgttttgactttgttggaaaacagatgtggtgtgtgaacaccaggctccctctgtccgggccccactgggcctcatggctcggagatgcagcttcatctccatctctgaagcccctcctggggcctcggtggtctctggccaggctgcagagcctgggggtggtcatgagcaccctgggtacacggtggggcctcactggggaggtgcttgtttcaggggcttctgactccagccgtcacgggacttcttcctggggtcgttcctgtagctgtgcccttgtcattcaactttaaaaaccctctcggtgtatagaggtcagtgcagccccctgccgccgccctgttttctcgagactgtacactaacccctgccgccaccaccctggatcctcagcacagggactgtcgtgctctccttgttccctttccaggtgtctctgtagccttcaggactgtcgctgctgcagccatcctgggctaagagcttttgctggcctcgggttctactgagcaagagtcccccaggcccagcgggctcagtgcagcaggcggggtgggacggtgccgccaagagagggcagcctggggctgggggcatggacagaaactgaaggaaaggcagcctgtgggagctgcgcttttaaaataagcggcatggggggccggggggggcgctgtgacgggggagcaggtctcttctgtagggactgggttttgattaagtcagtagcaggattaagtcattgggtcatcagaaaatctcatggataaagttcaaggggtttgtgaactttaaaaaaaaaaaaaaaaaaaacaaagaaatagccgtcggcacggttcaaatctgggcttggtgctctgggctgcttttccacaggccctccaggccctggatctgcagagtgtgagccccactgattgaagcatgttcgtgcacagacgccatgagggggatggaggctgcaggaacgggggaaggcaggcgggggtcctgtgaagtgtgagctcccagcagttgcatgctggggtcctcagtttcatgttgccagtgcgtcagagagccatctctcactccgtccctgccaccgtccagtcctgcctgctgtaaagggtgacactgaggaggagaggcgtgatggttcgtgccttgctatactagttgtcctgcagctgtccctgatcagactggccttattcaacctttgttctaaactacggcagttgtcctagccaggccatcggttagatggagctgctgcaggaggagccatccagcattgaggtacccctggaacacaggctgcctgctcggaaatgcgcatctttgtccttctcctgcctgcaccttggagccatggctttaaagattccttctgtgatctccaagagaaccagtcgagcatcaacactaaccattttgttttcaaaatgctgaaaactgctctgggaagctggaggtgctatcgagggggaccccatgggtttatgaaatgacagccgttggggagtgggagacacctcctcatcctgtgacatagctggcgggaggcccaggctgcataatgcagatgggcgcgaggccccaccagtgggacaggtccaggtctgatggtcatgtgccctgcctcccgcccagaacacagtagcatgtggccagtctgcactcgggccagcctgcagggagccattgtgctcatgtcaccctttgcaggagcgagcccagcaatgaggaggcaggacattactccctgtgacattgagagcaagtttttcaaacacaaagctcatgttaagaagcctgcagtgcacacaagaagtggggagaggggtgggaacggaggacacgggtggtgatgggaggggcatgtgggcttgtcagaacactctgtgtttgaaaatgtcaataacaaggaagggttttgttttgtttttaacaaaaatcctgctgtacccaatataagcagcaagcactgcggtcctcacctgtcctacaccggccatggtggcccctcgcgggcagtgctcgcctcaggcctcactaagctttgggcacacggtttctctggcagcagctaccagcggggatgccaagcccggactcagctcagaagcaatggaggtggcagcgctggggcgcgggctgtggactcactcacctggacgctctgtttctgtacaggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcaggtaatttgaaaatagatgccatggaagcttctgtcgaaaggtggtagcacttgcttgtgggcacaagagggacacggagggcaacggaggtggtttctggatacactgttgagcagggaagaggccctgcaacaaaccagtgacaagccacgtgaagccccttcctcgggctgagccaggctaagcagagaaggacaggcgctagccaggacccagcttcagaagcttcccagaacctttaaagaggccagcagctcggcacagtccagcctttccaccgtgttgcttcctctcaggatcagcagcaacggccctggcttccagccgtcaccaacacttcccactcccttccctcaaactgcagcacacacattaaaccaccagaccaacaaaactagcttgcagctttcttctttaaaccttggtacaagagtcttccaccatgccagtgtgcctgtaaccggcttttctttccttccacagatgaggcagggagcattccttgtgaacgcagcccgtggcggcctggtggacgagaaagccttagcacaagccctcaaggagggcaggatacgaggggcagccctcgacgtgcatgagtcagagcccttcaggtgcgtgttgccccagccgcctaccaggagcccacagggcccagctccacacctgacccccacactttgaactcgaggcccttttcccaaacaggtccctgggcaggaaactccagagatgacatttacagtctctgttcttctaaggattgtgctgtattctaattgtaaaagggctggaagtttcccagaggtcatcagggaaaggagaggcagaaaattggtgggggtgtggcagtggttctggtcttcagacagacaggcatcatctctgccctggattacagcaggacaagccttcaatagaattgggctttttgatctaccaattatacggttcttacacaactttgataattacattcaaaaattcccagccttcataaaatatcatcacagatgttcctgtatccatgctatctatgtagctacttttctacatggccaagagctcccttgtgctgaggagggcagggagcgtatgcgacatttcccgcttactctgttttttctacatttttctagctttgctcagggtccgttgaaagatgccccgaatctcatctgcactcctcacactgcctggtacagtgagcaggcgtcactggagatgagggaggcagctgccaccgagatccgccgagccatcacaggtgagcccctccgtgcctctggcctgccaagggcagcctcagctccacagtgcagccggctcctgtcctgctggctacaggcagctctcgacaggtagaattcacttttagcatcaaatttatatgagttgggccctgtttatttacgtaagccctgaactaaacttcacagagggaaccattccctttagtcccagacattataaactcgggggtcggggggcacacagaggctgaaggtcagtgttgaagagctcaagcacttgggcctttggatgttctacatttttacaaatgcttatttccccacataagcagctacaggtgtaatgttgaacttactgtgatttgtaaaaataatatgattaattttaatcatcttaccctaggtcgcatcccagaaagcttaagaaattgtgtgaacaaggaattctttgtcacatcagcgccttggtcagtaatagaccagcaagcaattcatcctgagctcaatggtgccacatacaggtgagaaaaggaactgactttgtctcagcttgtgagcaccacggccccggggccagggagagaagcccaaacttggcggaagcttaacctcccgcagatgctaagtcagggtcagaacaatcagccttctcagcaggaactgtgtacaccgcccccatttcttccaatgcctaatttcatggaacaaacagaagctcctattttaaaagggggtgtgttcggtcagatgtgattgaccacaggtgctaggaactgcctttcattctaaagccatcttaaaaccagaaggcttcccagtcacgtgtggtggcgcacacctgcagtctcagctgctagggaggctgaggtgggagaggtgcttgaagctgggaggtggagattgcagtgagccgagatcacccactgcactccagcctaggccacagagtgagacaatgctgctaccccccgaccccaccccaccaccaaaaaaaaaaaaaaaaaaagggcttctcaaagagaaaggtatacgtagataagatgttcaagtgcaaaggcctgtgagcaagttcattttccaatttgaatcttatgtccacagaaggcattctggtacagtcaactcaggatagtacaatcaactcaggatgatgaccttgtccacacactaaaaatgatacctgtagtttgggtcagctgagaaactggagccatgtttgggaacgcagagtgggggaaagacaggagccctcacagggagaaggggttccttttgtggtattttccatgcacgaatcggttttctcccacacccccccccccattattgctggcttcccaggaaaatcagtagccccctcatgcataaatgaatgaagttgcagccttgaatcttaagaaaaatttttgcatattctaaaccagggtttctagctcttggcaataagtatatttggggccagatcattctcttcattctctcgtaggaggcctggcctgtcctgtgcattgtaggacgttcagcggcatccctggcctctacccacgggatgccagtagcacctcccactcccactcatgatgattgagaatgtctccagccacatgtcccctgctgtagccacagtgacgaccagggtgcattcagtttgtgtaatgaaggctctgacactcttgaagaagctatgccggtgcttgcaggtcacatggctgtcttcacatttcatccagccccgtccttttggccctcaaaagtattttgagcctatcacagcaccagattcccctgttgggtggagctgggggcccacctcttccatgtctccattgttatttatccttcacgtaagctggggctcttaggccccctagaacagtatgtgtgcactgaggaagggaccctaatgaccagagtccttctgaaggtcttggtgacaggatggcaggccaggagctgggggtggggtggctaccatagtgagatgcctcctcctctacctggatggatgataagtctgtgtgaatacactgagtcccactttgcccgaggaccctgtgttctgtggttggcgaatgcagtgtgtcctcacacagcacttcgtgcttgcaatataaaaccagcccgagcctgggcgttccgaggaaggcgggcccccagccaacagccagcaagcataccacttcccatctcaggccatgggagtatatagccaaccagcctagaaagcttagtgagttctggctgccataattgagtagcatagactgggtggcttgtaaagaaatgccttgctcgcagttctggaggctggaagtctgagatgaggctgccagcatggtcaggttctggtgacggccaggcagcagaccgtcagcttcttcccacatcctcatatggcagagagagggccagagcactgactagactcccttgtgtaaaggcactgatcccattcatgacccagtcatttcctcacccagtcacttcccaagggctctacctcttaaggtcatcacctttaaggtgtgggatttgaactggaattagggggatggagggagacaaacattgagtccctaagggtccattgtactctgttgggaaatcattttatcagtcagaagtaactggtgaacagttgggagtccattttgtacaaagtgggtttttttaaatagtataatgtatccacattcataaatagtatgggctaatatcttcttatctaaaagctacaaaattagtggccccgtgtttggattggactagttttgtttttatgaattagttgccagtgttttatataaaaattgagacttctccttgctttggggatagggaagataaactatcccataaaaatcgttagccagggccgggcatggtggctcacgcctgtaatcccagcactttgggaggctgaggcgggcggatcacgaggtcgggagattgagaccatcctggccaacgtggtgaaaccccgtctctactaaaaatataaaaattagccgggtgtggtagcgcacacctgtagtcccagctacttgggaggctgaggcaggagaatcactttaacccaggaggcagaggttgcagtgggctgagattgctcacgccactgcactccagactggcgacagagtgagactccatctcaaaaaaaaaaaaaaaaactattagccaggcctggtgtctctcgcctgtactcccaggactctgggaggcctatgatggggcatcacttgagctcaagagtttgagaccagcctgggcagtctggcaaaaccgcatctctacaaaaaaatacaaaaactagctaggcgtggtggctcatgcctgtggtcgccactacttgggtgtctgaggtgggatcacttgagcccagaaggtcggtcaaggtgagccatgttcatgtcactgggctcctgtctcttatgaaaaggccagaagtagaagagccaagagcttggcaactctgccctgaacttacaaggccctatttctgtgtgttccttagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaattt

SEQ ID NO: 35813 - DNA, 172692 bp, Homo sapiens; identical to SEQ ID NO: 35812

SEQ ID NO: 35814 - DNA, 23153 bp, Homo sapiens
agtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcggtgagtgagtgtgactgagtggcccgacggggtgcggggccgctacccagaagccccagcggtgggcccggtcctcttccccgcggccaggcccctttcccgcgtccccgccacaggtcccttctgcatccctttcccggaccccgaaatctctgggcacccacgcccgcttcccacagcgccctcgtggttccctacccacaggcccttgcggtgtgtggccttttttctttttcgtttgtctatgttgtcctggacccttacccataattcctttcgctttttgcggggtccaggtctgttacccacaagcacttggttttggggcttcgctccttatgtttctctttctttgcttggaaacttccgatccccaggaccctgcaaactgcatctcgtaatttgccctccacggcacgggacgagcagccacagctgctctgggcctccctcctcgggtccttgatttccccagaaattcccagggaacctctccgccccacagctcgtgtcagaggactctgagacttcactcttcaggaacccttttccagccgttatttttgttttctttaccggcctttcacctccacccccaccaagacgtacccttttctccgcaacacaggactgttctctgcccttacagagcctgttttaattccgagacttttctcctgtctttcttattttgagagtcaaggagtaacaggggctttctctgtgcagacccgatctaacctaaggctgtcctgcttctgctctcagacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggtgagttcactgagcaggccaggaatggtttgggttctggggagcaacgggttggatttgcgagtccagcttctggccattttgccagctgcgtgatttaagcgaggggcttaacctttgtgatcctcagtttctctgttttaaatggggttggagccgggtgtcgggtgtggtcgagtgcgtctgtagtctcagctactcaggaggctgaggtgggaggattgcttgagcccaggagtcggaggctggagtgctttgtgattgtgccactatactccggcctgggtgacagagcaggacttcgtctctcaaaaaaaaaattttttttttaagtggggttgtggcccggtacggtggctcacgcctgtaatcccagtactttgggagaccgaggcaggcggatcacttgaggtgaggagttgaagaccagcctggccaacatggtgaaaccacgtctctgctaaaaataacaaaaattagccggacatggtgcctgtaattccagctacttgggaggctgaggcacgggaatcacttgaacccaggaggcggaggttgcaatgagccgagatcgcgccactgcactccatcctgagcaacagaacaagactgtctcaaaaaaaaaaaaaaaaaaaaagtggggttgatagtacaccttttgtagaatttttgtgaaaattcagtgagtagtggttgaggattcatgcctaacccacaccatttatcagctctgactttgggcaaatgttgtatcctcttaatgcattggtttctttatctttagcaaggggatagtggtagcacccttataatgttggtggagaattaaatggcaaactgtatgtcagggggcttggcaccaagcagtcagcacatgtcagcctttgttactctgtttactacttttattgttaataagatgatgttcataaaggcttagcacccagtattgagtattggagggcttaaaactgcagatggggatcttagctctgcacctttgggataaataggaatgaatgacttaggctcctggacctctgtgtttttatttgtgaaatgggatgacaagggtcatctcttaggtgcatcagagcacacctgagaaaagctggcacacagtcggaagttacaagaagaacgttctagcattgggtaggtaagggcagctggaggcgagggagttgcagagcagaatttcgtagataacagaaaggtatgtcttcagtgggatttgccacccttggtgaacccgcacttgagagatattactggccaattaacttaatgggcacaggcgggtggtaggtgccctttgatgatgcaggtcatgtgccagttaccatttatttatttatgagacagttttgctctgttgcccaggctggagtgcagtggcgtgattttagccaactgcagcctccggttcaagcagttctcctgcctcagcctctcaagtagctgggattacaggcatgcaccaccacgcctggctaattttgtatttttagtagagatggggtttcaccatgtaggccaggctggtttcgaacccctaacctcaggtgatccaccccccttggcctcccagagtgctgggattacaggtgtgagccaccatgcctgggagccaggtactttttttttttttttttttttgacttggagtctcgctctgttgcctaggctggagtgcagtggcgtgatctcggctcactgcaagctccgcctcccgggttcatgccattctcctgcctcagcctcccgagtagctgggactacaggtgcccgccaccacgcctggctaattttttgtatttttagagatggggtttcaccgtgttagccaggatggtcttgatctcctgaccttgtgatctgcccactttggccttccaaagtgctgggattacagacgtgagccaccgcacccgaccttttttttttttttttgagatggagtatcgctctgttgcccaggctggagtgcagtggcgtgatctaggctcactgcaacttccacctcccgggttcaaaggattctcctgcctcagcctcctgagtagctgggattacaggcacgcgctaccatgcctggctaatttttgtattttttgtaaagacggggtttcaccatgttggtcaggatggtctcaaactcctgaccttgtgatctgtctgccttggcctcccaaagtgctgggattacaggcatgagccactgcaccctaccagccagttcctatttaatgtgtggttgatgagacctttaagagctgccttggccctcagagggtgtgcagttgtgggctttggagccctgttctgtcagcttatgttgctttaggcctggtcatcctcactggcactcataagcagggccctgccatcactccactcccatcacatcctctggcactttgttcaatgtgagtgatacttggagctgtgagaagcaatgtctttcctaaatatggaagacagggtgtttcctaaatactataaagctagatgtcacctgtaccagtgcttttcaaactgtctttggtgaaggacagatactgtttccaatctgtttgcttttgataaatatgatagaattactttttaaagaaagatctacagtcaggagttcaagaccagccaggccaacatggtgaaaccctgtctctactaaaaatgcaaaaactagccaacatgctgtcgtgtgcctgtaatcccaggtactcactcaggaggcttaggcaggagaaccgcttgaacgattctagtcagttgctgggttccttttagagagacgggcacaggggggaaagcagggcttagaatcgcttgaacctgggaagcggaggttgcagtgagcccagatcgcgccattgcacaccagcctgggcaacagaccacaacttcgtctcagaaaaaaaaaagacctacagaataaaagaccaaatttgtattaagagtcagtggacatcaaattgtgaaattactgtagaagttcctgaacacttagtcctggtttctgtacttatcacagtccagcaacagtttagatagtactggtccatggaccatgcttagtttttgagacaggattttttttttttttttttttttttgagacggaatcttgctctgttgtgcaggctggagtgcagtggtgcgatctcggctcactgcaacctccgcctcctgggttcatgccattctcctgcctcagcctcccgagtagctgggactacaggcgcccaccaccacgcccggctaattttttgtatttttagtagaggtggggtttcaccatgttagtcaggatggtctcggatctcctgacctcatgatccgcctgcctcggcctcccaaagtgctgggattacaggcgtgtgcactgcacccggcctttacacctggctaatttttaaattttttgtggagatggtgtttcactgtgttgtcccaggctggtctgaaacccctaggctcaagcattctccctgtgtcatcatcccaaagtgctgcgattacaagtggaagccactgtgcgtggctgcagaccttgctttgatctgtgccactcccctccctccactgtgtcaggggaagtgtgcgtggatgtttatttttgtagggggtgggggtgggagggttaacctgtttatttccttggtgagtgtcccttgccatttcccccagtccttcccaccctgtcacctctcttcttgttcccaggaccctcgagatgcccctcctccaactcgtgctgaaacccgagaggagcgcatggagaggaaagtatgtcatttttgcttcctgaccccctgttttaccactgtctccagatgatccttgacactagggcacttctatctgcattcacttctccacctcccctttctcctgacagagacgggaaaagattgagcggcgacagcaagaagtggagacagagcttaaaatgtgtaagtctctcatccaccatttggctctctcctctcccaaaccctctgtattcttcccaggtcatacccaggaccctgctgtctccctaaggcctgtgttgtggggaacagggttgttagttcatttgtttagcccctgccacttcacaagcactgtttttggtttaggcttttcagcagcagaacatagggtaaaagttggcaggaagggagacccctggtaccttgggctcctcctgcatgggaggacagttaaggggctcccacaacccagctgggtgtcacaggctgaagtggtgggttgtgggatagtggtctgtcctggctctaaccttaggtccccaacccttgggctgaggatgttccatcccctccacatagaggaggaattggagtacaagacaggtgtgttgttgccattaaccaaactcataagagggtcagatgtcaacctccagtggctctttattctgaaagtgaaaactgtacagtcacaggcagcatagcagtgtttcactcagcaggggaccgtggatgtgatggtgatcctataagattatatcatattttgccaggcactgtggctcacgctgtaatcccagtactttgggaggccgaggcaggcggatcatgaggtcaggagttcgagaccagcctggccagcgtggtgaaatcctgtctctactaaaagtacaaaaattagctgggcgtggtggcgagcgtctgtaatcccagctactcgggagactgaggcaggagaatctcctgaacccagaaggcggaggttgcagtgagccgggatcgcgtcggctcactgcaacccagcctgggcaacaagcaaaaatctgtcttaaaaaaaaaaaagattataccgtctatttactgtaccctttctatgctttgataacgtttagatgcacaaatacttactattgtgttaggattgctgtagtatttggtgtagtaacacgcttggcctcggagcagtgggacgcaccctctagcccaggagtgttaggtatgctgtctaggctcgtggaagtgccatctcatgttggcatatcgacatcatcatcaaacgacgcacttctcagaacatgactctagtgagaagacaggttttcctcctatacctgtgaactttgatgaatccctttcctccaaatcctggagtgcaggatttcctcacggtgcttacgcagaagcgtgacagagacatctggcggtgcactctttggacattggctgtcggaacgctgtcttgatgtcctgcctcagaggcatctcagactcagtgtccaaaccacaggggttttccctcgccaccaacctggtttcctttgggtgttttctctgggacatagacattcagctgtgccggtcatgacctcattttttgccatgcagtttgtttctaacaccttttctaaccttttgctcagcctctcaccaagacctatttgtgttattttctaaatgtcacaaatctgacccttcttttcatgtccatcatcaccacccaggtcacctcttgcctagacaacacagtcacagtcttaactagtttacctatgtctttttgtttgtttgtttgtttgtttgttttttggaggcagcctcgctctgtcgccaggctggagtgcagtggtgcaatcttggctcactgcaccctccgcctcccaggttcaagtgattctcctgcttcagcctcccaagtagctgggactacaggcgtgcgtcaccacgcccagctaatttttgtatttttagtagaggcggggtttcagcatgttgaccaggatcgtctagatctcttgaccttgtgatctgcccaccttggcctcccaaagtgctgggattataggcatgagccaccgtgcctggtcacccccctccttttttttttgagacggagtcacgctctctcaatcaggctggagtgcagtggtactatcttagctcactgcaacttccgcctcctgggttcaagtgattctcctgcctcagccttctgagcagctgggactacaggcgtgcgccaccatgcccaggtaatttttgtaattttagtagagatggggtttcaccatgttggccaggctggcctcgaactcctgacctcaggtgatccacctgcttcagcctcccaaagtgctgggattacaggcatgagccaccgcagccggcctagtttgtctatatcttaaccaaccacatccactgtgggtcttcttttttttcttttttggaaaaactttaaaactgagacggggtctcactatgttgcccaggctggtcttgaattcctgggctcaagtgatcctcttgcctcagcctccctcagtgctggattacaggtgtcagccattgtgctcagcctcttttttttttgttgtgttttgttttgttcttagggacagggtcgtgctgtgttgcccaggctttactgccgtggtgcagtcatagctcactgcaaccttgaattcctggcctcaggtgatctgtctgcctcggcccccagagtgttgggatttcaggtgtgagccaccatgcccagccaaaagtgtttttcattttttgttttttgttttttagatggagttttgctgttattgcccaggctggagtgtagtggtacgatctagggtcactgcaacctctgcctccccggttcaagcgatttccctgcctcctgagtagctgggattacaggcatgcaccaccatgcctggctaattttgtatttttagagacagggtttctccatgttggtcaggctgttctcgaactcccgacctcaggtgatctgcccgcctcggtctcccaaagtgctgggattacagggcgtagccaccacacccggccagaaatgctttttaaaaacggttccacccgggcgtggtggctcacgcctgtaatccttcaaggcaggtgggtcacctgaggttgggagttcgagaccagcctggccaacatggtgaaaccctgtttctgctaagaatacaaaaattagcccggcgtggtgatgtgtacctgtaatcccagctactcgggaggctgaggcaagagaatcctttgaacctgggaggcggaggttgcagtgagccgagatcacgccattgcactccagcctgggtgacagaacaagattccatctcaaaaaaaaaaaaaacaaaaaaaaaaacagttccaggccaggcacggaggctcatgcctgttgtccagcactttgggaggctgaggcaggcagatcacatgaggtcaggagttcaagaccagcctggccaacatggtgaaaccccatctctactaaaaataccaaaacaaaaacaaaaacaaaaacaaaacaaaacctagccaggcattgtagtgggctcctgtaatcccagctactcgggaggctgaggctggagaattgcttgaacccgggaggcggagtttgcagtgagcagagatagcgccattacactccagcccgggcaataagagcaagactccttctcaaaaaacaaacaagtaagttccaattgggcgaacaaaaaagttccaattgaggaatttgaacactggatcatagatgaggttaaggaattagtaaatgttaactctaagatgtaatagtggcactgtggttatgatgtttaaaagcctttgttagagaccaaaatggtgtgctatctggaatttcatttaaaataatccagccggtcgtggtggttcacgcctgtaatcccagcactctgggaggctgaggtgggaggattacttgagtgatccaggttcgagtggtgaatatggtgaaaccctgtctcaactgaaaatataaaaattatctgggtgtggtagcaggggcctctaattgcaactacttgggaggctgaggcaggagaatcacttgaactcaggaggcagaggttggggtgagctgaggtcatgccactgcactccagccggggtgacagagcaagactccgtctcaaaaaaatgcagtgggctgtgggaggatagggatgaaacaagtccgtccacgtgttgataatggaagcgggctcatgggagttcgttatactgctctgcctccattaaatgcttgaacttctccataatagaaaagaaataaaagaatggatcaagttcagtagggtttctgtgcccttgagagcctccactcatagctatagaagcttgctgtgccttgtcacaatgaacagctcccgtcaaggggacggtgcctccttgctgagcgcttgtacttggtgttactgactttctcacagcttccaagtgcagcaggggttgctactcccatttttaagataaagaaatggaggcttgttgaggcaagcacgcttccaaagagtgagagttccaagatgggacctcgagtacctcaaagcctaattcccaactccacgacccacttccgttgagtctctgctctgggctgctacttagatgagccctcaaccagtgatgtcctgagggagagctgccgtcagggcgctgcacgcatacgctggctgtggggcgctgcccggcattgggtctgtgctaccttctttgagcttttgttctctatcttcaggacttgggggtaccattgctttgctgcatttgctttttacctttagtcacatttgtggcccccccaccccgggtaagcaagtgctccagggaactcacacagtgtgctggggtggtttccctctggctgcccttcaggaagctcagctgttgtttggccttcgtccactccccagccctgcagcattcattggtcccactgtcatgctccacagtaactgttagaatgcctgctgtctggcgttgccgggtgtgtttccttgctgctgtgacagctttcagctcttcattaaatgttagcatcttgtgaggctttttctaacctgccttgtaaagtcacccgtttctattctctgtcgtcatctgatgtgatcataggatctccttatttacctctttcattagcatatgaaccccatgagggtagacacctttttttttttttttttggagacagtctcactctgttgcacaggatagactgtagtggcacgatctcggtttactgcaaccttcatcgcctccctggttcaagcgattctcttgtcttagtctcctgagtagctggaccacacccagctaattttttgtgtatttttagtagggatgaggtttcgctgtgttgatcaggctggtcttcttgaactcttggtcacaagtgatccgcctgccttggcctcccaaagtgctggcattacagctgtgagccactgcgcccagcacctttttttgtcttgtttactgcgaaatccccaacaactatagcatttccaggcacatagtagatgcttaagaattacttacttacaagagcacaaacatcggcgaataaaaagaattacctattgaatgaatgagagttagctggtgcaaaaaaaaaaaaaaaaaaagccagtgcagattgagagacctggccatagaaaattacaacgctcagggataaggtatggcaaggaacgttttttgttttttgttttttttttcgctttattgccgaggctggagttcagtggtatgatctcggctcactgcaatctccacctcccagattcaagcaattctcctgcgtcagcctcccgagtagctgggactataggcgcacaccaccatgccctggtaattttgtatttttagtagagacggggtttcgccatgtttgccaggctggtctcaaacacctgacctcaggtgatccgtccgccttagcctcccaaattgctgggattacaggtgtgagccactgtgcccagcctggcaaggaacttgaggagtgggtggagagaacgctgagatggagttgttttcagacgtttccatttgtcccagatagcgattcccttaaattgtggcttaggcttctgttttctaaaatattcttaggccaggtgcggtggctcacgcctgtaatgccagcactttgggaggccgaggcaggcagatcacctgaggtcaggagttcgaaaccagcctggccaacatagtgaaaccccgtctctactaaaaatacaaaagattagctgggtgtggtggtgtgtgtttgtaatcccagctacttgggaggctgaggcaggagaatcgcttgaacccgggaggcggaggttgcagtaagccgagatctcgccatccattgcactgaccttgggcaacaagagtgacactccatctcaaaaaaagtacattccttaaagtcatcttgaccttagtttatacttgtagttaaattctctcataagaaacaaatctggcgggacgcggtggttcatgcctgtaatcccagcactttgggaggccgaggagggcggatcacctgaggtcaggagttcgagaccagcctggccaacatggcgaaaccccatctctactaacaatacaaaaattagctggatgtggtggtgcacgcctgtaatcccagctgcttgagaagctgaggcaggagaattgcttgaacctcggaggcagaggttgcagtgagacgagattgcgccattgcactttaagcctgggcaacagagcaagactctgtttaaaaaaaaaaaaaatctgagactttatttctctagcttctggcaacacccacactgtcttcctgaaaaggtagcacccgagggttcggggaaggagcctggtagttcaagtgcccggggtgagaggtgaagtctgccttggcccttcgccactttaacacctccctttttctgtgtctcgagtttgttctgttttacttccatttgcaaaatagtaataaataaatatcagtgtccagcactgtgtctgggccatagtacgtgttcagtaaattatatgtctaatgttccattattggaacgctaagcatgtgggagttatttatatcctactgctcgggtcatcaccagggtctgatttttcacacgtgtctgcaattcaaaaaattgcaacctctggcataaatgggttaatgttattccttttctcatgctctcccagaatgtgacagggcttccgagggaaacactataccatggaagaaccggcagagtgtccttaaggccccggcaggagtcagggtcattatgtgctggagccaccatatttggtgaaaaggacttattcccaggcctgacccagcaggatcacctatgaaattggtttcttaggagattcctggctcttttctttggagattgttattccttagtagccaggtagaacagtttgcctcacagtagtgaggctggagtgagaatctgatctgacgctagtcagttcctgggttcctttttagagacacagggcacagacaggaaagcagagcttacttagtgtttgctttcctggctctcattcttagccttggggcagcttggtctcaggttttcctgtgggctgtagttgcagtctgtgtccagtaggtggcagtgtggccctgcctacaggagggagctcagaacctgggggcatcagctgcatctccagggaggcccagttgggctattactgtttggatcaccttgcatctgggagcgatagggcccttagggtttatgtaggtctgaaatggcagttgggcctgcccacatcctgtcagcttgaagtcagccttacctcctctcctcagcagcctggattatctctcagccactctgataaagcccactgtgcctcagagaaacaggttcagagaggggcgtccctgaggttgccaggtcaccacccatgttcctccagttaggggcctctcccaatgccaccgttttcttcttggcctctgcccatcgtatttgttttgctacctgagaccatggacaccttcaacttataaaattcctttcttcctgcacaggggaccctcacaatgatcccaatgctcagggggatgccttcaagactctcttcgtggcgagagtggtaagtccccagctcctagctcctggaaccccacgctgctgagagcctgggtctggcacaaaggtcaaataggctaggtacaggggaatgttccaggggctgtgggacagctctgttctcccatttaacgtcatatccatctccttgtagaattatgacacaacagaatccaagctccggagagagtttgaggtgtacggacctatcaaaagagtaagtggagtgggtcagggtgtttgaattgggggtgcatggaggaggggctgtatcctgagagggagggagagaggtcccagccctgagcatggctcacaccatttcagggcctggatttatgcatcctgactgtatctccatgcagcagaccttgggcagcagaagtaaaatgagaagtaatgactgctggtggttggttgagagcaggggttggcaaactacagacttaaagttttcctgctgctcagccaggcaggtctgtttgtttacacattgtctttggctgctactgttgtaaggcagggttggattgttgcaacagtatacggccgtccaagctggaaatatctactctctgggtcttggcagaatacctatgctgagtcccgttttagaggaaggctttgttttaccaatcttcttttaagtcactgaagtgctctgtgtctgatttcctttatctaacatgggagacgcatgccttcactgggcagtagtgagggcttgaggccatcctacacacaaactgatgttagccatgtctcttctccctgctctgtttctgatacgtcttttaaaaatatttatacatgtcaggccgggtgcaatggctcacacctgtaatctcagctcttaaggaggcagaggcgggaggatagcttaaacccaggagttcgagacctgcctgggcaatatagcaagaccccgttctccacacaaaggaaaaaaaaagtattgttgggccaggcacggtggctcacgcctgtaatcccagcactttgggaggccgaggtgggcggataacctgaggtcaggagttcgagaccagtctgaccaacatggtgaaacctggtctgtacaaaaaaaaaaaaaatacaaaaattagctgggcatgatagcgggcgcccgtaatcccagctactgaggaggctgaggcaggagaattgcttgaacccaggaggcggaggttgcagtgagccgagatcacaccactgtactccagcctgggcaacagagtgggactccatcttaaaaaaaaaaaaaagtattgtaggctgggcgtggtagctcacgcctgtaatcccacatgttgggagggcgaggcaggcagatcacctgaggtcaggaggcaagaccagcctggccaacatggcgaaaccccgtctctacaaaaatacaaaagattagccgagtgtggtgtctcgtgcctgtgtgtgtgtgtgtatgtgcatgtgtatatatgtgtacacacacacacacacgttgttctgccttgcacagcccagtgacaaccttggccccacccttgtccctctgatccattcaagtcaggaatcttggttgtgttttggaggctgtggggtcccaggttcatccatgatacaggttggtcgccaactggtagtgatgtgaatggcgaactagccatcctttagggaccagctcaaatgctgttacctcccagaaatcttccctggttcattctggccacctctgtctcaacagccctgccttgcccgttgttctccctgacatggtccccaaggggtctttctgacatccagagctgaccccatctctgctgacagcatcccatgggtccctagcatgttaggacaggtccagctgccaccatctggccttccagggctcttccccaagctgtgtggcctcatggacctccaccccaccccatctcctcccttctcttgctgccatcctcgggatgggacgcatccctcatcgtgccacgttctctcaagcctccctggctgtgcacgtgtcctttctttttcccttagaacttccctgtccttggccaggcacagtggctcacgcccgtaatcccagcactttgggaggccgagaagggcagatcatgaggtcaggatttcaagaccagcctggccaacatggtgaaaccccatctctactaaagatacaaaaaattacccaggtgtggtggcgcacgcctgtaatcccagctacttgggaggctgaggcaggagaatcgcttgaacccgggaggtgcaggttgcagtgagctgagattgagccattgcactctagcctgggcaacagagcaagactctgtctccaaaaaaaaaaaaaaaaaaaagaattcccgtcccattggcattcacaactccctcctgtttccctaattccatttgtgtcctcctgactccacgtagaccacccacattggcccttccttgctcaacacccttcccagctcctcagcgaccacacttctcggcctggcattggggcgcttgatgaccccgggcctgcccacctttgtggcttcatctcctgggactctctgtcatcagtacatgagccagccctgccgaagcgcatccccagcctcctgccctcctgcccccgggcccttggacctctggagttactgctattccacctgacaggctgacacctcactgtcttccttcatctctcttctttctttaggtcttagcttaagtgtcattttctccaggaagccgcctctgtgtcctctgctcctgccattagaacataagtcactcagggctcttgaaggacagagagggtctgaggcctcatccggcccagggcctggtgtgcaggctgttgtggggttggtggggcggagccgccctgtggcaggactcacccctgtccccatgtgccccacagatacacatggtctacagtaagcggtcaggaaagccccgtggctatgccttcatcgagtacgaacacgagcgagacatgcactgtgagtacctcccgccgagccctgccctctgacctgctctcacttctctgctgccccagcccctcccagtctgtcccctcccccaccctgccacacctgacattagcgatgtctcttctcctcctccctctgtttctgatgtatcttttttttttttatatacgtgttttttaaaaaacaaaaaccaaatcccccacaacgtgtgtgtgtgtgtgaacctggggaggtaagtgtcacacgttgaacctcaggggcaaagagggaactgggtggggggctggggccagctggaggtggggggaggggtcggattttgggggaacctcccccattccccccactgaagttgggggtggccaggttgcaatgaggactggcctttgaacctgccctctcttccccccccagtagaactggggctgggccacccgaccctccgcttccccaaccctggccccccaccctgttcctcagcgggcagtggggtgataggcatgttgagcgcctgcccctacagttccaaagccccctttgaggctgccgcggcgtccacatgggcagggatgggtgggggagggtgggcagggctgcggcgtgtccaggggccgccgtattaattgactgttcttattgtcactgcagccaccacgcagctggcttgcagctgatgcttacgctccccttacaacacctcagtgtatggttggtataagggtttgtatcatgggtaagatcactcagcaccgcacaccagcccagcttagccaggcagctcaggagcagcgaggcgcccctcctcccaccccagtcgcccccgtagcctccccgcacccatggccctttccttgtttgggtgccctttgtccctcctgccccgatccgtatgctctctgagaatcttgctgatcccaggaggggaaggatgaacctggtgggaaaggcggcggcctctccgcttgggttccacccagcctctgatgacccggcttcgtgatgtcagcggcgaggtggcaggaacaccgagggcagggctccaggccagggctccactggagcccttcagccttccctccctgcccccgtgctttctatggggctgctactgtgctggccctggagagtctttttggctgctagttttggggtgctctgccccctttctgtcttccttactgtggttgaggcctcccgagggggctggctgtggtgtccagcagctctccagaggtggtcaggagctccctaaagtgcatggaattggggcttggggtgtgggagggaccaaggggtaggctgctagcagctgaaggtgtcgtaggtttttactaaagaaccttccactgtctagagacttgagagagggaaagagagagagaggcctagacgaacacaatcacatgttttctttgctgttcctcccgggatgggcctgttttggggtttgggactctgaacccgagcggggttccttcgcttgactttgatcctggtccttaaatgcctttccccactcccctcccgtgggttcaggggccaagcggcccctcctcagagcacgggcagcaccgtctcctggacccctgtgtgccagcctctgcagacgcagctggtgggagggagcatggatttggaggtggagaagtcactcctggtcctcggagggggtgggctgtgtgcctagttcagtgtgactcggggattggtgagggcggacaggtttctgaggcctccctagccttctttgtaaattcacacgagatagtccagggctttccagcgcccagcttggatgataatcctcgtctcccccactctaaggcctccttgagatttctttggggtctaccacgtcctctgcctgtctccaggtggtacaggagatgtggttcctctccctctcctggctccctagaaccccccacttcccctccctgtagctttagctgaccccgtggtggtgggtgtggggtctgtgcgcgtgctcaggtaagcttgggggctccaggtaagcggtcccgtgtcccccccccgggaagcccgcctcctcgccaggcccccaggagttgccgagccccccccatcccgctcggtttggacacccgcaaggccggcatcggtaaatggcacctttttctcttcctctggttgttatttgggggggagcgggctggggcggggcagggtattacggttggttgaggacagccccctaggccagggctgggtgggggaacggggactttttggccttcatgacagccccacgttgatcacaggccagggcctcaggcttgccttctgctacgcgctgcccgagagcagcagtgagcctctcccccgtctcccctctacgactcccctttcctggcaggctcaggctggggtgcgctcccagcacgtgttgagccgggggtgtggagggcgagatggggcagggctggggggaggcagagtcagtcgtctcaggtaaggcagggattttcagtagcaccgcacggctccccatgcttcctccactgcccctctcccctgctgcaggggccccgccaggccccctgggagtgtataacccgcctctctgctccctgccatttcctgaagatttctcccacccccttctggttcattttctgttctgatgtctgttccccccacactcacccccctccaaaaaaaacaaaaacagaaaaaaccggtgtggtctggggtgcggagcgtcccagctgggcctcctgccccggcttggtgtctcagggtgcatgcttggggttgtggaggagccccctcccccacagcagagtccagcgtggagttaaccttcagtttctttgcagcgattttggccgccctggcgggagggggctgttccatcatgtgggagaggaagggccggggagcctagggggtggcgggtgagggtggacgtctcccccgaccaggagtggttggggcgctgagaggaagcagacgctgagatggagcaggcccttcaccggtttgggagagggttggtctggctgtcagttgcctggctgtctgttgggcgtgtgcgtgtgcgtgatgatggggacacggggcggggattctgtagagctgggcctgtcctgactagaggaccctctggggactcctctcccctccccctccccacatctgttacagccgcttacaaacacgcagatggcaagaagattgatggcaggagggtccttgtggacgtggagaggggccgaaccgtgaagggctggaggccccggcggctaggtgagcacatcctgccttcgacgggctctcgggggccctgggcctggtggccttgttctcccttctctgctgctttctgcttctctgtctcctgccggcccacctctcccatcgcgtcctcatctccggcttctctctcttgtggccatcacatttctgacagctgcctgcctcctcgttctgggttactgtgaggagcaggggcaccagcctggagaggcctgagcccacatgctggcgtccgcccttgctagctgggggtccccttttcctgcctcattgtactcctcttagtggaaataaccccgagttcactgagctcagtgtactgggcgcccagcttggcagtgacgcatgctggggttgtaaatgtcactcgctcatctgcttctgctgcttgctgttgctcttgttcactcttttactgattcagcaagtacctattggatcaccagctgtgtgccgggcttctagttgagcaacacagaggcagcctctgccctctgagcctcctgcattcggtctcctcattgtcatttgctgtctcaggcaaggtcagtttggctgcaagtatcagaaataaacttgagcttcctgaaacataaagggccctgttgatgtagaatcatgggcatcctttggagttcggaggtatgtgatgtccgtggacctgagaacctggtagctgacgctgttaagagctggggcaaccaggccaggcgtggtggctcgcctgtaatcccagcactttgggaggccgaggcgggtggatcatgaggtcaggagttcgagaccagcctggccaagatgttgaaaccgcatctctactaaaaatacaaaaattaactgggcgtggtggcgggtgcctgtaatcccatctactcgggaggctgaggcagagaattgcttaaacctgggaggcagaggttgcagtgagccaagatagagtcactgcattccatccagcctgggtgccagagcaagactctgtctcaaaaaaaaaaacaaaaaacaaaaaaactggggcgacccacctgtgatgtgtgacagcccacagcttgcttctgcctcgtttgcctccatgcagctaggtcggtcccatgcctctttgcactggcccagcgcagcaggccacaggccccagctttacactcagtcctggatgagtctcttgtttcggggtgggcacatttgattgactcagtgttgggcctggggtcctgttgctcaggcatgcttattgaggactgaatcctgcaaagctgagtgacagttgtcagagaagatgatggtccctgggcagacacccaggcagtagtagccacttggggctcctgtcctgcctcccagccctgtgtcctggctctggactcgcctgtgctagggagaccacgctctcagctgctgagcctcggagcttaccaggcatgttcttaccttactctggtctctctggggtggagtgggttcttatagctctgctgtttcctgttggggcgggaaaatgctagaatctcagtctttccagaatctcagaatcttctagttcaattgccattcaaactttttgttggtgttagccaataacatcttgactcggtgcacccgcagaaatactgtaacctaaagtttgaggaaacagttttttctatgtagtaagtatatagttgtattctgctgttttgtttcttaagatgttggttgcaacccatcagattgatgatgggactcatttctgggtcatgacctgaatataggaaaggctagtctagctgccctgtgcctgtgacatggcaggtgcctggtccgctgcctgcttctataagaatgtctccctgcagcctcttttctatacagaactcagccctgcctcacggaagcttttccaggcagtgcgagatagaggagcgcttgagaaggcaggttttgcagcagacggcagtgacagcccagttctgcaccttctttgctgagtcactgtgggccagtgacttgatctgagattgtttccccatcagaaccatgaggttatcatctgtgccttggggctgttcatctatctattcacttgacacacacacatccacctttctataccagctgcagcgccacctgctggtaccgtgagcaagagctgggcatgcccacggttccggtgccctgcagtctggtgggagaggcaggtaggggtcgactcaggtagcaaacctgaaactccaggggaaggaagcgtttctgcaactgtgagtacataggactgtgaggagagacttcccgagaaaggatgttcgggctagcgttaagggtgagcgtgagttcaccagagaaggaaggggagaccagtccagggcaaggagaatgcacagacactggcaggaaggtgagcgtggggacactgggaaaggcctgggacacgcagccaagagccgcggctcagacgctagcagggcccgctcttgctgcctctaccaccagttgacgaggagtttggaccttaggctgggggacgccagcaaaggcttctaagcagatcacatttttgggtggaaagatcattggcttcgggtttctgtgagggcgaggatgattggaagggagggttttgaggaggctgtgaagtgcgctatggttaagatgatgcgctttggggccagacatgggttccagtaacggctgttgcctagcgaacgctttgtgtgagttaattagagaagacgtggctgtcttgtgatgggagtgcgcgggatgaactgcacggggggacccggccctgtgaacactaagccaggggctgccttcctgccctttgctcttggagtcggctcatttctgctcctccgggccctgtccctgcccagattcaccctctgtccgtctgccctgccccaggaggaggcctcggtggtaccagaagaggaggggctgatgtgaacatccggcattcaggccgcgatgacacctcccgctacgatgagaggtaagattgggcgaccggtgtcctggggtggggggcggtcacggggggagcccagccacacaggtctgcccacctcatccaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttg

SEQ ID NO: 35815 - DNA, 7086 bp, Homo sapiens
acgggagttccccggagaaggatcctgcagcccgagtcccggtgagtgcgagaggacccgcgccccctgtcacccctcacttctcctgagtcccaagtaaggaacggagccaaccctggggaggacccccggtcccctctcccagagtatacggagcctgaacctccccacttcccccaactctgttcgcggatagggtctagttgcctgctctcggacatccgttcagcagacactacctcttcgtcaccccctgcccaccctgacccgcctttacctcgcgtctagaggacacagccagggatcatcccgcagccccgaactccttcacagacccccactagccggggacgcagctcaggccccctacccccaacacaaacacttctctcctgtagaggataaagcttggggttcatcctccttccctggatcactccacagtcctcaggcttccccaatccaggggactcggcgccgggacgctgctatggacgacattttcactcagtgccgggagggcaacgcagtcgccgttcgcctgtggctggacaacacggagaacgacctcaaccaggggtgagctgaaacggttggtggatgagaggaaggctagagatctcctggctacgtggagtggagtgctcatgtctggtggtggcggctgcctttgctagccagtgtaatgagtgctaagcatagcctgtggggggcagagggttttcacagaggacgcagtttgagctgaatcttgactgcagaataagagtttcacaggcagaggctacagagagctttccagcctcagtagactgcatggccaaaggctagggggcaaggcacagagcagagagaacaggaaattgtctggagttccatatggctggaggatagatgatctctgtgggtcggagcattgggtacaagaggaaaagaacaggacataagactgtagaggtctccaaggatcagccagatcatgcaagcatatttaggctataagaaggtctttattttaaaagcaaggttttaaagctgtatagtgacataatgagattgtccatttttcagtatcgtcttggatgctttgtgaagagcaggtggaaaggaggcaattgcctagttcatcgtagaagtaatgatgtcttggactagaattagggtgagtgaaaaagagaagtgatcaaattccagaagtctttaggacgaagaattgtggaacttggtgtggggagtgagtaagggcaaagatgaggaccagggttctggcttgggaacttggttgtttttactgagatggagaaaactggaggatgaggcattttattttggacatgttaaagttaaggtgacaatacagcaaggtggaaatgttgagtgtgttgttggttatgcagatttgcaattcaggggaggaatctgacttggagacacagatttgagagctatcagcatatagatagcatatatatatcatatatatagatgatacttgaagacgtggttgtgaaggagaacgtctcaggagagtggaaggcaagaggtcaggggacaggaagcctgcacgacagaaaaggagcaaccgcaagttgaaaaagaaataggaaaatgtgtgagtaaagcttacagaagagaatgttttaatgaaggggaggtagtcaacggcagtacaggctactgagagatcaaagaacattaatattttaaagtagccattgaatttacagttgggttttttttttttaagttaaggggtacatgtgcaggtttgttggatgggtaaactcaggtcatggaggtttgttgtgcagatcatttcatcacccaggtattaagccgtggcacccattagttatttttcctgatccctccctcttcctacccgccccactctggtaggccccagtgtctgttgctcccctcagtgtgcagttaggatgtatttgaccatctgtgagtgttgtttcagaataatgggtgaagaaatcagactacattgggttccttaatttaaggcactatgatgaacaccttctgtgctgggtgctagagtccagaatctgacataatctctgctctcgatacagcagatttgtggcagattgaaaagtaggccgggcgcggtggctcacgcctgtaatcccagcactttgggaggccgaggctggtggatcacgaggtcaggagttcgagaccagcctgaccaacatggtgaaaccctgtctctactaaaaatacaaaaattagccaggcgtggtggcgtgcgcctgtaatcccagctactcggaggctgaggcaggagaactgcttgaacccgggaagcagaggctgcagtgagccaagatcatgccactgccctccagcctgggccacagagcaagactctgtcttaaaaaagaaaaagaaaacaaaagttgagaggtgagcaaatagtgaaagtgaatgtacaccagttctacaaggttggctgagataggaaggcaagaagagcagtagtgatggtgactcagagtggcaaaatcaaattctttattttttaaaattggtggagtttagtttttaggtttgacaggtcaggatcacctgtcatcttagtctagacttcactggttcccattaggttctacactatttctctttaatactttgcaaagtcatttgttccatttttcatataattctcaaagggtaccctgataaagacagtaagcactgttactgttttgttggtgaggaaatagaggcttaggcagttgcccagtgggcctagcatctaggaagactctagctgagtctaggaagactctaggaagatgctgccagaaggaaaaggggtggaattaatgaaactggaaggttgtggtgctggtttgaggagtaaagtatgggggccaaagttggctatatgctggatatgaagagggggttaattccttgcaggtcttcttgagatagaagtccaggccctgaggtggcaggcagcctgatagtgaacagaacccttgtgcccatacttttgccccccgagtttggcctgccctggcgccacaggcagtactggaagctgataagtcagggcacaaattaaaggtctaggaggcaagaccaactgataaacagggggcgtaatgcttcctggggataatcccatctcaaggaaaagcttttggctatttctgtgttagcagatgcgagcaagttgtggaggaaaatgattaacttaaaggccacaccccccaaccccttcagctgtacgggcatctggatggccagacccctgatcagctccaggccttgcctagagtcgcacacaggaagtgaccacaacactaaggcatccggaggctgctggcccagaccacggaccgccccctgctccgccccttgaatctgcagccccgaactggagggaatttccttttatggccccaggctgtcaggcaggcccagctccaaaccaattgttttgttttgtttgtatactttactttataaaatacatatttcttggaaaagaaaaaaatcaggtatagttttaatcccaaaacagccattctcattttcttctgttttctatgcacaggattgctaagtaggggaatcctgctttgcatggtggtttgttatctacctcatcagtagtcaaaagcatttctccttttcaacataaacccttccaaaacatcatttaaattccattccatttttagatgttagtttcagtaccagagccaaatagtaagtttgttccctcttctataagttgtggcctgccttctccaagacacccttctcccccactaacatgcactgaacagctgctgtcaatccattccctcaagaaacttaaaggtctaacagacaagacagtccattaacagatttttacaatccagtgcaacaagtgctgaagtagggggacatataagatgtggtggaaaacagaaaggaccaatagatgttgcagaaggggtgcaagagaaaccaggggaagagcactaccacctaaggaaatgagatgtgggatatggtgaagataacacatttttttatagaggttgttgagatatctaggtggttggtttggtttgaagctcaggggaaggtctgaaatggacagctttgggagttgctggcatgaatgagaatcaaagtcctagagaggtaagccttcccagagagtatgtaattatcagtttttcaggaatcaaaacctttgccccatcccacctccagctcaatgaccattgccccttcctcaaagggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaaggtacgtacaaactccttcgtcatccacatcacatacatgccatgagggtcagtcacaggcactgtaacatacagtagaaagcatgtgtgctcttcccccttttcccatgccctgacaccagtatctcatttggaactgactgtactttctgcctcttctttttgtctggccatggggtccagctattgcagtacaaggcagacatcaatgcagtgaatgaacacgggaatgtgcccctgcactatgcctgtttttggggccaagatcaagtggcagaggtgagtactcagcccttaattcctgagatgggtaggaagtaaagtctgagccttggtgggagattttggaaccctcaacccattctgtcagtactactgtgtgacacttacaggattaagttctacatttgtgcattcatggttggttcagtgactgccagcgaggtagcagtggctctcatcataatggccttttcattccaggacctggtggcaaatggggcccttgtcagcatctgtaacaagtatggagagatgcctgtggacaaagccaaggcacccctgagagagcttctccgaggtccatctcccccatcccctagcttgtgtcctctcgtcccttcccacctgtcttctccctctgtaccacagcttaggttgtttttcttccctagagcgggcagagaagatgggccagaatctcaaccgtattccatacaaggacacattctggaaggggaccacccgcactcggccccgtgagtcaccactgtgggaagaagggttgtaaaaggaaataatcctggcctcttggggctgggttagggtgaagctgggtacctgacctgcccacactcttaggaaatggaaccctgaacaaacactctggcattgacttcaaacagcttaacttcctgacgaagctcaacgagaatcactctggagaggtgacccctgcccttcttgcccttccctcactaaacccccataaattacttgctttgtacctgttttaagtttttcctccagttagtgggcaaggaagtggcagcaacatttcaagcctcctaacccctacctgtcctgcagctatggaagggccgctggcagggcaatgacattgtcgtgaaggtgctgaaggttcgagactggagtacaaggaagagcagggacttcaatgaagagtgtccccggctcaggtagtgcaaggcgtaacctggaagctgctagttccaaggaaccctgaatagcactgaaagagatcttttgtactgggtctcaaccactccctccctcttctaggattttctcgcatccaaatgtgctcccagtgctaggtgcctgccagtctccacctgctcctcatcctactctcatcacacactggatgccgtatggatccctctacaatgtactacatgaaggcaccagtgagtagggatgttgaatttccttggggaggaaatggcagagagggagcctctctgaactatttgacttttgcctcctctcagatttcgtcgtggaccagagccaggctgtgaagtttgctttggacatggcaaggggcatggccttcctacacacactagagcccctcatcccacgacatgcactcaatagccgtagtgtaatggtgaggccacaagctcactcctggcccaggccccaaaagccctttgcctatctatgacttacctccttctatctgttttctcttcctcagattgatgaggacatgactgcccgaattagcatggctgatgtcaagttctctttccaatgtcctggtcgcatgtatgcacctgcctgggtagcccccgaaggtgagtgaagtcatcatgtcgggaggtaaaaaaggaccacctcagaagtagtggaagggggcagagacaggacaggcaagggggccagaacagacaagccctatctctccagctctgcagaagaagcctgaagacacaaacagacgctcagcagacatgtggagttttgcagtgcttctgtgggaactggtgacacgggaggtaccctttgctgacctctccaatatggagattggaatgaaggtgagagcacaacagcatacatttgtgttgcgggagtggttggtgatggtgaaaataactgtagtgggccttggctcctcacatatttgttcggatatacagtaatcctgtcccaagggccagtggcttctctctacatgacagactcaaattgtgaggctgctttttttcttgtattcgcaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatg

SEQ ID NO: 35816 - DNA, 28462 bp, Homo sapiens
agaggcggacaagatggcggcggcagctgtacagggcgggagaagcggtggtagcggaggctgtagtggggctggtggtgcttccaactgcgggacaggaagtggccgtagcggcttgttggataaggtgaggagccggttcttgggaacagttgaatcctggggaggcctgggaggcggcgagccaaccttcccatcccggtctcccttattttctacggccttttgaggggagcccttgtgtgaccactatcacaaccctacgcacgcttggagcctgcccttgccctcatcacacttcaaacctggacccggtcctctttagaacttcttcttttctcgcaagtgttctggtcctggtcgccacacctttttcggtaatttgatttttcctatatttaatcgtgtccatctcttttctcctggggggctgggtgcactgttgtcagtgcccatttcacagacacggaaaaccgaagcccaaagattaaagaatcagtatcccccaaactctctaccaccatcacccttgcgtgctgctacagattccaaagtgcttcttgtccttttgcttactgaagtttttaggcgttttatcatgataggcgaatactgaaaatatttgagtattgactgttctactgggctgacaagaagcctttaagatttttctttttttcctgttgtttttccccgccctctcctctcttccctccacctccctctttgctaccaagtgcactgctgcccgctcacgcttgcccctttcctccctctgctcatccaaaaaaattttttttaactgcagtcctagcaacaagggtttaaaagaaaagaaaaaaaggaaaactgtccctgggttggcctttcttgctctttgcacagcatcttggaagaaacagttgcacggagaacaacgtcctggtgttgattttgcctctaattagctttgtgaccttgaaatatgcttgctctctctatatctgttttctcatctgcaaagtgagagatttagccttaaaatgagggacttaactctaaattcccttccagttctctcattgtagggccctgggctggtttgatgagaattgttaagcatggtgtctttaatatagtaagcagaatttttgaatataattgaaaacagctttcagacttccctgtgcataacacatggtaggtgcttaagaaatgaaaacatgattatgttgaggggttaagatccaggtctttttacttgtctttttgagtgtcattggttttgaaagacatggttctcacactcttctcttgtgagaggggtcacgctccattgcccagaatggatcttagctcactgcggccttgaactcttaagcttaggtgatcttcccaccccagcttcctgagtagctgggactgcaaatgtgcaccactatgcctgactaatttttttgcttttaacttttctgtagagtcagggtcttactgtgttgccctggctggtctcaaattcctgggcctcaagagatcctcccaccttggctccccaaagtgctgggattacaggcataagtcaccatgcacctggcctcacactcaaaccttaagatacagaaacatattctggaggttgggatggtaaattgcttcaagacatgtgagagtatggggaattgatggtcatttgtgtacacaaatccttccctcttgctaggtaagcacctcatagcctgtgcttacctgccccactaactgctcttgctcttccttgcacttggatcatcatcagcaaacattaagtatgggcattctgctaaggcagtatagaatactattattatggaatagtgtatatggcaccattgtgttattgaaagaacccggatgtggggatcataagatttcagctttgaagtatttctgctacttgctaacagtatgaagattggcaagtcacttaacctttcttcatttggaattttggaatctctggcacctagatcacagggttttgggaagaaccaagtaagacagtacacattaatgatctccattacctgtagtgtccagtacagatgtgtgatggtggaggagtaaatcaagaatcctactgtcagagagcactcagaatagccaaatataggagatggggtaattgaatctatttaaggaagtatatggtatattcgctcaagtgtgtacttgttacggaagttcaaatgagagaaatagagtgaaccctgcgagcttattgataagagtaagagcctcggccgggcgcagtggctcacacctgtaaacccagcactttgagaggccaaggcaggcggatcacctgaggtcggaagttcaagaccagccagaccaagatggagaaaccccatctctactaaaaatacaaaattagcgaagtgtggtggtgcatgcctgtaatcccacctactcgggaggctgaggcaggagaatcgcttgaacccgggaggtggaggttgcagtgagccgagatcacgccattgcagtccagcctgggcaacaagagggaaactctgtctcaaaaaaaaaaaaaaaaaaagagtaagagcctgaaggaaaggcctcattcctgaaagtggaactggcaccttatttggggggagaaaagaaagacatgccaggtaaaaaagtctccttgagtaaagttacacagatgtgatggtgttttatgtttctcaggtattgagttgactagaaggctctctaaaggaactgtagtgacaagtagatagcatctgattagggaggccgtggattgcttgaagtagaggaaagctgttgaagggttttgagactgtgtaaagtggtttttaggaaaactattcagatggtttggagagacagaaattagaagacttcttaataaggccgtatacacagtagtgtataatatataataaaaagagacaaatttgagttctagtgccgcatgttattaggttggtgcaaaagtaattgctgtttttgccattgaaagtaatggcaaaaaccacgataacttttgcacctacctaataaaagccacatgaccttggataagttgtgtgatattactgaatttaaatttccttatgtaaatattgtggacattcatacatattataggcttgttgtaaggatcaaattgtatagtgctggtaaatgttctttgggttttttagtttggtttcctctgccctttttattttatttttatttttatttttggtagagacaaggtctcactgtgttgcccagactaatcgtgaactcctggcctcaagtgatctgcccacctcagcctcccaaagtactggaattacaggcatgagccaccgcacccagctctgttccctgtcctttggaatctactagaagtaaatgttctttgtaaagggctgtctgtggtaaaaaatagaatgacaaggtgatgagaaccccaacatgagtagcagaaatagataaaaggtctcacaaaagagtgcttggaagatttaaccaataagtgagggacagaagagaatagtcaagagctgcttgagtgccttttcttggaaaacttagtttcagccttacattgaactgttccctccctgaattcctctagcacttacactgcacatgggaattaagctgtcacttaatatgacatactgtcttgtattatttcaccaatttgtatttgcccgttttcctgtgagtgcttctctgtagtgatcaacacaagataagtacttttagcattgaatttcgcagagaaaaaacttgagatctgccacctcagtcttcagaaacagctttagaggatggtgcctctaattgtttgaagactgagggtactgtgggagagaacttggggaaaaaaatgttattctcagtggagcaggatctgaatgaatagagaggcttttgctgtgtgggaatgagaagctattacctttaatataatttttttttttttttgagacagagtctcgatttgtcgcaatctccactcactgcaacccccgcctcccaggttcaaacaattctcctgcctcagtctcccgagtagctgggattacaggcatgtgcctccatacccggctaatttttgtatatttagtagagacagggtttcaccatgttggccaggctggtctcaaactcctgacctcaggtgatccaacggcctcggcctcccaaagtgcggggtttacaagcgtgcgccaccacacccagcctaatataatttatttaatttgatgtgtcttgatttgggcggggagggtttttattttatttctgcagctgtagtttcacttgccataaagaagtgtaataaagagatgcaaatatgctcctagttttccctaagcagatgtgaatttctactcttatgaaactgactttaagaacacagcaattcttgtttcctgatcttaaaaataagtatgcaaatataatctttccgcctccatcacagaataacttgacttagatcattgcagtatgttattttgccccaaatacatcaaagcattttcttctgcctggcagttataaagaaaagctgcttgcttaatttgttttggctattaaagttgatatgtggtgttaaaccatgctttccagaagctattatctagacccttttagccttatacctggatttctgtctcctggctggcctgtcagcctgatcttaaagcacagctttaatctgtttacatcagactcctttgagaattagttaaaattaacagatttttggacctttttttaggcctgaatatctgcatttttcttcacatgtctctattacctctgcattttaacagttacctccaggttgagaactactggcttaaatgattttttaaagtctcttctggttctgacattttaaggtttttgttttgtttttaaaagctattctgcttaatagtggtttctttaaaatgtttataatgaagagatcctgaaactcatatgatacttcagcctcattttgtagacaaggacacaagcaaagcaacttgcccaagaccacacagtgaattagtaacacttacagaacctggctcccccagtgcttaatccagtgctctttctttactcagcacattgcttcccataccagagtgtgccttgtgctatctaatgtgctagctaacgtagtagtgggatgagcatctgttgtgaggtggaagacctaggctgtggccttggctttgtcacccaccaaccatatgtccttaggtatctcctcttttactctactggaagatatcttagcttgtcagacttccaggtgatatgcttgtgccctgttacctagctctgacaaagaagatgaacggttttataacattactataattgtgtgtgtgtgtttaatgaaacaaggtgctggccttttaatactgttgcaaactgatctttattagcgtctcaaaactcattattttttatttcctcaaaataaaaagtatgtgtgtgtcaaaggccactatcaagaaagtgaaaaaagacaatctacagaatgagagaaaacattttcaaatcatatatctgataagggtctagcatctagactatataaagaattttacaactcagtaataaaaagacagcaacctagtttttaaaagggcaaaagatgtaaatagacatttctccatagaagacgtacgaatggcccatagcacatggaaagatgcgcaacatcatcagtcattagagaaatgcaaagtaaaaccacaatgagaaaccacttcacgtccactaagattgctataataaagggggaaaaaaaaggaaaataacctgttttggtgagaatatggagaaatcagaatcttcatatatcgctaacagggatgtaaaatgtggtggcactcttggaaacagtttgacagttcctcagaaaattcaacgtaaagttaaccatatgacccaacaattccactcctaggtgtatacccaagagaactgaaaatgtgtgtccacaggaaaacttggcacacaaatgttcataacacagttatcataatggcctaaaggtagaaacagtctgtcagctgatgaatggataaatgcaatgtgatatatctatacaatggaatataatttgaccgttagaataaagtattgatacatactacaatatggatgaatcctgaaaatgcgctaagtgaaagaaaccgatcacaaaaggccatatatagtatgactgcatttgtatatccatagagacagaaagtagattgttggctgcccggggataggggacaggaataagatgtgactgctaatgggtatggagtttctttttgagggtatgcatatattctagaattagatagtggtgatggttgcataaccttgtgagtatactaaaaaccactgaattggcattatttttaaatagtgaattttatagtgtgtgaactatatcgcaattttagaaacttatttttgtctttcctggagtaacccttaaagtttcaaattattatttctttaaactatatgtcatgtaacacagtggtatcacagacactgattactttaatactattactttaattactaattaaaatatatatatatatatatatatatatatatatatatctgcctgcctaggtacctttttcagctgttgctagcaccatttctctgctctgatctccatcttatcaaatttcaatagtagttttttatattacttagcctttcagtagcatttgacttattgatcacttcttttttcttgaaatactttctttacttggcttctaggacaccacttgcccccagctttcctcctacgtcaactagtctttgttgtcttcattgttctttggtcttcttcctgacctgtgtaaatattgccagtccctgagcttatgagcttattacccctggccctctcctctgtctaccctcatcccaaggtgatacccaatgtcatgacttaaataacatgtagaagttgctgacttctacatttatattctcaacctggacctttcctataagtcccagacttttctgtccaaccgcctacttgtcatctccacttaaatgtctaaaacatgtatcaggcatcaatagccagagccaatctcttgatttccgcttacccctcaaagtgcttctctcccagtcttcttcatttcaggtagatacctccattcatctaatttattcaaacaaaaacctgagagttacccttgattcttctctttgctttgtactccacagccatctcattgtcgtattttcctggctgtacatccagaatctgaccactcctacctagagagctgtagtagccctttcaactggtcttccagcttccgtgcttggctccgttacattttgttctccacacagcagccagactgatgttttaaaacatagatcactcactctcttgctgaatctctccagtaacttcccatctcagttagctaaactccaaatccctaattgtggcctattttatagcccctgcatgttcttgatcctgcttgtttctgtcatcctcatctgtcagtttctgcttgagtcattatactctggaaaccctggcttttctgctgttcctcaaacacgttaagcttgggggattttggtgtactgttttcactgggacactccagattttctcatgggttactcctttattcaactctgctcagatgttaactattttccctcactattttttagtctttttaaaaactctattgcatttttctgtataatcttttttagagcctggaattatatgcgtatttgtttactttttatcttccatacaagaagaagctctttgagtgcagaatttgtcttgtttatgactatatccctagtggctagaacagtgcttggcacatagcaagcagccattcaatattaatttaaagaaaataaagagtgtaattgccataaaggttgtgtttaaaaatattatttttttcttttaaaagaatgtccaacactggaatgaattgctattgagaggcttggcagtttccttaaaaagaaaaagaaacccagaaaagtcatataacagttaatatttttccaggcagtaggagatggatttcagatgaaacggctgtatggtcctctccctgaatttgcactcagctgcatttttcagaactgattgcatgtaattcttaaatggagcacgtgatctgccacctttctagaataaggactcatcgcacatctgtatcaatgtagtacattcctagccagtcttcgtgccttaattcaggtcttccttggcagcatccctctctcttccaaccctccccagtcagctttgctgcagattgatatccctgaggaaataggtaacattttatccaaaatcttttttgcagatccttgaacttgtagtgtgcccttgcccctctatgtctacttcttaccatttagcacttagcatagtttataattcattgtaagtataggattttccttaactaaattgtaaagaccattttttttgtatatctgatttcttgtctacccattgcaaaggtaagaaattcatactggatgattatgccaacaattcagtcagactttagaagatgttagttgctagtagtgaaaggattgttgactacatttcagtttgctggtagaaaaaaatacttcgttgttggagcattactgattaatatgctgaatcaagttgttttaactttaagctcttttcagccttagatctcacacttactgggttcagtggtgggatgtttaagtcatggatccagtgatctggccctcaaagagcttcagtcatgtaggcttctctattcatgggctgggttgatgtagaagcagccccgtcactgctaaatgcagtttgtggtggagtagagaaggcagtgtaaaacctaagaatcagtttctctggggttgtcactaatgtgtgtgctcataatttaattaacacatggtaatttcctaacttctaactccagtgatgaatgcagtcagtaataagcactgttaagctagtaattttctttgcagtgtatcttggccatttttataaaaaatagattgaaattgaagattcagtgtgttgctaagagcataatctctttgagataccatgtttttgctgaattgggatctaaattagatgacagtgcacattcttaagatagacatcattttcttcccaaactgaacattttcctttcttgctaaatatgtgtgtgtgggggggatataggcactatatatttccaactgaaattgtaatctcagcttctgagtttgccatcagtttttattatctccttattttagtttagaactccacatatacaaatgggtatttatcctttttcctcctgtattcttcttcttggaaaatgacatgatggctccaacaagtcatccaagccctaattctagtaggtggtcatctctgtctcttctctttcatgttccttataactagtctgttactaagtcctgccaattctacctcagaatactccctttcagtccccctactgctgctctgttgagcattgaggctctgcacttacatcaggccccatctgcatctctatgtccagtgttactcccctccagatcatctgccaggttgccactaaaatgacttaaaaaaaaaacgtaaatttgattgttattcccatgcttaaaatactctccattgcctgcttcagaataaagttcaagttctttagcctaataactaggaaatggtttctctcggatgcctcatctcctactactttccccctttgcagcttctgtctactttctaaactgggataaaggagagaaaaagtttatttttcttaaagccatgctcagttctgtctaaatcagaacagggtcaccattgacaccactctcacccttggtaattcttcatctctccagtgtgaattgaggaatcctttgagtcttattatcaagccagggaactttatgaagcaatccactcaggtcttttatatcactgcataacttctgttttcactgtgattaaaataagataattgaaggtgttcatgtgtcatactcaaaacaattttgttttgctggacatatcctaatgaccaaggattttgtccttttgttttttgagatggattctcactctattgtccaggctggagtgcagtggcacaatcacggctcactgcagcctatacctcctgagctcaagccatcttcctgcctctgtctcccaagtagctgggactttaggtgggcaccaccacacctggctaattttttaaattacatttttttgtagatacggaggagtcttgctatgttgcccaggctgatctcagactcctgaactcaagcgatccttccaccttggcctcccaaagtgctgaagttataaacatgttgccactgtgcctggcttattttgtctctttttttgatcccaccctatccctttgagtgtggtgagatgcatgggaacagaaggctgtattccctcaaatgagttaatttggaaaatgccttcctgtactgactacatatccttcagacctgagttgtgtttaatatccttcctaagcacttatggagttcctgatgccataccttcagtgaagtgtctttgtagaattttttattattcaaatgtgcagtggagaaacgtaactgaaatgattcttcataatgttctattaaagctatcaaatgcctgttttctttgaactggttagccagccagctctggcatcaggtgtgttagtctgacaaaagttgtctttatcttggccgggtgtggtggcactttgggaggctgaggtacgtggatcacttgaggccaggagttcgagactagcctggccaacatggtgaaaccccatctctattaaaaaatacaaaaattagctgactgtgatgacacttgtctgtaatcccagctactcgggaggctgaggcatgagaattgcttgaacccaggaggcggaggttacagtgagctgagatcgcgccactgcgctcagcctgggtgacagagtaagactctgtctcaaaaaaaagttgtctttatctcttcagtgggtggtgtaggggagtaatttctttaagatagtactttttgagctctgttttcagccaaattgcagttggttttacattggggggggaggttcaacatttttgataccctgtgagttttgtggtcctattcaagattaacatcttttttttttttttaggtttttaaaatgttattactagagcttgttaggaatcaagatacaatgtatagctgtcacttcagggatctctttgtttcctgttctttgtgtttttgatggctaataattcctttccttgcacttcatgggaaagcagtgtagaataatgagagagcatgggttttgagtcctggctttaccactttctgcctttcacctttggcaggttttttaaacccttagtgttatctgtaaaaggaggattttaactgttcttaccttgtagagttattgtggaaattaagtgagatagtgtatataaaatacttagcacatccgtagcacatgttaggcattcaggaaatggtagctatgattataccttctgtctgccctccatcccttaaagaaattctgtgaataagaaccaagtgagatcattttgaccatgtttacatttgctaaatttaaactggagagtaacattttagagatctttttcttccctttttttctttataaggatttagacattaaaaaaaaaaaaaagctattgagagtatattgtgttccaggctctgagaatacaaaagtgtatagtccctgtgacccagtgagggagacaatacatacagtcaggtaaccatgatgcagtgtattatatagttttatatcattaatagcaacagcaatagctaatttttatgaagtacttgctaggtaccaggcactgtgcactgtgctatgttttataattacactatttacttctcataccaacctgtgaaatagatactttcaccatcttaattttacaatttagcaaactaataaggctttagagaggttaaattatttgcccagtgccttccagtattaagtggaaaagtgaggattaaaataaagtagcctgactccattctcccttggataataaggattcaccttattgggtaaggaaaaaaagcatttgcctacatacatttgtatttagtctaaatccagtcagcttgttttttgttgttgttgttgtttgtttgtttgtttgtttgttttttgagatggagtcttcctctgttcacccaggctagagtgcaatggcaccatctcggctcactgcaacctctgcctcctggattcaagtgatctcttgcctcagcctcccaagtagctgggattacttagcctggctaagttttgtacttttagtagagatggggtttcacaatgttggccaggctggtctcggactcctaacctcaaatgatccatctgcctcagcctcccaaagtgctgggattataggtgtgagccactgcacctgaccagaaccaatcagcttgtgatttgaagtacagtacacctttaagaataaggccacaatctgctttgggattgagttcagggattaaggcaaataaaaataagtttatatcactgaagaagagacagttttataatgagccatgtatttgtaatttagccctaaagaattttgttggcctgtcatttactatttgtatggcacttaacatctttgaactctagttttctaatctgaaggacattggtttctggattgagggtctgcttagtgctgcaataaaaagatgagtggcaatagcagttttacagtgggtgaaaattgacctgtgtaagggatatcatcttgaaattttagatactggcaacataaagaactttttctagatttccagaaggaaaggtgttcaacataaatcacatcatttatacaaacagttgaggcacagtgagccattcttatcactgagggaatgtatttatatcagtgtagggatttgttttatcagccagcttgtcagataccagccaagggccaaccttgcaaacaagccttgctaaagatggcagtcttggacccaggttcacttatttctgcacactgcccttctttttaatttatcctgtgaggtcccacataaaagaaactaatttttgctttctctttttattattacaaaaggaaagcaatttgcaattagtgttgaggaagacaaaattgaggcaaaaaaaaaaaaaagatagcttttaaaatacccgaattagtagtagagagaacatgaggagcagcatacattttagttgatgagcagtttttgagcatgatgagaagtaataatcagaaaaagaagcacctaatagcaactccccttcttccagatggttctccatactgtagtagagacattacttgcttcgaaatgggctgtgttgccgtaaagtcaaattataacctttcttgtgatttcatgtaattcactggaaatgtttcttttccacttactgaagattgcttctaggtaccaggcagtgaagttagagctgaggctatttcaatacattgtaatggctgcttctgcattttattctcccaaattggttaagacattatcctctgacttttaaaggcaagtttcttttctgtgatgcaatgcaggcagtgaagtgtggctaggtgtctgagaatatgattttcctgtttttgaatgacccataatttttaaatgactttattctgactttatttcacaaataattcaaatgctatggtggatttggctctacaagttggttcttttgcatgtcttcaaagagggatttacttgacagtgtaaatgagctatctagctagaaaacctgctaatttctttttggttcagtttgtatctttaaaattagatgtcgtgtttgatttgtaggctggcagtctatggcagtcaatagtgcagtatgctgccatgagtaattttctcaaagaaaaatttttgcttttacagggcaccaagggggaaaaaaaacttgattgacttttaatcactttaagtatggctatttttagctcatgttatttcttctaacaaacttcacagaacaggttttctcttttgtgtaataatatatagaatcacagttaaaaaaaaaacaaggttgatgaattgtatttctgtagttgtttaaaatctttacaattatttttatcccatctcttattttattttttattgtttgtttgtttgtttgtttgtttatttatttatttatttattttcagagacaagctctcactatattgcccaggctggactcgagctcctgggctcaagctgttctgccacctcagcctcccaagtatctgggatggcaggtactcaccactgccatctctttatttcttataggcattatctttgtacttgtgctcaatccgaaagataaatatgacattctctgtctttcagtaaaataatccattctaaatccagatgaacgttggattgcttgctggtttgtaatttttatggaatacaatatttgttcacttgatctaaaaaattaagagttggccattaatggtctacaaaaaacaggtttgtcagattatttgtagcaccctgttcctcttaagctatatttacttaaatacttgcatttgagaaaattttttactatgtaatatattcacatggttaaaaaattttaaaggcacacatagagtaatcttactcctccccgtatttctctaccctgataagatatctggatgtaccgtagtttgtttaaccaatccccttgtaaatgagcactcgagttacctccagcttttcactattacagacaatgctgcagtgagtagccttgtatttcatttcacatgtattcagttatagaaacattcctggaagtgggaagttgaattcagggtgctaagttggcattcgtaggtgctgtaacattttgaacttctacatgagcagtgagagaattatttgcttctgaatagcagtgtttgggaaactttctaaacctctatagataagggaaatagaagtagagtttgtccactcaactcgtgttgggactgagtctgggacttggtttgtaatttaaaatgtagtgttgtttccaacaggctatcctggaattgctatcttaaagttaagacatgctggtaaaataataaaagttgttagctgacaaagtgatattaaaggagatcctccccattttgttagtatctgtaaattcatgtatctgtattttctgagttttgtggtcacagaaagaaagaatgaacaaatagagtaattttctgtactcacatttcggtaaaatgaaggtgggatatacaagtttacacttacagtctgtgcagcccatatacgttttctggttctggggttgtttttatattctctgcatggagactggcaacatcagcatcacatgagtaccacctgactctagtgacctagtctctttcaacctgatttttaattgtttggtcttttttgtttgtttttaactgcttcttgcagggctaccccataggagtgtgcccagaatagcctgttttgtcttttagttctgcaacatcagaagacaaagagtaaatattatatgtgcatgagggatgctcttaaaaaatggttcattttactttcagtaagaggccaggtttcttgatgcacaacttttttgtttgttttacagtggaagatagatgataagcctgtaaaaattgacaagtgggatggatcagctgtgaaaaactctttggatgattctgccaaaaaggtactttcttgaggaggggttggttagtatctatacagctgatggccatctctcctgggaaatcttttccttttgtaacttggagtgaccttagttttcagtgttagaaattaagtcagaaagcagtttctaaaatttctcacagaaaaagtcagaggaagtgtgttgaaatatcaccaacatggcacatgtatacatatgtaacaaacctgcacgttgtgcacatgtaccctaaaacttaaagtataataataataaaattaaaaaaaaaagaaatatagatgttggctatctcaagaaagctggtaattttttgtttttgagattaattagcctagagcacagaagggtgagagaagataggacattcattcatgataaatcatctctccatttgtaaaagtaaaacattttagctgtgggaaaagttgaggagtttaaagttttttatatgagggattgatgaactttttctcttggttctttatagaaggcttgagttttacttgtttggtgtggtaaaatcccaactggagggaactacttggtaattcatatgattcttttatcatggaaatcaagaataaaagcacatactggggaggaagtattcctattagcttgattccttgtttttctcaccaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcatatcctttatttatgctcaggttgttttctagtgactatttttttaaatctgctgatatttctccctacaaaaaacaaaacggactttcatattagggcttgctaatgttagaattcaacattttgagctgtgatgtttatatagtaaatatctatcagtttatatagtaactgtcactgatattttatgttttgtatggttattttatcgtaattcatttttgttattaatgtagaggttattgtcctaatatgagcacttaatagcaaaacacatagtaatagtgaacccagctcttctcatttctagcccagaacttttcccgttagacgtggctgcttcaagccactcattctaggatattaggaaaggatctgattttggagactcagatctgtattaagtttacttgaagctgaggagctgaactggaaagtactgagcatgagatacaagtgtggcttgtattacagtggaattaagaacttattctggagctagagaatatgggtttgaaatccaaggtatctgtgatcttgtgctaatgaaaatttacttatttttgagatgatttgaataccactcatttataaatatgggtagcattcagaattatcataaagattaaatgagagattttatattgtatttgatacataatcatttcctttcccctcttttttatgataaatgtaagatcatggtcgttgcctacccagcgtgattttttttctcaagaagttgaatataaagaacttaattatacttcactattaaaataggtaattttggttggtagtttacttttttaaacaatgttaccactacctaaattttgttttgttttcttttttttgagacagggtcttaccgtgtcacccaggctgaagtacagtggtgtgatcatgactcactgcagcgtcagcctcctggctcgagcaattctcccacctcaacctcctgagtagacgggcacatgccaccatgtctgcctaatttttaaattttttacagagacaaggtcctactacgttgcctaggctggtctcaaaactcctgggcccaagcaatcctcccaaagtgctgggattacaggcataagccactgtgcccagccaacctgaaatatgttttaaaacttcatgttggggatttatcttcagaggcagttagcaaacctctgataaagcagatcctagtcaaaaattgtattatccagattgccccacatttcccccagaagtggcaccaggtgatccttgactcctttcagtaatcagattaatcatcccagtatgaatttttcactattaaggcagttcagaagaataatattccataggttctagagacagttcccaggggaattccaaagagatttgaaaatgatagcaacattattacaaatatctggcctcccaagagaactaccttgatggtaattcatttgtttggttatatttgtttaataaaacaaggtcttatttttgtcatgtcagttttatttataatgtagggactaccattataaatgtcttctgttgctgggcatcgtggctcatgcctgtaatcccaacactttgagaggccaaggcgggcgaatcacttgagcccaagagttcaaggccagcctgagcaacttggagaaatctgtcactactaaaaatacaaaaattagctgggcatggtggcgcatgcctgtagtcccagatagttgggaggctgaggcacaagaatcacttgaatccagggggcggaagtcacagtgagccgagatctgctactgcactccagcctgggcgatagagcaagactctgtctcaaaataaataaattaattagataaaataaaaaataaattagctgggtgtagtggcacacacctataatcccagctactgaggaagctgagatgggaggattgcttgagcctgggatgttgaggctgcagtgagctgagatcatgccactgtactctagcctgggtgacagagtgagaccctgtctcaaaaaaaaaagtcttctgtatcctagactgcatatatccttcatctctaaatctcatgataattctaaaacatcagtattatcccaattttaaaggtaaggatactaagacttggggaaggaagttatttgttacaatcatactgattaaaggccaagatttaaatctaggattatctctactctaaagtccatatactttgtactatattttcctgcctttcctgttcatgaaatttatctattttttaactcttctttaatggaatgcttcatgaatttgcctgtcatccttgtgctagggccatgctaacctctgtatcgttctaattttagtatatgtgctgccgaagcgagcactgttcatgaaatttatttttattttatttattttatttttattttttgatacagggtctcactctgttgcccaggctggagtgcagtggcacgatcttgcctcactatagcctctgcctcccaggttcaagtgattctcctgcctcagccacacaagtagctgggattacgggcctgcaccactacatccagctaatttttttttggtttttgtgggttttttttgtttttttttttttttgagacagagtcttgctgtgtcacacaggctggagcacagtggcacgatctcggctcactgcaaccctgcaacctctgcttcctgggttcaagccattctcatgcctcagcctcctgagtagcaggactacaggcatgtaccaccatgcccagctaatttttgtatttttggtagagacatggggtttcaccatgttggccaggctcatctcgaactcctgacctcaagtgatctgcccacctcagcctcccaaagtgctgggattacaggtgtgagccaccacgcctagccttaatttttgtatttttagtagaaatggggtctcccattgttccttgttggccaggctggtttcaaactccaggtctcaagcaatccacctgcctcggcctcccagagtgctggtattaaaggtgtgagccatcgtgcccagccttgtttatgaaatttaaatggcacagtatacacaaagctcttatgccagtttttggcaaactataagtgcttattaactatggtacttaatactgtcaaaaacaatataataataagtctatatgcatataggaagtaatcgtagtactatttgacatactctcttatagtaaactatttgggtcacttttcttctcttaataacccttaaaatcagttgaacatggtcaagtccactgggactattcgttgttttttataaagaaataagcactattataacaaagtcttgacaaactaggtatcttattatacatgttgtctttgaacataaagatgagagctagtttatgctctgtatctttttcttttcttcctttctgaggtgtttgcagaattaaccagagagagccttgcttctcttggtatataaacataaggatgaaaatgaaatagctaaattttcagtgttttggcagcaagacaaagctgtcttctttaggactatcattatgaaagtttttatatctgttgcttgtcaatttgtgttacttctcttttatgtttgggtattttccccttaactttatttgaacctattttgtgatgatggggattctgaccatttatacctcatataaggagaagagcatctttctcgtggcccacaggaaagatcctacaggaatggatcctgatgatatttggcagctgtcctccagtcttaaaaggtatgactatcctcacagatttttaaatcctggtgttggatttgccctggcatgttgtcattatcaacagaagacttattatgtgcctactctatgtggatcatagggctagtcatataaaatgaagaaaggagtatggatgatctagaaggtttgtcctagccctatagttctgagattgcgttatcacagaaatgctctgaggataaactgtgggagaaggtactttttcctgtggccagttaacagagacgattaagcatacaaaagtataaaggccaaagatgtgagatcagttatctttgaagaattccattagcttctgtgtcttctatgatcctgtcttctctccacgaatacaatcaagaatatctggagcagtgcactgggcaactcaaaaaaagcacaatctagagtctgtttctgaccagtgtcaggtataactttgtgcagctgacacacatgtgttttgtaggtaccaagaactaggttcatgttccaattcagtttctttctagctgtataactttgggtaaatcatataaattatctgaggtttagtggggtcaaaaatgatgcctagagtttctgggaagatgaaataccaattataataatagcaaatgtttattgaacatttactgtatgttgggtattctgctaaatgcattatctcattaagttttagaacactcattttatagataagaatacaggcccaaagtttaaatcaactcttccagtatcatatagcccaaaagtggtagagcaggaattccagcccaagtttgaaaccagaattcatactcgtagtcactatcttaaaaacctattatacttaactggtgcataatagccgcacaaattataggtacaattatttatatatgaagttaagtgtagcatctgtgccatacagactgtctcattgccaacttgtagaagcgcctatgagaaagggaagcagaccttcattctgttgttgcagctgagttcttgcttatctcctgacagggcttctagctgccctttggcctcagccatcataatctgcatcctctaccaggccactgaagctgagttgcagaattctaaaacctagcggcattataatttcattatttttattctgacttttgtattttttaagaacttttatataattcacctaccatacatacagttcacccatttaaagtgtacagttcaaaagtacctagtagtatttacagatatttgcaaccattatcacagtcaattttagagcattttcatcacctcaaaaaaaaaacctctgtactctagctaatcacttccctatcctcccacttgcctgagccctgggcaaccaccagtctactttctctgttctcttttatggacatttcatatgaatggaatcatacaatatgtggtcttttataactgggttctttcacttagtgcaattacttcctatgtatactgcacacaaggttcgttcatgttgtagcatgtatcagtacttcattcctttctatggtcaagtaacattccattttgtttatccatttgttgacagacatttgggttgtttctactttttggctattatgaataatgttgctatacatatttgtgtacatgtttttaggtagacatgttttcatttctcttgggtaatacacctgggagaagacttgtatggtatgctaactctctttgtttgatgaactgccagactgttgtccaaagtggctgccctattttacaatctcactagcagtgtacaagggttctgatttttttcacgtttcctgctgatttttaccaactgccgtattgttggtggagtggaatgtgaatgttcttgctctcttcccggctttctgctgatgtcttctccctcccccacctcaccgactgatttagtagcttaacagtggctgattctgatgtcttattcccactgccaggtcatgtgatgtgaaaatggcaatgaaaggtttcacagactactagttgccacgtgcagacaacacaagctatgtgactctctcgcaaaaagtgattttgtcactccccagcaaattcattatacagtctaaactccttcagcatatgaagtattacagcattcatcccctagtgacatctccagctttcttttatgcccctctcaaaatacattctcttactctggcaatattatggaatttgcaatatgctaagttatccaagtttccagtgaccccgtacctttaaacatattcttctctctggcttagctatctttctgtaacctggctcactcctacttccaagaagccttccctgacataccttagtcttccttaacatgccttagtctaaattaggtggtcctagttattctttttttttttgagatggagtttcactcttgtcacccaggctggagcgcaatgacgcgatcttggctcactgcaacctcctcatccggcttcaagtgattctcctgcctcagcctcctgagtagctgggattacggacccacgaccacacccggctaatttttgtattttttgtagagatggggtttcaccatgttggccaggctggacttgaactcgtgacctcaagtgatcgcctagccttggcctcccaaagtggtgggattacaggtgtgagccaccacgcccagcccatcctagttattcttaaaagcatttatgcttacctctgttagttaccacatggagctataattatttaatatctgtgtctcctcctgggcccgccccctcctccaaagtgtgagctcctttaccattcactatacagtagaaacctaagcccaggtgggactttctcactcaccccttggtaaccagacccagcccagggcctggcgtggcatgttttgttatgtgaatgattgacattcatctgggctgggctgcagccttgacctcctaattagtctttgcctgcagcccagtcattgtcagccatccacaaagtcccctataacctagccatctctatgaacattcccttctcttttttttttttttaaacaacaaattggatccactgaaacttttatttaactttgtaatatgaacatttaccatataaggttataagacaatataaaatctatctcatttcatttatagcatagctataaatcaatctaatctctcttattaatgttttatatatatatatatatttttttttttcctgcatacttaggcaatattttccccaagggatatatcattctcagtaaactaccgcaagaacaaaaaaccaaacatcgcatattctcactcataggtgggaattgaacaatgagatcacatggacacaggaaggggaacatcccttctctttcttaccctaagtgaaacctgaccataacctctgaggacatatttccactgcagactgcaagtggtggctgatgtttctctcacagccttcattactccggtactacaggtagagatgggtctctcctttgcagcttccaatgcgtcctcttccctaaaatcccccctttgaatgcatgtcatcacattgtgccacttctatgcctcttctttgcggttaaacacacacctagtcttttgaagataattcctggctcattggcactctctctaacatttgtcctttcttaagtcttggtgattgccatattcacatagatggttattctagtaacttggcctctcagttttacttcctttcttcccattatcctgttttctatcatgccttaaacatttattttcatagacataccctagtagaccttgcaattaataagaacaaattacctgcaataatttcagttttaagtatcccaccctgaccattgcttcctgttactctcatttatttccttctagttctcttgtcacggcatttcttctgccccagtggcatctgtaacccacttcacttcctccttacctggcttagattccatgacacttctgtagtccagttactctctccctgtcctggaggatctttcatatcttccctgtcctcaaacctgctaggcctcctcccccatctttactctcggttttttgttgttgggaagatagaagccatcataagtctaccatcactactcacctacttccaagtacctatctaaggccttccctcccttgggtctatgggattctatctcttctctcttacttgatgttttcctctctgctggatcattccttctgacatacaaatatactgtaatttctcccaactgaaaaaaaaaaaggttttctttccccttctgcttctcacacagtctcctcatttctctgctctccttttcttcttgtgctatcacctggatctgctcttgtctcctttacttgacctgtcagcagcatttgacatagctaattacccttactttgtaatactttttttttttaactaggcttctcagataccacacacttctaattttcttcttaccttaatgtttgttcctcagtctcctttgtgattcttcatctcccatttttttacatttgaaatgccaccagggcttgttctggaacctcttctctatgatgaagatctctaaatttgtattttcatccttgacctcttctctgaactctaaatatattctggcattctttttgatgttggatcctaataggcatctcaaagtcaacaggtccaaaacctaactcatctctcactcatccaaacctgcccttccctcagtttttcccacttcaataaatggcagtgctgtccttacagagctctggagtcattttgactcctctttctcagtccttctttagtctgtcagcaaatcctgttagctccaccatctaaatgtattgtccaaccatttaccatctccacagctaccatcctctctcacatatgttactgtaatgatgttctttttttgttttgtttttttgagacagagtctcacactttcatctaggctggagtgcagtggcgcgatctcggctcgctgcaagctccgcctcctgggttcacaccattctcctgcctcagcctcccaaatagctgggactacaggcaccagccaccacgtctggctaattttttgtatttttagtagagacggggtttcaccatgttagccaggatggtctggatctcctgacctcgtgatctgcccgccttggcctcccaaagtgctgggattataggtatgagccacggcacccggcccactgtaatgatgttgtaatggacttctgcagccctctctccacccatagtctattcccaggacagcaagcaaagtgatccttttgaaacataagtcagatcaactcagtcttttgctcaaaactctctcagagaaattgccaaaatcctaaggatggcttagaagtccatacatgtctattctctgcactccacacaccgatgcaaacataccctcatctccttggctctcatcctctcccacttcattctgttcacattaggcccctttctgttcttaagacatttcagggatgttcttgcctcagggcctttgcacttgctgttcctttttcctggaacattctttttccagatagcttattctcttacctttcttgtctctgctcagacatctgcttagtgaaggcttttctgcccatctatttaagagaacatcttctttttttatactgtctgttccctcacacacactaaaatgaaagtcccaaaaggcagacatttatattatgttcactgccgtatatccttaccatctaaaactgcctgtcacatataggtaggctcagtaaatatctgaattaatgaacatttctaaaatgtatcaggtcacaactcatcagatcatggactgccaccaaagccatgtaactgccaataaaactgggcacagaagtctaaaaattactgtgatatcaattagcagttggtcagaacttgagaaaatattttgaggtgttgaaaatagttaaaggaacttcactactagctctccaagttgggagttactgcctagaccaacaattattgaggagctgtgaccttttgagcactagttaatgatagacactgttttagtcatgacagtaatcctgaaagcaggtggaagttctcccattttaaacatgcagaaatagagcctcaagaaactgcttcatttaaagataatactagcttgacaatccactgaatatgtcctaataaatggaaacagggtgggggatgtcagcctaccagtaattggtgtcattaaaccctcttgaatgaatggacatagtaatggccttcagggtaccttgaagtatagctaaaggaatctctggagttcatttagtaaagcagttggcatccctggcctgggatcagagtaaaacctggagctagattgattacagagtgcaaggactaggcaccccgggattggagagcatccttgaaagcaagggttcttcatttatttataaaaatttgattgcctactagaagcccagctaagagtatgaagcaattaagacaacaatctttgctcaagaatctcctagacaatcctgattcaagcaccagaaacaaagggaaaagaaacctcccagtctagtgaagaaagtagtacacatcatgtcaacagataggtaattttgttgataccataagagcctattattaggcctggcatatgacaggaggtcagtatttgagttgagtattgattgatggtactgtggaagacagaggaaacacatctgacccagattggtaggctttcccagaaaagtttatgcccaagtatagtgttaacaaataagaacttctcaggtgagataggggagaagagtctgcgaggaaaacctgtctagcatggcaaatacgaagtccagagatgagagaagatggtccacgtggtttaaaagtctacaacaaggtaaaggaggtacacagtaattaaagtaggaaagatatgtcaacacctaagaatcagaactagtatcttgaaaagttaggagccctggggttttgtttttgcttttgcttttaaaggatgtgtttgttccctgtatcaccgtgcccagcttactccttttcttcggaaacacttggtgccgtattgttactggttgaatctctgtgtttggtttttaatttgttatctttgcccccatgcttaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtg

SEQ ID NO: 35817 - DNA, 27299 bp, Homo sapiens
gcatgtagcttctgcagttgctcctcctcaccctccgcgacctgatttcctagaagggctctgtcacccgaaaagattttccactggcttagaggagggagggcccgccttcccccgttatccattggctgctcgttccgccgcaagttgggggcggggttagggcgcctttcgattgcatcagctggtccagccgaggccaagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccggtgagcaaacttggtgggacccagagaccagcctgggactctagtgggtgcagacgctacgctcgcggcgggagcggggggcaggaagcaggaagcggccgggaccgcgtgggtcggagaagtgggggatggtgggactcctggaaagtcggaaccccctttgggaaccatccattcataaattagggtggggccttgcagttcatctgtgggtccattctctttacagatgaggaaacagaccttgagtgagcgacttgttcagagcctcacatctacagtagttagacgcggagacagaatcagaatcttaggcttgaggcttccaaacttgcgtttatggcttactgtaagcgggaaacacattgcagagccttatttaatcaatctcctaagatcctgcgggggtaaagagctccattttaaggaaaggaaaaccgagtgcccgagatctgacccagcttgtccaagtttgggtggttaagtatacattttgcccggcactgatctgggcggtgcatgtgggaagatgaatagggcccagttccccgactttgagggcctcacaggctgatgtgtaagagacaggaaaacagccctagtgctttgtgatcaaccttgtggtattacagaagaggaagtttaggaaggcactttagaatttagtttggaagaatgatttcaccaggtaaacaggcaggacggggcttcccacgtaaaggtagggaaggcagtgaaaaggggcacgcaggtgaattgtctttcgggttgtttgcaagagatatgccagaagggttaaaggaacagtaatcagaaggatcttaggcaacaaggatgtttgaaacttgtattctatacatgaaggatcttaagcaggaagattgtatttgtaaaagtcacgctggcattgggatagaaggttaggccacatgcagaaggctgttgtaatagtccaagtgagaagtggtgacgtcttcagctaagggatcctctatcccaagtctgtgacaggacagttcacttaaaagccaaatttttttcttgattgtccactcgagattgaatggagaaactgcatacgggcacattctaactatgtaaatttaattctagatgataaatggtgactatacgtagatttttttcacataaaatgatatttttactgttttgtaacttttttttttttttttttttttgcttaatagaatgtggtcaacaactttccatgtccataaatattctcctgtgctattcttaattggacgtgatatgtatggttaacacatatgtaatttttccttcctgtaataattatacaatagttaatatttattttgagtactaaatacgagtttggcactgtattaatgcattccatgaattaactcattcagtcttcttttttttgagacggagtctcgctctgtcactcaggctggagtgccgtggtgcgatctcggctcactgcaagctccacctcccgggttcatgccattctcctgcctcagccaccaggcctggctaattttttgtatttttagtagagacggggtttcaccgtgttagccaggatggtctcgatctcctgacctcgtgatccgcccgtctcggcctcccaaagttcttggattacaggcgtgatccaccgcgcccggcctcattcagtcttcttaataacgctgtgaagtgggttctgttattatctccattatacagatgagaaagcaggcgtaggaacagtaacttgctcaaacccagtatccccgtttttttccttcctcaaacccagtatcctatagccaatactaataacccctgtgctgttctgagtgagtcagggacagatcattcctgagaaaggtaattctgtagcttctcttcacaatccggttctgtttcccaacttttgggttgagattttagattacttgtatgtagatgtacataccatatatactcagggaaatagagaacagttgcctactctcttcccagtgttgtagaaaaggggtcataggcctcagggttccagagagacctgttgtaatttcccagctctattacttaatgatacaaatgggcaagttacttctttgagccagtgttcttgtttgtaaaatggagccgtatttagaaccagaaaacctttgtggtgattccctctctctctctccctctctctctctctctctctctctctctctctctctctctcactacccctgttcatttggcaaatggtcaaaaccaaaataatcttatcagaaatataaaacttattttatcatctttccattttaaacctgcacagacctgcaatttttctttctttttttttttttttttgttgtcgttgttgttgttgaaatggagtcttgctctgtctcccaggctggagtgcagtggcgcgatctctgctcactgcaagctccgcctcccgggttccagccattctcctgcctcagcctcccgagtagctgggactacaggcacccgccaccacgcccggctaattttttttgtattttttagtagagacggggtttcaccgtgttagccaggatggtctcgatctcctgacctcgtgatctgcccgcctcggcctcccaaagtgctgggattacaggcatgagccaccgcgcccagccgcaatttttctttttacccagtatacttgatcagttacatcacttctgcagtataacaaaggctctattgaatctaaatgaacctttaaagtttattaaatccagacttctggagtaggggggattttagctcagcatgaaattaggagtcatattttaaaattagttttttttttaattatacaagtaacgcattttataggatttaaaagacaatggccaaaatgtccatcaactgataaatggataagtaagcaatggaatattatttgataataaaaaggtacaatgacaagtattgatgcatgttacaacctgatgatcttgaaattattatgctaactaaaagaagcctgtcacaaaagaccacataatgtgtgattctatttatatgaaattcccagaataggcaaatctatagaaacagaaactaggttaatggttgccagggtctggagatgaaggcaacagggagtaaactgctaatgggtacaaggtttctttttgagggtgatgaaaatactctaaaattgatggtagtgatagttgcaaaacagtgaatacctaaaaaccattgaattgtgtactttacatgggtaacttgtatggtatatgaattgtatcttaaaacttaagaaaactaaaggtcacaaacatgcaaactaattaaaatccctgtttacattcctggcacaggatttattactttaaaactttctatgacttcacttgcttctaattgaagtctgtattccttatggtaacttttagttcttgcttctgtgagccttagtctgtcttaccttgtattactttctaaaacaatccttcattaatcagcctggtttagtcattttttctctctttaaattttaacatttctgacaacaagcttatgtgtacacataggacacatttcctgtattctcagaatccacctgttgaaatgcattccatcctttaaaacgctagtcctagcttatttgacatctaatcgtagcgttactactgtgttttctcctccgggagtttctcacacatgtatgccttactttccctggagagactaggtttacacatggtagggattgggccttatgtttgcttcttccatggcttttgttagcactggtggaattcatgggcacactttgcattcagtttttttttttttcccctggaaatatgcttactgaatcaactgcgtgcttccttgtggccatatgtttggtatgtggtccaagtaaacctgaagcgagagtcacaagaatagttaaaataaaataaatgaaatttgaggagttaaacatcgttagtaactccttcctactttttaaagacttgcctttattgtaagttgttaacctgtctttgccagtgatgaaattgttcagtctttcaatatcagatttccattttttttaaattaaataacaaatactaaaataacattctcaacacttcctggggcatcacaggatggaggtgtcacattagattaaaatataaaacgttttttgcttatttagattggtgctggtgaagagaagcaaaaggaaggaggcaaaaagaagaacaaagaaggatctggagatggaggtcgagctgaggtaaaagttatcatcacagagggctctgttatcagaggttggcaaatcgcagggaactttctgagactttcctaatgtgtaagggttctaatggtttacatggtagtgtaagatggtactggttggaaaaatcaggaagaagaattaggaaagggtaatctgagaggggaaaaaagactttcagttgttactgtaaaaggaagcaactggcgtatgattgtataagatgatctgattgtagggttgaatataaaaatcagagaacaaaagttgaagaggagactggtaattattcagttgccagatgtgatgccagctctgacatttcattaaatgagatgttagggaatagagacttggtgtttgggcttacactgaatacaatgaaaaccaaagaaagccagttttttgaccccctccttgccctttccatctggacctgccctagggttggcttctaagccaggacagatccccttaaggcctctcaagtctgcagaaaatgctttcacttctccaggctcacactgaaaggaactggcatatcaaaagccagccctaaatcaacctggttcctgagtattttgcttttacaggcagttaagcttgcctttctactttatttttactgctgtgaactgtgcttcactttttgctttagtcattacagctgttttattggagactctttagaaagctaccagaaggaagaagcacaaaggaacagcctttttagaagtagcacagtaagctggcttttaagagccacttttacaaatgctgcaattgctaaatttatagtgccgtcatttactttagggtaagtttatagatgatcaagtgtagtgttgcttagaaccctacctaaccatttatcttacggctgatcagttgatcagtctcccgaccattatacccccactgtaattgtgaagaaaattgttgattgtgaattttaaaatttgcaagccaatggaaaaatgcatatgttccctaatttcttttttatactttcaatacaaacatacgtgctgttccatcacagcttgagaaatgacctggaaataagacaaagagtataattagaagactcttctgaacagagaattttaagtgggacatgtgattatttatgtttaacgattggtctggaaaaaagagtgtacagtgaactgtccaagaccttggtcttcccctccaagggcaacttgcaggttttattcatctctgcaatcacagagactgacacagagggtatctgctgaatgaatgttgaagagattttgacacgaaattctaattgggacattgcaagtggctatgatgataaactgcagttaagatacagagggtggtgcaggtgggtaggattataatgatgctttagagtggatggaactgggtactgtgcattagtctgaggggttcagattatggttgtagaatgacaggctctgtctgagcttttagttaattcatgggttcttcaccattgaaggttatggaccgttgtgataatttgatgaaaagctctcaacaactgaacgactaaagaaagggagggactgctgtgggtgggaattacaaagatattagggcctgatacggtggtaggaaccaatcacttgagactgagtgggagaatcactggagcccaggagtttggggccaaaatgcgctgtgactgtgcctgtgaatagtcactgcgctccagccagcctaggcaacatagtgaaaccctgtcgttaaagaatggaaagaaggagggagggaaggaattactgggcagacaattaatctttttcatttgatattattttctattatctccagtcaattttgttttgttttgttttgtttgagacaaggtctcactctgttgcccaggttggagtgcagtggcccaatcttggctcactgcaacctccacctcccaggttcaagcaattcttatgcctcagccccacaagtagctgggactacaggtgtgcgccaccacacctggctaatttttgtatttttagtagagataggattttgccatgttggccagggtggtatcgaactcctggcctcaagtgatccatctgccttggcctccctaagtgctgggattacaggaatgaaccaccatgccctgccccagtcagtttcttaaggattagatattcccttgtactcctttcaaattgtggtatgttgatatatatggagacatatgtatggagacgttggtagcattatcaacattgaataaatgttaaaatctgtattgcagtaagtcattttatatctgatagattgaaattcatttgaagatagaaagtcatggcaaaattaagcaatctcctcttcacttttgtatgaagtgttaatgttcatgtaatttgaagatgatgaatgctgtagatgttagtttgactgttttgttaccacagattcactgcctttttgaaatgttccatagattatagagtgacagtagaagaagtcagctctctgattgctgtctctttttctttctttgccaaacctctagaaacctaagtgggtgttttatatagaatatttttgttaattttatctgctatagaaagtagtagtgtgttgttttatatagttgctaattacatactccaagctgatcatggcatctttgaattcagtaaatactttccttgaaggggagaccttaagtcaaagaaatttgtgattggttgtgagtggacatataggctgacccgctgcacagaccatcacctggacatgaatgaaacaaaatagaaaagccagtttattgtttttatttccagtattgtttatagctctatttgtaaaataatttagttagaaaagatcctaagaagacatcttaaaagagaaaagaccacttgctgtaaatagtagcaaaatggtaattgtcgattcagcataagaatagggcatttaattccttcttttaccttcatttagaaccaaattgaggtaatgccgggtgattttggcagtgtttatttaccacattgaatcaatagtcctgggtttctgtattgtttttattatttctttcccatttctaaataggaaagcaatatttactgatcatttatttcctgatttgtttgttgtcttgcagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattaggtataagctacacccatcatgaccttccatagtttgtggtctaactaaacttccttttattatcttgccatgttttattcttataatatttttatgttaccattcagtgtttttaatctgtttaatttgcctacttgagattttttaaaaatcaaaatgatacagagctttgtagtcaaaattcaaagttaatttctgaaagagtttactttggtcttatcttttggggcattgtatatttttagtcttactatgattataaatgttacaaaaccgactagacagtgtttacctatttcgacttaaatgtcttggttttgaagttaaaaatgaagctacataatctcacatggaaaggttaagaaacttcatataacacatgaaaaaaatgtactatttttataaattcaatgaaagactattcctagtcttaaaacttttattggggtgggaagaagttatttcaattaactgagaattagatgcatattttgtaataggggagaggctttcttaatctgatatgattgggatcaataattggtcagtttatcaaaataagagttggtaaaacatatatatgtgtatatatatacgcgtatatatacacgtgtatatatatatatcttaaactgggtattgggaaactctagtcataatctgtttgtgtatgtcctgaaagcgaaaaataaaaatgattctttttttctttctttttttttttttttttttttttttgagacagagtcttgctctgttgcccaggaggctagagtgcagtggcgcgatcttggctcactgcaagctccacctcccaggttcacgccattctcctgcctcagcctcccgagtagctgggactacaggtgcccgccaccacgcccggctaattttttgtatttttagtagagacggggtttcaccgtgctagccaggatggtctcgatctcctgaccttgtgatccgtccgcctcggcctcccaaagtgctgggattacaggcgtgacccaccgcgcccagccaaaaatgattcttaaatttttaaatagttggaaaaaataaaacaactaagaatatacaacagagaccatgtttggcctgcaaagtgtaaaatatttgtgtggccttttacagaaaaagcttgccaatcttggtcttaaacacttcaacttaaaatatgtgaatatgtatgtattcactaactttatatacatacataaaacagtgaatatatatatgtatggcaaggtttgggggatagcgagtgctaattagagttcttacattatcttaacacatacgagaagtagtctgagcacagaatccttgcagattttcatgtagttgtagagttacacctaacttgacagtgtttttgtgtgtgtgacttggatttatcaagccttctcaaacattcaacttggttttcatagaatccataattcccttattgtgttattttataattatatatttttgaagtttatttataagtgttatgtattgaattgaaccatttggaatcaccatatgaattgtcatgtggttgattatcatcaattttgtattgttgaaccaaacacgtaaaagaacaagcacaaaaacagtttggggaaccaacgtggctgattcttggtaagcgtattatacaactagtagaagcagaaccagttaggcctatgagccatgagcatctactgtaccacagacattagttagtactttttacaaagtgaatggagtgtttccattcatttgacaagtgcttctacctacaagttcttctaccttactccaaaggaagtaaaaagttgtaataccatgcaagtttctatgtgagagcatagagaactggatagacctttacgtatcagttcaacctttcattttagagataattttgaaggtcaggttgattaatagattcctctgttgtcacacaatgagattgtagccgtgtcattaaaatttaggcttctgttagtttgggaactttttcctctaccttctacaatgttgatctagattacattgtaatttatcaagtcttcagttgaaaaatattcttcaagaactataaaattctaagttgaattacatagctgggcgtgttggctcacagctgtaatcccagcactttgagaggccaaggcaggcagatcacctgaggtcaggagttcaagaccagcctggccaacatggcgaaaccctgtctctactaaaaatacaaaaattagccagtcatggtggcgcacacctgtagtcccaactacttggaggctgaggtgggaggatagcttgaactcgggaggtggaggttgcagtgagccaagattgagccactgcactccagccttggtgacagagcgagagtccgtctccagggaaaaaaataaaaggttgaattacataaaacattgatgggctttagctctggagttaagtcactgatctgcactgagaatactttatgaaatttttacaaaagtccagaataactttttgttctgtgaaaaattataacattgataacaggctatttaaagattcacataattagtggtgaatatgaaagggaaggacaaaaaagacatgttccatttgcgtcaaaaggtttttctttgaagttttgttataaatcttttttttttttttttgagacggaggagtctcgctctgtcgcccaggctggagtgcattggcgccatcttggctcactgcaagctccgcttcctgggttgacgccattctcctgcctcggcctcctgagtagctgggattacaggcgcccgccaccacgcctgcctaatttttgtatttttagtagagacggggtttcactgtgttagccaggatggtcttgatctcctgacctcgtgatccacccgcctcggcctcccaaagtgctgggattacaggcgtgagccactgcgcctggccgttttgttacaaatcttaaagattattttacccttctttgaaaaattgaaatgatccagtatggcccatgtgtaatctacattttcagagtaactctattcttagaatcttggggctccatattggatcataagataaaagtcatgttcttcccaaagaatatagagaatatgattatcctttttatcagttctttaatctcctgaaaactgttttacaccaatatgatgaaatacatttctctctgccaaattcatgttatgttttgtgaaatgcatgtatttattttattgactccatctgatctcaggaggaaagaaaacattgtttataacctatggtaaagttagtaggagcattgaaaatagaaaggagtttgttgtttactttctgtttggttcttttctcttgatcctcagataggagttgtatacattttgttgtaaacccttagacatagagagccaccaacacagcaagcctggctagcttaaagccttctagtggtaggtttctttgagatttacagtgtaaagggtgtatactttttcttcacagtgtagaatgttgcctaccttcgttgagatgtccaggctgttatagactattatttctctagctgtgcatttagatgtataatctggctcacctactcaactctgctctagtcacacagcttcctgcaaaaacctctcttcacttgcatctctgcttgcatctgtggccattccctcatctggaatgccatggcctcctcttttcttcctgtgagtgctttatcctcaaagcctttccagatgactctgacctgtactgctttccctcctcagaactcctgtagcttttacactctgtgtgctctgatatttcatcacttgatgatactttatgttcgatgttgtatattgggtgtgtaatgtttttactcacattatatggaaagttttattaaatagtctttcattttacctctatatttgttataaatattatcataggcatttgcagaatttattctgaggttagcattgtctgtcaaagaaaggatctggtgtacattttaagcaggaagaggaacagagaagttatttagtaggccttttttttttcctttggagtctacatagcttagctttgtagaaagagaaaggtgggtgtattaagagaaaactcggtgtggtgacttgtgccagttgtcccagctactctagaggctgatgttggaggattgcttcaggccaggaggccagcctgcgcaacatagcaagaccctgtcgctaaaaaattaaaaaaaaaaaaacttatttgttggagaaattaagattattcaaaccattggaaattgatagtgcttatttatcagagttgccatatctgcttaaacaggaggcattcaatgtcaaatgataatgttctgcattttcaggatcttccagttaggttcttaggtacatttttggaatttgttgtttttatcattatatttcagaaaaatagagatacatcaatataaaaaaacaatatataataaaaatagtgtttattttcctgttttcaaattagattcgtgtgtacttatatatgtgtggacttttttttttttttttttttttaagtcaaggcctggccgacaacaccgttattgctaaagtaaataatgttgtgtgggacctggaccgccctctggaagaagattgtaccttggagcttctcaagtttgaggatgaggaagctcaggcagtaagttgctgattagtattcattgaattttaggatgcagattcacatttgaagtcttttccagctcagtcctgctgcgattgggtggctaacatttattgttgtctcactgtcatatttgaaatcttcattttgtccttcatttagggaacataataaaagtgcttgccttagaaaataaaggggtgaagctgaataagtcttttcattactagacacttcaatagggaaaatgttttgggaattgtattaaacattgattaagcaagtaaaaattgttttctaaactgtgaacactattttattttaattttttttttttttaatgatggagtcttgctttgtcactcagactgtagtgcagtggtgcgctcttgcctcagtacaacctccacctcccaggttcaagctattctcctgcctcagcctcccaagtagctgggattataggagcgcactaccacacttggctaatttttgtatttttagtagagatggggtttcaccatgttggccaggctggtcttgaactcctgacctcaagtgatctgcccacctcggccccccaaagtgctgggattataggtgtgagccactgtgcctggcctctaagctatgaacactctagcaagatatgtacatttgacaaataaatttgaaccttacttcaaagcactgcctttattggataatttctgtatttttttctcatcttaagatgcaaatctgctggataacactataaaagtcaacctgcatgtgatgacaagattttctttttaattctccatggctgtgtatcatataaggggagacaaagtattttgttttagtgatgattgttcacttatgtatgtggattagtggttttcaaatgtattttggagccctcaagtttcttacgagaattttttaatgtcactttggtaccttaatactaaatcttgaaaacattgctttgggtgtattctgactcatcccagtgattactttaaaaccaagtactgccatttgatttcagtgtacagatgtttgtcctcgtgttttgtcattgtgttgtggggtcgggttgtaccacctttgttttgggccagtaacaacatgtaatttctaagtgatgttccatagccagctaaaggccagatcacagtgtctgagacatggtgctgtgggcacattgactcaaaagaacctgggccattgcaatcaatgagttagtcacattgtgagtagcagttgttttcagagaacaaagtctatgtcatttaattagtgatgccaagtttagtttaatttgtttgaaaacagctaaaccagatgatttccaaaataaaaatacactagtaattggaagccttttgaattactttggctatggatagaaacagtagtttatagatttagaaatttaggattttatatattgggtttacttgtagtaaatattatcatctgtctctttcagacaaccacattaattggcaacttgtatgccaagactcagaccatgccatttttctttaaattttcaggtgtattggcactctagtgctcacataatgggtgaagccatggaaagagtctatggtggatgtttatgctacggtccgccaatagaaaatggattctattatgacatgtacctcgaagaagggtaagccatcaactagataaagaaaactgaagtcaatgactatggatccataagttattcttaagagttctcagtaagggaggaatgatatagatctcactgcttcttcatcaggtatgcccattatcagtacttgaagtgttgcaatttacctgaagtaatagaggatttgatgagacctctgttctagattgatggaggtagagtcctaaggtattttgggaaattcagggagactggtcctcccctctcctttaaaacctggtgatagagttgcgggaaggggtcactagtgagaaaggtctccatggatgaccaaggtagaagctactgaaaatataaaatgtaaaaattacttatgaaaaatgttttgtttagaattctaagatacgatgcaatagtctaattttttaatattaaaacccttgaagtattccaaatactatttccaaatgaacatttttcgaagccatggtgtgattcgaatggaatgaaaagattatactttcttctccttcaggggtgtgtctagcaatgatttctcttctctggaggctttgtgtaagaaaatcattaaagaaaaacaagcttttgaaagactggaagttaagaaagaaactttactggcaatgtttaaggtaaattgaaccatagtgcgtggcccccactgttaatatcatttattcatgttagttgaagtgacaccactggcgttccgtgtactaagctgaagtctaattggttctttagcaaaaattaagtgtttttattatttttttaatttcatttttttcctagcaaaccattccttcaacatgtttttaaaacatgaagtatcaacatttatattcatacagtgctacgttttagctatagtacttagaagtaaaaattaaaggacagttttttaaaataataatttttcctgttttcagtacaacaagttcaaatgccggatattgaatgaaaaggtgaatactccaactaccacagtctataggtaagaatattagatgtcattaaatgtatctggtatgtatgtcattttgtctttgttaaaattcctttcattttatctttagatgtggccctttgatagatctctgccggggtcctcatgttagacacacgggcaaaattaaggctttaaaaatacacaaagtaagtaatgtaactttaaagactgtgaatgtatctgtctagaatagatatatgtttaaactttcactgatttctctttaccattttctgttgcacatgaaaggatggtattttctcatgctctctattaactgggagctgtatgccatcaggattttataattgaaatccctcaaggggtgactgacttgctgtcattgccagagcaatcacaggggatggagattttacaaaatcatacagcatgggccatcctggctctataaaagctttgagactcactgggagtatgtgcttttgccctttatatgtctaaattaataatttcccaagttgttgtttttaacagaacccagttttatactagttcataaacattttatggaggtttttaaaatgcactttaaatcaagagaataattgagtcatttcaagattttttttttattggctcatttctatttttgctcattttgtgagaaatgcctttgcaggcaaagtaatgtttgtggaattgtggttgagtattgaggggtgggcagttttgggggtattggggtgtagaatgggtctcactctgttgccccaaaaagacagagtggaggaccacttgagcctgggaaatgaggttgcagtgaatggagatcgtgccactgcactccaggctcaagcagtcctcctgccttagcctcctgagtagctgcgaccataagcgcacaccaccatgcctgggtaattttcttttttttaaataaagaatggggtctccctgtgtttcccaggctggtctcgaactcccaggctcaagcaatcctcttgcctcggcttcacagagtgctgggattacaggcatgagccactgcacccacctgcagattgagggaggggcatttttgaggatagaaaacagccaactttgtgctgcagaatgagtaactactctaacaaggcctcaaagcaattgggagttaaaataagtgagatgtttacaaatttgaatgttgtttcatggttaatccttgttttcagaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggtatgttcaagaacaatgatgtgtcttgactgagttttcttcaacttcatttgaagtttgaaattcagctgcatgaagtactaggaattttgttttgaagagatgttgtggctttttagtaactggtgctatgtcctgtacaaactataaacacttactgattgtccacattatctgcctggagtatgctcagtaccgcacaaaaatgcatttgaactacttttattgagagcaaacactgatgatctacggttttctgtaaaagaagtataacagcttctcatagagctgggagaactatggaaaccctctagtttcactgactcatttaaaatgtggaaacagagtcccacaaagattaacctacttgttgcccaaggtttagcagcatgtcgcacatggatcctgtgctatcatttcctctacccattatctctgttactgctgaatgtcctctaaactggaagttaggctagataaaacattcccccttaaaataggcactctgtgccaggggtccttggctattaggttatgaagcttgagctggaggtagcagccactgccttgcacccctgactacctgacattccagctatgaggcagccagcaatgattgatgggcccttccctgagggcttttgggcacttggggaggcggatgttggcaaggaggtaggagggtgtgtttctttcaccatgacccaaagtcagccaactttaccatcatctatttcattatcagtgtctttttcccagtctccttcctgatactcttactaagaaaataaatacatacataaataaaatgaaaaaagatccagatcttggagctttaaggaatttaagaaccatgagaggtactgcagtggatagttaaagaactgaagggacccttattccctgccactgttggggaaacttgactggattgaggaatataacaggcagggcatgtgttacacgtctgccaaattgtaaatcagctgcaattctataacatcagaaacactgacatggtttctttgattcaggagtggcactgattgaaatatgggacatcatgaccatattctgagctcaagaacactgaaatttatgtatatatacacacacgtatacgtgacgtacataaacattcttttgcttttcttttacccaggaccaagaactatatttctttcatgaactcagccctggaagttgcttttttctgccaaaaggagcctacatttataatgcacttattgaattcattagggtaagtcatatttattgctttcttctttagatttaggatatgtgatcattttattaaataaggtctactaaaaggaaagataatctgtatttgagaagaaatatataagacgataagtaaaagtagaagtctgtggcctcataaatcatccctaatagttgattttgcccatatacacatagaaactggtgagcttgaagggggacctgtggtccttgacataggagctctgtgccctctttgactttgatcatttatttgtattttctttgaaaaaacggtttttacattgcttttttcctttgtaaattatgaaatgtttcaagtataagtttatagagaatagtatatccaatatcttgtacttaactacccacatttaacaaatattcacattgggctatatttgcttgagattttttcattcatgatattaaaaaaaaaattagttgtttaaaaagcctctctttaggacccagttttgatccatatacctccatatactggtatatatatccatatactggtatatcatataccagttttctagaagaaactactgttttgaagttggcatggattctttttgtccatgttacttatatctagcccatgtatttgtacccttaaattatttatgtatttgtgtgttacatataggaagcctcattgtgtatcagactgccttgtgatttatttttagagacatgcaaatcaagtttattttcacttgctacatattattttgttatataactaccacaatgcactcatccctgtattgatggacactgatgtataattgtcccttattatcagccatgctgcagtagcatcacttttataagcctccttaggtacatgtgccaagagttttctctctggtatatacttagaagtgggatttctgaatcatggcatgtgtccatctttttcatgagagagtataaaatcactctttaagtttttactcccacttgaagtatgagcatttatttgcctacacatgtttctgtttattttctatcagagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactggtattcggcagctttgaatttctactgaagattttcacatgctacaattcatcctgggttcttccctcctttaacaacattttcattaaaaacaaattatgtgatcagaagagcatttaaacgcaacatctttgtattatatcttctgcacctgattagatccccactttttttttttttttttttaaagaggtcttccaactggagtgcaggtatgcgattatagctcactgcagctgggactgcaggtatatgccaccatgcccagctaatttttaaaattttatttctgtagagatgaggtcttgccacgttgctcagcctggtctcaaactcctggcctcaagcggtccttcaaccttggcttcccaaagcgctgggattacaggcatgagccactgtgcccagccagatctccagatctgtgggcattcagtaatggtactgggatcatagcaatgaccaaggcagactataaaacaggaagatgaaatatgggggtgtaacaaattacctagtgtgttgttgttttaaagaaacctgttctgtcaaaacctgctaatgactcagcattcttggaaaatgttccttgtcatgaggccgctctgctttctatctttgaaagttgggtgaagaacagcttaagggaagacacaggagagctgtggatacaggtagcttagtgtctgcagctcctactagccaggcctggagggcagaggaggtgagagaagaatctttgtgaagaagctgtattataggctaggggaccaaccaagttcattcttaattttcccagattcttcagttgttggaatacgttttttaattcttcactgtggttcattgagttataacttatttgctgttttattcatgcaagtgcttttactgctgtatgtagcccagaatttgagaaatgttgcttggatggacagctagaatcagtggctttttgacaacctttcgtgtaattaaatatagcattacagaagcagttttattcttaagtgtccgtggacttttctttttctcttcagccttatgtttgatcatcggccaaggtcctggcgagaactgcctctgcggctagctgattttggggtacttcataggaacgagctgtctggagcactcacaggactcacccgggtacgaagattccaacaggatgatgctcacatattctgtgccatggagcaggtatgagaccctgggaataaaatacttagaaagaagagtcaagaaagtcaaggaaaataactactgtttctttttttgttttttaatttgaagattgaagatgaaataaaaggttgtttggattttctacgtacggtatatagcgtatttggattttcttttaaactaaacctttctactcgcccggaaaaattccttggagatatcgaagtatgggatcaagctgagaaagtaagtggtgtttttcagcgtgcttttgaatactgtttgaaattggcttgttctgagatgtaagaaagccaagcctctttaaatggataaaagcaaaatgaaattggaaatggttcctaggtttgtgtaagctagtttttttctttatgattgtgtatttttgaaatggttgaatgttttcatgacttttttcagttatcaagctataagctttaaaaaggggttggtatgagcatatgttcaggtggacaaaattctaaagcagagaatattgatctatgaaagtaattactgtatttttagtctcaaattaggctaaaagaagggaaattgcgatgaaaaaaataaaaatcattttgctttatcctcagcaacttgaaaacagtctgaatgaatttggtgaaaagtgggagttaaactctggagatggagctttctatggcccaaaggtgagcactaaagtacatttgggtaatatgattttcacttgtggatgaagaagatacgacttcgaaaaaagttggaaaaaagaaaatcagccctaatccaactattgagctccactttagtatcactggcattttataataacccagtctttgcttcttagattgacatacagattaaagatgcgattgggcggtaccaccagtgtgcaaccatccagctggatttccagttgcccatcagatttaatcttacttatgtaaggtgagtttctggtgtctgctctgaatattctccagggatatataagagaaaatatatataataagacaaaacaattttttttttctttatagccatgatggtgatgataagaaaaggccagtgattgttcatcgagccatcttgggatcagtggaaagaatgattgctatcctcacagaaaactatgggggcaaatggtaatttttgtcactgtcttttttttctgattagtataaattggctacaagaaatgtctacttttcgatttaattatcagatggaaagggagaatgattccaatcggttgcttctaactaacgacaagtgttcattaaaaaataaggaatcacaatctaaacacaaactttttagcattaagaacaattgctaatagtaattactttaattccagaacttgatttgtttggatgttgtgtaatactttctaattaggaattagtattctgtaagaagtatacttactgttttggatgcttttctagtaactttgttttgggatttagatggctttgctggttttacatagataaatgaggaggcttatggctttcttcgttcagccttgctaatcataacaagcaggtatttggacatgttttaaaagccaagcattttttaaaacagatgccaaaccgatcaacatttgtgattcatttctgtgaggttaagtaagtttttgtttccaagatacatggccacataactttcatcttaattcttaagcagttttttctggacccacagtgcatttgaaagcagcacagggttataaaagcacccgtgtgtagagccttccatattaatcatattgatttaaaacttttgtaaaatgacgtacattggtttaatcttacacattactgtcatttcagttttatttgaacttggttacttcagaaattaggacagtttctcattctgatcaatgatacaagataatctctagatttctcaaagtcagataaaatgtgagacacattctctgcaaggtatttcaagaattaagggagtcctcagctaattgctctgctaaacctgttttaggtggggaaaagtccatgattagggtagaatttagtgcctactttagccttttgcctgatacaacagaacaactgaaaatagaggaatgatggagaaaaacattagcctgatgtttgcagcatcagaagcatttgacacttgtattgcttcaaagggagaattggatgggcttattttttaataagtagtgaaaactctgatttttaccaagtgccataaccagttattatcaattacaatttgctgaatgatacaaaatggatgttgagtaaactgagggcactgtgtccccgtgaagaataagtaataaaatgaacaattaatcactacatgcagttattaaatcatttgttacctcctctcacagccaatacacagtgttttgtgatgtattaaagtgtgaggcctagtcctatcctcaatttgctttgctatctacttagcaagacaaattgtagttacaggctttccttacgtagggttagttttcttctcctgcatctcctcgccttaatctttattggataggtcttttcattttggggttttttaaagccaagttttaaaagtagtcgttacatgttccaggaaaagatactgaagagtagagtaagaaatatgctgtccctgtttagtgaatatgcccacatctacactgaatatttttattctcttccaaaggcccttttggctgtcccctcgccaggtaatggtagttccagtgggaccaacctgtgatgaatatgcccaaaaggtaagccttagatatgaattttctttcaatttaacatctgttgttcagcttttcaaatcacataagccctgtattcttggtgaatcgagctgttgtgataaagagaaatgttactatttttaatctttgttaagcctgaatagattatattacttctttaatgcttttctccatgattccataatcagaagacatatttggatagtgttttatgtacacttgtatattttattgtatttgttttaagagatgggatctttctcttgccccaactggagtgcagtagtacagtcatggctcactgtaacctcaaactcctgggctcacgcagtcctcccaccttggcctcccgagtagcagtgactacaggcaggagccaccatacccagttacacttgtatattttagtatttagtattttaaaaaaccagattagcagatatcaggtacttcagtatggtaggtaaattcccgttcaaaatacagtttaggctgctctttgactcagtgagtaattttgcttcattttaatgtaaatttcttcaggtagttgaaattttttcaggttaatagtatagcagaccaatgtcttgcctctctaccaaaaaaactaacttaccaacaaatgtatagccattcataacttcactttaaagcattgttctgccatagtgaaaattccatactaaggaatttcaaattattaaaagttgatgagtgaacaatactgtaacatcaaaaccatcatgtcttcagaccatcagaataaaccacactcagttcttaattacccttaagaaataaatgaacttgagcatggagatgcatacctgtagtcccagctacttaggagcttgaggcaggaggatctttgagggttcagggtgtgatgattgtgcttgtgagtagccactgcattccagcctgagcaacatagtgagaccccatctcttaaaaaaaaactgaagtgggccaggcgtggtggctcacgcctgtaatcccagcactttgggaggccgaggcgggtggatcacgaggtcaggagatcaagaccatggtgaaaccccgtctctactaaaaaatacaaaaaattagctgggcgcagtggcgggcacctgtagtcccagctactcaggaggctgaggcaggagaatggaatgaacccaggaggcggagcttgcagtgagccaagatcatgccactgcactccagcctgggtgacagagcaagactccatctcaaaaaaataaataaataaaaacaaataaataaataaaaaaaatgaagtgaacactaaaccatctaatagataaaccattcagactattcctgttactgcactcagtagttttagttacaaatgatgacaatcaaagttatgttccatggttgagtgcactttgtcttatttgtatgtgaaaactcacacagtaggaagaagttctgtattggttaactgagttctcaactggagacagcactgacttccccatttccctttgcgggtaggtggcattccagattatgtggtggtaagcttttcttttgcggggagagaagacagggcagtactcctgatacctaataactatagagcagacatgttaaacaccctgtaattatcaggccacttccccaactgcagaattgcccatctcacgtgcacacacaggacccatgttgagaaaaatgaagaaactgatgccttattctttaaagtagttataagttgaagatgtagacctatcttggcattctaaaattctgtaacaacccttctgaaatgggtgtaataaaatgtcaacaggttaattggttcgtgatcactgtggcttaaaaatctagttaaaatgctaagacttgtgcacagtataggcaaagtcacttagattgtttcaaaaagtatgccttatagaaataaacatttgacatacataaataacccttggtttacacataactcgcatttgagaaatgaatgtgttgtagatcatttagaatctttttcaatcaaaaattgaaagaaatatttcgtcacccaggtcaaccagagattgctggttttactcatgatacttaagtagagtatgatagttactatttcaccttcagctgtacttaagatgttttcctggaaaaattcattctgctttctgaccaggatttccagaaactctgacccttctaagaggtctgggtggaattgtgatggtgattctgctagtagacagtgtaacttctgcgtctacaaaaagaggataggccgtcactgctcacatggctttgcgtgaaagcccaatggtactgtctctatggcagagatgaggaaggaacaccagcgtcctccaactttcctgttcttcctttgggttaatggccactgtaaggaaacagttttctgccacgtgtggggtgatttgaatgtaaaatgcccaactctcatagcaggctgaacagaaacattttttatactcattgttaatttgttctaatctaaattacttttagactattaaatattattctattttaaagttaagggactaatgcctctgataacctgattaaaaaaaaaaactttctgatactcagaagttaagatttattcagttgaagatcatttctttcaggtgttgatcgtgtgatatttttcacatctgtaatctgaggttcatatgaaatgatagtgaaataaaattgttcatttaggtctttttgtcatgttaatatgttatcaggttaatgggaagtttaatctagttaatgtaaaattaataaattgtaatctagtttattgcttttttggaaaagaatactgaaaacattgtttacttaatacacatgacctgaggtaataaagaggagctggcctttttgaggggggaataatggcagtgaataatattatctaagacagttttgccagctttaaattcctggaagttcatccaagaagtcctgatccctgtgttcagtaaaatcatgtgagatcaaaatataattctgattttagatctgacaaattctgtatctctgttacaataggtacgacaacaattccacgatgccaaattcatggcagacattgatctggatccaggctgtacattgaataaaaagattcgaaatgcacagttagcacagtataacttcattttaggtaagaatggaaacttaccaaagaaaatttgccacacctcaggaaaatctactgaaaccttgagacaggtttaagtgaattgtaatcaagaatttatttagttccttccagtcctgattttttttctattatatattttaatatataataactataaaaataggctcatgcatacatactgggtttttttttttttcacttaaatcatggatgtctgtgagaaaatattttgctattataacaagaatgaagacgcattgcttttaaacacatctattggattactttctcaagataatgccttatgtgggattacttgaaaaaagatattcatgatgtttggggttttattatttggttgttacgttgtctagattgactccataagcacagtagttttagatattgcaaagagtttcttttaaatatcaacacatggtcacttgtaccttttaatgtatcagaagctatggggtaggttttgggtcctaggatcatttcttttcagatgttcagtgtgaattcttccatatctttagattaagtctgacaaagctttgtgtgtttgttttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgtaaaaataaaaaaaaaatttattcacataa

SEQ ID NO: 35818 - DNA, 19877 bp, Homo sapiens
gacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaaggtgcggccgcgcaggggcgcggggacgctgggggcggaggcggaggacgctttctggtggccgcgagccgcgttctgcgtctaaaaactttctcttttcttctcgcgttttttgggccacctcttccacagttcagtgaggagtagtcactgtcccgtgacagaacccagagcagtaacagtttacggtactgctcactcgtacagcgttctctctgcgcccttgaaagtgttttgagtaagggaggtgtttatgccactgtagtgacaataagcctattttgttcagccataccttcagttcccgtgagatggagactgttgcttatcctcattttacggatgagaaccctaaagttcagagaaggacgtttccctgcccaaccagcctggttatttctcccagagcttacccattcattcattcattcttcattgagcacttttttggacgggcactgtattccgctggactcagaatgataaacacagtttcccagcgcagtggctcaaacgcctgtaattctggcgctttgggaggccgaggcgggcagatcgcatgcgcccaggagttcgagaccagcttgggcaacgtggagaaaccatgagtctaccaaaaattagccgggcgtggtggcgggcacttgtaatctcagctaccgggaggctgagacaggagaatcgcttcaacccggaggccgaggttgcagtgaaccgagatcgcgccactgcactccagcctgggtgacaaagttgtaagaattaaagaggaaagaaacacgaaaggtggcttgccagtcaagacaggtttattttagagaaaacaaacctgagaggcgccttctggcggagttgggtcagagtaacactcttttacagactaagagtttttaaggattcagggtcggagagtttatcagaggcttgaactgcttctgtgtctcttcgttgtgcttatctgggagggagagttgtgtgtctgttcccatacatctttcttttttcttttcttttcttttcttttttttttttttttgagatggagactcgcgctgttgccaggctggagtgcagtggcgtgatctcggctcactgcaacctccgcccccaggttcaagcaattctcctttctcagcctctcgagtagctgggattacaggcgcgcgccaccatggcccggctaatttttgtatttttagtagagacggggtttcaccatgttggccaggatggtctccatctcttgaccttgtgatctgcccgccttggcctaccaaagtgttgggattacaggtgtgagccaccgtgcccagcctcccatacatctttctgcagctgcaggcatacccccctactctgcttttagcttgcctattttagtgcacctgaagggaaaggaatgtgcttattaaggcccactgttttactggggcccgttgtatgaaggtgaagtttggcagttacccaagaaattttcttcccactctctctctgtccgagctgtctttctgtgttttactgtctcctctttctggctgcttgtagttagaagtgatttcctggccgggcgcggtggttcacacctgtaattccagcactttgggaggcgggcggatcacctgaggtcaggagttcgagaccagcctgaccaacttggtgaaaccccgtctctactaaaaaatacaaaaattagccgggcatggtggcaggcaccttaatcccagctacttgggaggcagaggcaggagaatcgtttgaacccaggaggtggaggttgcagtgagccaagatccagccattgcattcaagcctggggaacaagagcgagacttctctattaaaaaaaaagaaaaaagaaatttccttaaaattcatgaggctagaaagggggctggaacttaaagtggcagtgtttgtctgagatgttggtgctcttactatgtcaaaagtgagaccctatctcaaaaaaaaaaaaaaaaaaagaaaaaaagaatgtttctagtaggctttcttgtcttcaccagaacccgccactggaaaaagaaaaaaaaaaaggcagagggagatttgagacacagagatgatggaagcagagatgggagtaatgtggctacaaactgaggaatgtaacagtcaccaaaagctgggagaggcagggaagtatcctcccctagagcctttggaaggagtgtggccctgctgacaccttgatttgggacttctggcctccaggactgtgactgtgaaggaatactttttttttttttttttttttttttgagacaggatctcactctgtgtcacccaggctggagtgcagtggcatcctcctcctcctgggttcaagcgattgtcctgcctcagcctcccaagtggctaggattacaggtgcccaccaccacacccagctaattttttttttgtttttttgtttttgagatggagtcttgccctgttgcccaggctggagtgcagtggcacgatctcagctcaccacaacctctgcctcccgggttcaagcagttctcctgcctcagcctccctagtagctgggactacaggcgtgtgccaccacacccagctaatttttgtatttttcctagtgatggggtttcactgtgttggccaggctcgtctgtaactcctgacctcatgatccgcctgcctcagcctcccaaagtgctgggattataggcatgagttaccgttcctggcctaatttttgtatttttagtagagacagggttttatcatgttggtcaggctgatctcgaactcttgacctcaagtgatctgcccgcctcagcctcccacagtgctgggattacaggtgtgagccaccacgcctggccaggaatactttttttttttgagacagagtctaactctgtcacccaggctggagtgcagtggcacaatctcagctcactgcatcctccgcctcctgggttcacaccattctcctgcctcagccttcagagtagctgggattacaggtgcctgccaccacgcccagctaatttttgtttttttgtttttgagatggagtcttgctctgttgcccaggctggagtgtagtggcatgatctcagctcaccacaacctctgcctcctgggttcaagcgattctcctgcctcagcctcccgagtaggtgggattacaggcgtgcgccaccacacctggctaatttttgaggaatacattttttaagccatctggtctgtggtagttcatgacagtggcctgagcaacctcagccccacctgaggtggccccagggagagcacctggcagtctttgccctttgctgcccccagcactaggctaccatcatgacgtttctgggtttctgacatttgccagtttgcccacaagatggcaggcaccgcccagctgttggggttgaagcagctcataggccttgagttgctgacggcccagtgcggtcagatcactggctacagggacagaagggaggagttactacccccaaggtttctggctacagggcccccatcctgtcacccgccttcccaaacagtaccctgattcctcaaccatggccacatcttaagccacctggggccagtgctggggccatcctagggccaggtgaccttggtggatgtggcctcctggctttggtggttcctgggctcccaggtgatcgtagtgagcccttggggttgaagagcaatgctctcccaccccggggacacacatgcgtcctgatggtaggatcgtccctggaagtcgaggaaaaccacaacggttccagagcctcacgtcagggtcacggtctgcacatttgttgttgttatgcttcccggcactcttgtctctccagtgcactctgcagcctctgagcacttccgcacgcacagtctcctgggcacctgcatttcacacaggggcggctgaggccaccctggtgcccccgatggcgccccactgtgtcctcactttgaaagcccaacagccagcttttgtctcttttttttccctaaagatagacagggtctcactctgtcacccaggccagagtgcagtgcagtggcatgatcatagtccactgtagcctcgacctcccaggctcaagcgatcctccttcatgaacctcctgagtcgctgggactacaggtgcatgctaccacacctggctaatatttataatttttttatggacacagggtctcagaccgggcacggtggctcatgcctgtaatcccagcactttgggaggccgaggcggctggttcacaaggtcaggagttcaagaccagcctggccaatatggtgaaaccccatctctactaaaaatacatatagtcgcggctactcgggagactgaggcagaaaaatctcttgaacccaggcggcagaggttgtagtgagccgagatacacgccactgcactccaacctgggtgacagagcaagactccatcaaaaaaaaaaaaaaaaaaaagactatgctttttgctatgttgcctatgctggtctcaaactcctgggctcaagcagtgctcctgctttggcctcccaaagcactgggtttacaggtgtgagccaccacacctggcctgtcttttttaactgagggtggcatgtggccctgggctagtcacctaactgaagtccacctcagaaggttgattgagagttacttatttattttttattgagatggagtcttgctctgtcacctaggctggagtgcaatggcgtgatctcggcttactacagcctctatctcccgggttcaagtgattctcttgcctcagcctcctgagtagctgggattataggcgcccgccaccacacctggctaatttttgtatttttaagtagaggcggggtttcaccatgttggccaggctggtctggaactcctgacctctaatgatccacccacttcggcctcccaaagtgctgggattacaggcatgagctaccatgcccggcctataatatgtttctttgcatacttgaaaaggtacatatttcacctgtccatcccatttgcaggtggggctcgatttctgcagccaccaccctccgcatgcctttgacattcttctaggagttatttatttagatggcatcttgttccaaatcatagccagatacccactctggctaccagggcctgagcagaagctgctgggtcctcttggcaatggcagcctgagtcaggctggggccaggtctgcggcggcctgggatgaggacacgtttgacatccacgctcctccctcaggctggggagaaggaagagatgtggcttggaatctgtggttctcggcttcagaggacagggcagagtgactccccctggtttgggcactgggtcctttgaccctgtgccttgacagctggcaggccctcttgctgacagccttctcagtcccctctgtttagaggttgttggagtggcgatgccaaggtggctgggccccttcccaactgtactttcctctcgaagcccccaggggcctgggcgagcaccctcaggccatgggctgagctgcactgtgcccacctgccatgggcaccctgggaagtcagccagcctccgggggcagcatgcaaagctgtgttctggagagcggtcccagcctccctccctggcctgggctcaggggcagcttcattatcatcccaaaatggatgttgccacaggttacctccctcttgctcctcagttctgtgcaatggctgggctgtgggggtgtggcccaagtacagagccattcccagggtctcccctggccagggctgggcacagatgtcaccacactggggcagccaaactgagctcaaaatgtcttgagacaaaagcagaacagaatcaagccacagtggccccatgtccagaggttagaggtgcgggtgccaccctggcttcttaagtgtgactggggcagacactgaacttgggagcaagcctccttcctggggtggtgtcagcgcgggatgagatcaggcaccccccgtgtagggtacccccagcagaggccactcgggctacggaggatcagggctgggactcagacctccaaccctgccggagaagccacctgtccccagtgtacaggggcctgtctgtcatgctcaccctgtgtgggctgcgctgggcctcccactgtgcgtcctgactcacattggttcccacagctatcaagcccagagagagacgtggagagggacgtcttcctgtatagagcgtacctggcgcaggtgagtgcgggccttggccgggggcaagagtgatgaacagagtagagggtggggctggggacaggaaggcaccacagagtgggtggcggggacagtaaacaaagcagggacccaggcctgcagtgttcagtgactgtgaacagccagcgcagccagcatgtgaaggtggctgtgtcacggaggcctgagactgccaggccagggggcctgggtcacagcttcttgatttttttttttttttttttgagacggagtctcactctgtcgtactcgatctcagctcactgcaacctccgtctcctgggttcaagtgattctcctgtctcagcctcccaagtagctgggactacaggcgtgcgccaccacgcctggctaatttttatatttttaataaacacgtggtttcaccacattagccagggtggtcttgaactcctgacttcatgatccacctgcctcagcctcccaaagtgctgagattacaggcgtgagccaacgcgcccagccgatttttttttttttcctaaaataattggtaggagccaggcacagtggctcacacctgtaatctttgggaggctgaggtgggaggatcacttgaagccaggagttcaagaccagcctgggcaacatagtgagacccccgtctctacaaaaaaaaattaaaaaataagacagtcatggtggcatgtgcctggagtcccagctaattgggaggctgtggcaggaggatcagttgagcccaggaggtcaagattacagtgagccgtgatcacgccattgcactccagcctggacaacatagcaagaccttgtctctaaaaaaataagaatgggggctgggcccggtggttcacgcctgtaatcccagcactttgggaggccaaggcgggcagatcacctgaggtcaggagttcgagaccagcctcaacatggagaaaccctgtctctactaaaaatacagaattagccaggtgtggtggtgcatgcctgtaatcccagctacttgggaggctgaggcaggagaattacttgaacctgggaggcagaggtttcggtgagctgaggtcacagcattacactccagcctgggcaccaagagcgaaactccatctcaaaaaaaaaaaaaaaaggccgggcgtggtggctcacacctgtaatcccagcattttgggaggccaaggtgggtggatcacaaggtcaggagattgagaccatcctggctaacacagtgaaaccccgtctctactaaaaatacaaaaaaattagccgggcgtggtggcgggcgcctgtagtctcagctactcgggaggctgaggcaggagaatggtgtgaacctgggaggtggagcttgcagtgagccgagatcacgccactgcactccagcctgggcgacagagcgagactccgtctcgaaaaaaaaaaaaatggggaaggaaccatctaggagggaacacaatgagggacgggcccccagctgcagatgtgacagtggtatcagtctgggcatcctcagagggccagtaggtgggcagggctggctgggggcatgtcctgctttatagaagcgcatgtcacaacccccataactgctgctgccctgcccccaggtgacacgcccttcacctcaccaccagaggtggacagctgccaggggatagacagtaacctaccagggtccctagctcaaggcatgggcagtgtggccctgcagatgagggcacacctggctgctcacgacaggtgacgccatgccaccctccacagtgtactgcagtggaggtggcccatgctgggctgaggggtccctggtggggcagggacttcctgtctggggctctccctgccaagctgaagacatggaaatcctctggggtggacgggtgcagctgacgcctcgtccctactgcagaggaagttcggtgtggtcctggatgagatcaagccctcctcggcccctgagctccaggccgtgcgcatgtttgctgactacctcgcccacgagagtcggaggtgaggccccagagaatgggttggcctgaggcgcggggccatcttcaaggcctgttggttatgaacctgggtgggtgggggcatggcgtgcagcgcacagcatccctcagattaggcgcctctcccctctgctcccctgctgctttgtgcctcagtttccctcacctgcacagcagtggggggctggtgatggatcctgcttcaaaggggagggtcagagacagtgctgtgtgtgcacacgccctcatggaccacaaggcactctctgaacctagaactgaaaatatcaattaccgagcagccctctgcaacacccagagccccaagacagcccagggcgcagcgggggcagggccctcccatcagttttcttatttatttatttagagatggagtctcactctgtcaccaggctggagttgcagtggtgagatctcggctcactgcaacctctgcctcctgggttcaagtgattcttgtgcctcagcctcctgagtagctacgactatagctgcgtgccaccacgtccagctaatttttgtattttagcagagactgggtttcaccgtgttgcccagggtggtctcgaactcctgagctcaggcggtctgcccacctcagcctcccaaatcctatcagttttctagtcccagctagttggggactgcaacctgccagtatctcccctggagcccagtgggagggtgggtgaggccacgcctgtcctgcccctgagccacaggccagcgttggtcaaacgcccatgggcggcagccaaggggagagggggctgggctgtggggacccaggaaccttgccccctcctgctgtggggtcggagtgagggtctggcatggggagactgctgtgatcctgctcttccttggcccacggaggcagtgtcccaactaccgcctcccttcactcaaagaaacctggggttcctgggagctgactcctgtgcagaggcagcatggtggggtgaatggtgtcccccaaaaggtacgtccatatcctatcccacatgcttgtgaatatgatatcatttggaaaaagggtctttgccgatcagattaagagataaggagatgaagacatgctggatttagggtgggccccaaagccaaggacttgtgtccttttaagagataaaaggagggctgggtgcagtggctcatacttgtaatcccagcactttgggaggacgaggtgggcagatcacctgaggtcaggagttttcaagaccagcctggccaacgtggtgaaaccccatttctattaaaaatacagaattaacaggatgtgatgtctgtgattccagctacttgggaggctgaggcaggagaatcgcttgaacctggcaggcagaggttgcagtgagccaagatcgcactagtgcactccagcctgggtgacagcgggagactgtcttaaaaaaaaaaaaaaaaaaaggaaagaggcccacagagttaagcccatgtgacaacagactggagtgacatgtctgctagccaaggagcaccacgagtggccagcagccaccagagctgggagagaggcctgggacggccttgccctccagcctccagctggagccagccctgccgccaccttgacttcagacttacggcctccagagctgtgaggaacgaatccctgttgtccttaactgcccgggctgtggtgctttgccacagcagctccaggacattgagacaggtgacctcccagggccactgtttctcccaccctgcacttacttcaccagctggagtgaaggcagggaaccctgggtcccccaggagcagcagctgctgtgagcatcacagaaaagcagccccggagagcaggcggtccaggcaggggcttgtggtccgttcatctggctgcacagccgcgacctcattggcaggacgccccggggacaaggagcatccattagtaattggttttggttttgattttgttttcttgagatacggtcttgctctgtcgttcagcctggcatacagtggcacaatcttggcttactgcagccttgatctcccaggctcaagtgatcatcccacctcagcctcccgaatagctgggactacaggcacgcatcaccatgcctggctaatttgtatattttttagagatggggttttgcctggccgggcgcagtggctcacacctgtaatcccagcactttgggaggccgaggcgggcggatcacgaggtcaggagatggagaccatcctggctaacacgtgaaaccccatctctactaaaaatacaaaaaaaattagccgggcatggtggcgggtgcctgtagtcccagctactcgggaggctgaggcgggagaatggcatgaacccgggaggcggagcttgcagtgagccaagatcgcaccactgcactccagcctgggcgaaagtgcgagactccgtctcaaaaaaaaaaaaagagagatggggttttgccatgttgcccaggctggtctcaaactcctgggctcaagcgatccgcccagtaattgattttgttgctgttgcttgtttttgagatggtctccctctgtcacccaggctggagtgcagaggtgtgaccacagctcaccgcagcttcaacctcccgggctgaagccatcctcctgcctcagcctcccaagtagttgggactacaggcgccaccaggcccagctgactttcttacttttttgtagaaaaaggggtcctactatgttgcccagggtggtcttgaactcctgggcttaagcgatcctgccttggcctcccaaagcgctggggttacaggtgtgagccacagtacccggccccattggtaattgtaacaccttaggatgacaacattacagtaccaacgctacgacaactggcagtgtttatacacccttgtgtgctggagcctcaggaagctttgtaagatggtcttgggagctccttgctcctcccctgcatgatccctgtaacatggtccctcagcacggggaaacagactcagacctgaagtcacttgtctgttggacctggcactgtggcgagccctcagtggagcctggttggtatcagacatgccatgccctcagtgacacctcagacacgggccctgggcagacagcccccagatgcgcgtggatgcttacggggtcacagagccacgtttgaacccagaagaacaccagctttggtctagggtggccccctcacctgccttctctttttagctgctcaatagccatggggaatggagggtctgggtccagttagggacatggaggcatgggtgacctgtgccctcggagctgagccggtcctcagccttgcctgggctcaagcctggccctggcccgcagcacactggccatcttcagggtgcagccagcaccctgggctctcagggactgagggcagctgccctggcagtgggggtgccccagggctcccatccttctgcacggcccctcggcacccaggccgacctcctgctagaagacgtggccttgaagcccacagggttgatgggttatggtcaggagtcccagctgggcccaccagcctcctcaggaaggcgggtgaggttggtgtgagactgacggtgcctcctcatgtccccttggagcgccccaccccacatctcccggcctcgggtccttgcctggcccagcatgagaggtgcttcataggaacggagggaggacatgtcgggacagctcgatgctcggcctgctgctgctctgcacccccagggcctggctcaccctctctggacctgtctgcttccaaggaaggggaccctctgaggtcccacagaggccaccccagctgtgggtcgtgagcatctctgtcttgcagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtggtgagtggcctccctgctctggggccagcccagggaggcaagtgccccctgccacatctccaggctgcgcacggcctcgctggctgtcgtcatgggagcagagaaaggtggtgctgaaatgaggccctggcctgctgtccaggctccagctcccctgcccagtgtgggaggcactcccatctgcgcaccaggctgcagatccaaggacacggtgcccaggctgcaaccctctgttcccaagggcagagcagaaagcggctttgtctctgctcggtttctgtgtccccaccccccacgaagccttctgtgtctcggccctgggcccagtctctcaggcctccccgggccccccataccggccctcctccagggccctctggggttggggtgctgaagccctgcaaggttggtgcccccctccaccctaggatgtgactccgggccatgtccagggcactggtcacagaaagtgtgtcagttcttccccgtgagctgtccctgcagtgcctgccttccactgtgagttgcaagctgggcatttcatggtcgctgtggatctgctcccatcccacctccatccacagagggcttagaattgcagggcgagccaggcatggtgacatgcacctatgtttccagctacttgggaggcggaagcaggagtatcccttgagtctgggaggtggaggctgcagtgagccgtgatggtgccactgcactccagcctgggtggcagagccagaccctgactcacacacaaaaaagaaaataaatagggatgtcacactgtcggcgagccggccgactcggtgctggtccaggtgctggctcctgttggcaggaaaacaagaacaagaggcctcacgagtaattcgtggtcacagccacctggggctgagagggatgaggggacgagggggcctgcagagagtgggtggccccagggctctgctgcaggtgcaggtgcaggggcgggtgcgtggccctcctctagggccttgttcctgagtgttgatgcctccagggtgtcgagtccgggcagggccctccatctggaagcacagcccatggaggctgcttctccagatgggcggtgagtgggccggggcctgaaaccccatcctgggtacctcccccagagctcctgggcctgaggaagctgagcggtgaaatgtgggagtgagggtgtcctcctctgctgggcggggctggtggtcctaagcacaggacttaggaacatcccagacacacacagtgagccctgggtgtggagcggccatgcaatgtgtctgtggcgacccgctgaccgccccctcgccctgtcctgcagcacagccatgacagtgcagatcctgctgaagctggaccgcctggacctcgcccggtgagccctcctgcccctctccacccgcactgagccacagcccagagcgtcacagcccagagcgtcacagcccagagcgtctgtggtgctgtcattactcttgttgtctttcctttccatgggggtggcttgctgtcgttcagcccttccctgcagtatgttgccagggaggagggccatggctctctgtgcctcagtttctctctatgcagtgggtggcaggcctctcccacagggtgagggtgggcttcatggagggagagtggaggttgtgcctggagcaacatgttacttgaccagcttgtaactgtgccgtggggctggcggggcctgcacgtggcatcaccaggtcggaggccatggctgggggtccaggactcccctgctgccgtttccaaagcccttgcctcagagttgttcacactgtagttccgttgcccttccctgcgttccatcctccatggagtgagtctctcctgagctctaccttgtggtggccaccctggggggccatagctggccccagtcccaccttcccagggcctgcacgtggtcagacgggcagggtggctcgggcacttagtcgtggggtatgagcatgcagtggagcacaaagcaggggccatccccaggctccggtgggccccaagtggggacaaggcagggatggccaggccagggccctcggccactcagcccctctgtcatctgtccccgccccaggaaggagctgaagagaatgcaggacctggacgaggatgccaccctcacccagctcgccactgcctgggtcagcctggccacggtgagccctaggccatgaggtgggtgggcattgcgggcacctggctgagcagggtctgtgggcacccccacctgtgcgtaggctgctggccactccagtggggctccaggatcaggccgtggcccctgccagcctggcataactcagccttgactccattccgggcttctcacagccaagcgacttggccagagccagagcgaagagatggtgggggcggggacgggttcctgagcctgaggcacaggggtactcgagggtctgggttggcctggcaggccctcctcccctcagggcttcctggggttttctgcgactcagctttgctctccagggtcctggtcgccagccagggacggagttcagtgttcccatagcagcggtggagatgtcctcagctcccaggcctgggcacctccgcccggcaacagcccctctcctggtttctgggacttggcccccttctgagccactcttttgtgtgggcctattaaaatgtgcttcctggctggtcgcagtggctcacgcctgtaatcccagcacttcgggaggccgaggcgggtggatcatgtgaggttgggagttctagaccagcctgaccaacatggagaaaccccatctttaccaaaaatacaaaattagctgggcttggtgccatgcacctgtaaacccagctactcaggaggctgaggcaggagaatcgcttgaacccgggaggtggaggttgcggtgagccaagatcgcgccagtgcactcctgcctgagcaacaagagtgaaactctgagaaagaaaaaaaaatgtgctccccgtccctgcccgccacggggctgaagcctcacccagacagacttccagtgaccgtctagtatggtaggacaggccccggcagacctatcgggtagtttgggctgttttcactgcctgccttggcctcaggctccccctgcaagtgttctgctgttctgagcaagtggacaggtcagggctgctggtcacagagctgactcctcctcctctgacgtgctcagtgacccagtggtccccactcagaccctgagccagccacctgtgcactgaggccttggaagccccagattccacctctgtgtactcagcactccgggagctgggtgggaggtggggcaggaggcggccacgagtctttaggccccatcagcagagtacaagttacgggtagtccccatggcggagtggctgtgccttgaaccgggcacaccagattcgtctctgtgcagtgctggagtcccccccgctaggggagggggctggcgggggaagggccgggcagcaggggcacaggcaatgatgcgggaccctccctgcagggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggtaggcacaagcctgtcccagagtggggacggagggaaggccaggcggccagagggtggggtcagggcggacagaaacaagtgtagcagagaccccctgggtgtgcgtgtggccccacagggcttctaaggcccagtcagcagcgagatccacaaagcagggatctcacctgcaaagaaatccagattccggcctcacagaaatggggcatctgggcagcctgggcctcagtggtctgagccgtccttgttgtcacctcagctgcctggcccgggacctgcaagtgggacccctcacctgagtacatactcagtattggagagacactccccgtacttatgtaggggagagtgtgctgtggacaggagctcttcgttgagagagcgctgcctgcccagggtggctgcagtcatctcctgcctgatgtctgcagtcttttcttccttccttccttccttccttccttccttccttccttccttccttccttccttctttcccttccttccttccttcctttccttcctttccttcctttccttcctttcctttccttcctttccttcctttccttcctttcctttcttctttttttttttttttgagatggagtctcactctgtcacccaggctgcagtgcagtggtgtgatctcagctcaatgcaacctccgcctcctgggttcaagtgattcttttgcctcagcctcccaagtagctgggattacaggcggctgccaccacgcctggctaatttttgtatttttagtagagacggggttttgccatgttggtcaggctggtctcaaactcctgacctcaggtgatccacccgcctcagcctcccaaagtgctgggattataggcgtgagccaccacgcctggccatctgcagtctttatgaagagtttatgttatgttaaattaaaaatatatatatattttgtaaagacggggttgttcttgctgtgttgcccaggttggtctcgaactcctggcctcaagtgatcgtcccacctcagcctcccaaagcattaggattataggtgtgagccaccatgcttggtggattttttttttttttttttttgagatggagtcttgctctgtcgcccaggctggagtgcagtggtgtgatctcggctcactgcaagctctgcctcctgggttcatgccattctcctgcctcagcctcccgagtagctgggactacaggcgcccaccaccatgcccagctaattttttgtatttttagtagagatggggttttgctgtgttagccaggatggtctcaatctcctgacctcatgatgctgcccaccttggactcccaaagtactggattacaggcgtgagccactgtgcccagcctggattattatttttataatcagaaaggacatcaaagctttttccattttggagaaacgaattttggggggttttttgtttgttttttgaaacggtatgccaccatgcgtggctaatttttgtattttttgttagaaatggggtctcactgtgttgtccaggttagtcttgaactcctgggctcaaacaattctcaccctccttggccttctaaagtgctgggatgatagacatgcgccagtgcgcccagctgagaaacagttttaatctagtgacaaacactggtgaagccctcctccctgtctgactttccaggggctgagttatcatcagaaagttgtttgcagagcggggctggccaaggggtatcaggctggccccatcacaggccgggtactgctcctcctgagcagggtccatctttagctctgagcagtcagggctagtcaggaactcccagcctgatgtgcaatctcagacaggctgtgtgtccctcgctgccccaggggcaagactggcgccctcctccaccaccctgcccctccctgccacctgagaacacttggatgcatgttgtgttcatggccgcatcctctgggggcttttgttacacctctcaggtgacacgttccgtgactcaccagttagatgactcccttctgtccttgtctcttgaaacaccacctggggctggctggccgtgccccttggccctggtggcctccccgtggctgtggtcaccctgcattcttgctgggttttgggaggcactcaggtccccccacttccctttggagccacctcatggctgctcctgtgagcgcaagctggtgtcccccttcatggtggagactgaggctcagaaaagtccggtctgcaaaaaggtgccctgccatgggccgccgtgggcaggtcgggctctgggcgcatcctcgttggtgtgtctgtgctccaagcagacaccagggctctggctgggtctcctggcctagatgtttcctagggtcctgtgtgctgggagcctagagtgagtgagtcaggcaaggtcccctgccgaggtctccttcaaggctccttgggagctggtgcaggggtggcaggtctgcccatggcctcggggttcgttgtacagcaggagttgaggccatctgggtctgggccccatggctttgagatgtgtgggacaaatacaaccttcccaagtctctgtaaacaaggggtcgtaccccaggctggactacagatggggaaactgaggctcagcgaggcggctggccccttggcaccgtatcatctgagatctccaccttgcagagcggtgggcggtgtcagtcccaccccacctctgaggaggtgaccttgtgtggtgctgcctgaggtgggggtgacgggcaggcatgggggctggagtggctgaccctgcctccccgtgtctgcctgtgtctccaggatagtggctacccagagacgctggtcaacctcatcgtcctgtcccagcacctgggcaagccccctgaggtaagcggcccccagggctccaggccaaccctaatgtccagaccctgggaccccagcctggggtccaggccctaatccctaggcccctgggaaaactctgtatacagtatgcctaccgcagcccacctccctcacaaaccctgtgccccccaacccatcctcacctggggccctgcccgacctgctcccctgaacaccacaatacatcccccaccatgtacggaggccagctccatgccagcgcctctccagggggcaggcccatccctccacccccaccctgaaggttctccgagatcagcccagtcccaaggcagggtgaggagccccctggggtactgtggctctcaccccaatccacccctgtccagcaggtcagagccaccgtggggtccccgtgttcggctcacctgcctccctgcctcccctgcaggtgacaaaccgatacctgtcccagctgaaggatgcccacaggtcccatcccttcatcaaggagtaccaggccaaggtgagtggtggggatggcctgtccccgagaaccaggccagggggcgcctggagctcagcctgggctcacatgcgccctctctctctccctccacctgtctccccacaccctgcccccaccctgtgttgccatgtgtcttgctaaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 35819 - DNA, 63335 bp, Homo sapiens
ggcagttagcccgcccgctcggcgcagggcgtggcttctcgtagccattaggaaacagcaaccctttcacctcagttttcttcactccggcatttgcagcagagcgaaaggtggtcgagtcctgaaggagggcctgatgtcttcatcattctcaaattcttgtaagctctgcgtcgggtgaaaccagacaaagccgcgagcccagggatgggagcacgcgggggacggcctgccggcggggacgacagcattgcgcctgggtgcagcagtgtgcgtctcggggaagggaagatattttaaggcgtgtctgagcagacggggaggcttttccaaacccaggcagcttcgtggcgtgtgcggtttcgacccggtcacacaaagcttcagcatgtcatgtggtaggtgaggccggcgcctgtaggctggcggtttccttcctcttggtctttgtagagacagtttgcagaacagcggagaaaatgggtattgtatcgtttcttacagagtccgagtcttgaaatgtagatgacaatgtgttgagtggactgacagatccttgagaatattaagaaagtataactatgtaagaatgcttctctaggaattttcacaccatttaatcctcagaaatcctgagacgttggcaaaacacatggggtctccatgtttttacaagtagggaaagcaaggctcagaaagatcaagtggcgtgcccagctggacacagactattaaatggggcggcgacgacgaccccagggcttcctcactctctcaggcagtacaggacagtgattaaacgcgtcgaccacattgcctgggtttgaatcctgccgctgcttttgagtagctccttgagcttggacaagtttcttagcttttctgtacctgtttccctgtctgtaagttgggcctggtaatacttacttgtagagtggttgtgaagttgaaatgtaaatatatgtgaagcagtatagacatgttagctactattattacaattaagcagctatactttgttttttgttttttgttggttttttttgtttgtttgttttttgagacggagtctcattctgtcgcccaggctggagtgcagtggcacgatctgggctcactgcaaccttcgccccctgggttcaagcgattctcctgcctcagcctcctgagtagctgggattacaggcacctgccaccgcgcccgactaatttttgtatttttagtagagacagggtttcaccatcttggccaggctggtcttgaactcctgacctcatgatccacccgcctcggcctcccaaataagcagctatacttttgaatgttggcgtgatttatgtctaatgaataggcctcatgtcagtgtaactgtggaatctgtatgttccactgagttcacccctttgtgaaattttaccattagtgcctagtttcatctgtagcgttgtgtattgcttcaggattctttttaagaatgcaccaggtaggcagagtgttcttaattttgctccacggtttcaaatgtcaaggaaacgttggaagttggattttggcattcagtatagatgcagagttgaaagcaagatcaaactgggaggtgttttgtgaaagttgagataaacgtgtattaagcttcttttttgaagcttttctgaattcgggatttaccgggaaagtaggacgtttaattttagcggagtagtgcaatgatttaaccctgactagaactctgacgtttacagctagccttgaggccatgttttcagccagtgtgcggatttgccggggtcagactccaagcttgattgtgagttctagcctttgtcagaaatgcagcaagtcatgctaacttgcaagggagtcaacagagggcacgcggtgcctgcggggccgggacggaagccccgcccccggcgcagttcccgcctgttagcgggggagaagcaccttacacgctccgctctgcttttgtgccacacagaggacggtcgggccctggaaggaacgctctcggaattggccgcggaaaccgatctgcccgttgtgtttgtgaaacagagaaagataggcggccatggtccaaccttgaaggtaggagagagtaacgtatctttttaaacgggggatgagctcgttgagctcagcgtggtcacagcctgccttttaaagccagcgtggatgtgaccctccaaacgggacgcagcgctgggaaatgacgaaaaacgctcgtgggctagcgcatgtgttaatcgaagttgatgagacgttggacaaatttcacatctcgggaaacttgaaatttctaacgctttttatcttttaaaatagctttttaaaaatgtcctttttctcctatttccccttcctctttccctcccagttgtaaataacattttttagcagcaatgtaatctgctaaatgttagttgtttagggaagtcctgagaaaaggggatcaggaaatgcttatctttgtcatcaaggtggccctgtaatcttcctcttaattctctcaggggtaggggacccggaaaccccagggtctggaggagagcaaccaggaagctcttggggtgacttcgttttccttcaggtgtgtctttttagcccagagttaatagttgggtgaagggaaaggaagaagtcttccctttggctggtagcaaacgcagtagaaatccttccttagacctatgctactgaggagttatagccactgagggatttatagcctacagtgttagaaaaatgcttggaggctgggtgtatgtatgttttatttatgtatttaaaaaaaaaaaacagtcttgctctgtcacccagagtgcactggagtgcagtggcgtgatcttgtatcactgcaacctccacctcctgggttcaagcaattctcctgcctcagcctcccgagtagctgagattacaggtgcccgccactacacccagcttcaccatgctggccaggctggtctcaaactcctgacctcagatgatccacggctgggtgcatgtttaagggaacaggacacctgggtgatgttctatctcacctgtggtagattaccaggttagaaaacttcccgtagtcccatcaccacgatccatgtgatttttgtccttatccatttatatctctgtaatttttaagaaatgaaaacattgccttcttagaagtaaacctaacgcctgcgttaaatgtaaaaatatatttagatgtgttgcagccttaggaaaaatactaataatttgaatttttatttattaccttttcttttaaaagtattttatttatttttgacaaatggttatagggaatggatctagacttcaaacagcaaattaatggaaaattaatggaaatacagaggcttttagctttagttaaaatatattgtgttactcagacctttagtttgcaggtaaaaagagataacggtctattatattaatattccttcctggccgggtgcggtggctcacacttgtaatcccagcaccttgggaggccgaggcaggcggattgctttgagctcaggagttccagatcagcctgggcaacacggtgaaaccccgtctctactagaaataaaaaaattagccagggcttggtggcacatgcctctggtcccagctactctgggactgaggctgaggctggggaatcaacttgaacctggaggtggaggttgcaatgagctgagattgcgccactgcaccctggcctaggtgacagtgagaccctgtctcaaaaaaaaaaaaaaagaaatatacatatatatatatatatatatatatatatatatatatatgtatatttcttcctgtctgattattctattattttcacctgtgccataagtttacatttacaaagttatatagtaatttgatctttatgtaattctactgatactcctggttttaatggcaatgggagtaaaaagagtcactctttttataagctttggaactcacttaattgatttggtctgatgttctgatgttttttctttttttttaattgaaaacttttttttctttagagatggaggtctcattatgttgtccaggctggtcttgaactcctgggctcaagcgatcatccggcctcggcctcctaaagtgctgggactgcaggtcacgacatttagtgaggtatagtgccatgaatgaaaagcataccatcaagaacacttaaaagaaatcatttagcatatttcttaagtaaacttattctactttgtgtcttttttttttttttttttttttgagacaaagtctcgctctgttgctcaggctggagtgcagtggcatgatcttggcttaccgcaacctctacctcccaggttcaagcgattttcctgcctcagcctcccgagtagctgggattacaggcacacgccaccacaccctgctaatttttgtatttttagtagagatggggtttcaccatgttggtcaggctggtctcgaactcctgaccttgtagtccaaagcgctgggattacaagtgtgacccaccgcacccagctttttttttttttttttttttgagaaggagtctcactctgttgcccaggctggagttcagtggcgcgatcttggctcactgcaacctctgcccctcgggttcaagtgattctcctgcctcagcctcccgagtagctgggattacaggcgcctgccaccgtgcctagctaatttttgtatttttagtagagacaaggtttcaccatcttggccaggctggtcttgaacttttgacgccgtgatccacccacttcggccttccaaagtgctgggattatgggcgtgagccaccgggcccagccctatttttgttttttaatgagtgctaaaaaatgaaaggagaaacagcaaggtaaggactattggtttgaaagatctgtgaacttttcagccaattattgcccacatttggggctaaatggtaggttttgaaacccttaagggagctttgggtttcagtggagaaaggcatttatttagtggagaattgagtgcttatagtcctaaaggccacacctttaaaaagaaggttaagatttcatactttaattgcaacataaataatggagggagctcttcaaaatgtccacttttcctttctccttttaatattgtttcttcctcatccccttttccctgaataaacaacagcagcaaaacctaccctgctttcacagtgagtgtactatagaagacaagggagaaagaatcctgctggaagaagttggtgagcctaggtgactcccttgataaaggatgaaagctttgcagaagagtgttccaaaaaagtgtagtctccagaccacctgctcagaatcccctggagtactcgttaattatgcatgcccaggctttacccgagttcttttgaagtagactcgggaaagagctaggaatctacccccgcccccccgccttttttttttgagatggagttctgctcttgttgcctgggctggagtgcagtggcatgaactcagctcactgcaacctccacctcctgggttcaagtggtgtggttctcctgcctcagcctctcaagtagctgggattataggcatgcaccaccatgcctggctaattttgtatttttttagtagagatgtggttttgccatgttggtcgggctggtctcgatctcctgaccacaggtgatccacccacctcggcctcccaaagtgctgggattacagtgtgagccaccacgcccggcttgccttattgtttttgttttgttttaaataagctccctccaataatttttaggataaatgtcaagtttgagacgctttaatattattgtacatagggtagtttgatcaagatcatttgatgagataattagaattgcggaaaacaaaggactagtctttaatacccaaaacatatttgttagaaaacagcaaataggaacccaatgggggaggaacactttttgttgaacactttaacaatgaatagaaaaatagggaaccaagctgtttgcagccagggcttttgtatgtccatgtataaagttggaactagggacctccaagatggttaagaactatgaatagagttcctactgctcaaagatgtggctttcataaacatcttggtttttaaagcaaagttccagtattcttatagggaacctcttttgtatgtaaatcagcatctccctcaggattccagggttttgaaatcacttgtagagaggcctattggtggtactgagaggagaagcagagtgagtgaaaaagtatttactggaataataccaagtgtcagacatagttaagactttagtagtttgaggtaatcctgggagataagactaaaactgacaactcagggcttaaataatttcttcagggcaatattaggagagatgacaggcaccaagcaatgcgggattaatatccaggtgaattttgcagacagttgcggtggccccatgttccagtcttggggggtagatgctgagacaaaggcaggtctccttttatgttttgagacaaggtctggctctattgcccagtgcagtggcttgatattggctcattgcaaccttcgcctcctgggcttaacccatcctcccacctcagcctcccgaatagctggaactacaagcgcacaccacctcacccagcttatttttgtattttttgtatattgggggtttcaccatgttgtccagtgtagggaccagccccacagggtcggtgggtctctccctgtgtgcggcgacgagagagtgtagaaataaagacacaagacaaagagataagagaaaaggcagctgggcccgggggaccgctaccaccaatgcgcggagaccggtagtggccccgaatgtcgggctgcactattatttattggatacaaggcagaaggggcagggtaaagaatgtgagtcacctccaatgataggtaaggtcacgtgggtcatgtgtccactggacagggggcccttccctgcctggcagccgaggcagagagggagaggagacaaagagaaagacagcttacgccattatttctacacatcagggactattagtattttcactaatttactactgctgtctggaaggcagagccaggtgtacaggatggaacatgaaggcggactaggagtgtgaccactgaagcacagcatcacagggagacggttaggcctccggataactgcgggcgagcctgactgatgtcaggccctccacaagaggtggaggagcagagtcttctctaaactcccccggggaaaggcccccccccccgccgccggctttcccggtctgctaagtagcgggtgttgtttcttgacaccttttgctactgctggaccacgatcctcttggtgacgggcgtcttcccagatgctggcatcaccgctagaccaaggagccctccggtggccctgttcgggcataacagaaggctcgcactcttgtcttctggtcacttctcactatgtcccctcagctcctatctctgtatggcctggtttttcctaggctatgattattgagtgaggattatcataatattggaataagaagtaattgctaccaactaatgattaatgatactcatatataatcacatctaagatctatatctggtataacaattcttgttttatattatactggaacagctcgtgtcctctgtctcttgcctcggtgcctgggtggcttgccacccacagtccaggctggtctcaaaactcgtgagtttaagccatctgcctaccttggcctcccaaagtgctgagattacaggtgtgagccactgcacccagccaggtctcctttcaagtctaacttctaaagttaccagaaaccagaatcttaagtgaatagacatcaggacatgagtggtaattgaataactctccaaccatcccctttcttaactattcttaactgcagaggctaccagaacttgacagaaaacacaatttattttgtttctatcctcttaaataatcccttctttttggaggcattagtaatgtatctgcttttggcttgattaaagttgaggcctgaggaggactggaggattgctttgaagatgagggaagtgacagattctctggcgtacattaaaaggaagtaagggttgaggactaccaagatttattagagtcttagactgttagaactgcaaataaacgtagaaatttactggttgtagagtcgtgttgagctcctcctacttctaccaggtgtaaacacaaatctctttttttgctgtgtatctgttctttaatagtagcgtcaaaattctggtggtatagacttcagatttccggtcacttctcctgtttactcaccagcgcctgactattctaggcatcaccttcttgcccctatttacttttgcctggaccatttcatcagtctttaactggcctcccacttctgatctcccttctcttccagctcatattgccagtcatcttcctgattgctactcgctggccccagatctgcatccagaacgaaatgggagctccttagcttggtattcaatgccctccagggtctagccccaacctgcttttctggttatctcctgctctgctccctcacttactggaggctcccgggactatcattgcagctaaaatatttctccctacagttttcctcctcacttctattctttatttcaacacctgtcttctcttcctaccacaacccacttttccaactgcctacccgttcagaatacaagaccaaagttttccattcctttcctcctctgttcccacgacaatcccataagtctttatttttggaaaaggaggaatcctgccaatgataactttttggcttacatatcgaggtcagagagctagtcttattctttatgcctgtggtcccaggcatatgttagagcccagcagatacctaagcaaatatgcctgttaatgattataacatttatttgttgaatacctattatgtgttagactctaaatgttgttaatacttagtgattaaatccccacaacagtcctgtgaaggaggtgatattatccaggtttacagaagagaaaataaaagccttgagaatttaaggagcatgcccagattacaagctagttaagtggcagagtcaggactagaacccaggcctgtttgcctgcaaagctcactctcatgtactcatacttctggcacttggccttatgttattgctattgagatacatgcttgtgtccttgatgagatgctgtggtgtgctcatgattcgaggtcaggcccatgcaaatcttggtattcctagcatagtgctggcatatggtaggtgttcattcattacatgcttgctgaatggaacttcattcttctgtgcctacttgtactttctttaagagaacaatgaggctgggcttctaaaaaaaaatatacattttaatatcttccatatattgaaaaaaatttctttagaggcaaggtcttgctctaacccaggctggagtgcggtggcactatcatggctcgctgcagcctcaacccccctgggctcaagcaatcctcttgcctcagccgcctgagtatctgggaatacaggcatgtaccaccacacctggccaatttttaaattttttgtaagataaggtctttacaaaaggctttttgttggcttaggcttattttttaatacctagtgtgcattcagtaaatatgtattgagtgaatagatcgtggtagggccagaagagactcacttaaaggatttagctctaaggtatctggttttattgaagatgggctatcaggaaccaagctctaggttgttcagaagagattctaggcagcatattggaaagcagttcagaattaaaagctgtatgacagcaacattgtctgccttcagcattctatgcaggtgtgtccaggtcagttgggaacaaagtcacttcacatctatttagctagtatttactgagcacctgtgttgacatcgggctaggcactatctttgtaatctctaacgcaagtctgtagagcaatgtacttatttaaaaattcatttgtcaggctgggtgtggtggctcatgcctgtaatcccagcactttgagaggccgaggcgggtggatcacttgaggtcaggagtttgagactgacctggccaacatggtgaaaccccttccctactaaaaatacaaaaaattagccgggtgtgttggcgggcgcctgtaatcccagctactcaggaggctgaggcaggagaatcgcttgaacctgggaggtggaggttgcggtgagcggagatcctgccattgcactccagcctgggcaacaagagtgaaactccatctcaaaaaaaaaaaaaaaaagtaatatacaaacacttgttgacaaataaatttatatttatttatttatttatttagtttttgaaatggagtcttgctctgttgcccaggctggagtgcactgtgtgatctcagttcactgcaatctccgcctcctgagttcaagcaattctcctgcctcagtctcccgagtagctgggattgcaggcatgcgccaccacgtctggctaattttgtatttttagtagagacaagatttctctatgttggtcaggctggtctcgaactcctgacctcaggtgatccgcctgcgtcagcctccaaaagtgctgagattacaggtgtaagctaccatgcccggcctgattttgtttttaatgatgacaaccactctgtatggcagagtgagacatctgatagacttctgttacaattttcgaagaaagtaagtggaaactaataatgcagatatttttcatttgatccctgagtggagttcctagaatgctgcatcctttagtagccacatacccagtccttcttaccctccctgtctatcaaaataacactcctagtcattgctgccttttgaggtgttgtggaggctctcgtaacctgaaaggttgttcttttcatctcacgcccttatttatattcttgaggcttggcaagtcagccagcactgggtttttaaagtgtcattaagtatatgatttgaccacagagcaagggtggagattttatctactccaaagtatttcaaatgagtgagtccagattatttagtgagactcttttacttctccaataataatgccatcttatttgaataaagcagttattcaaagcctcttttagatactagacttaagaatctgctgaaatctaaggagctattcctgagaaaaatgcacataaataattttgcatataaactcagactatttgtggatctgcttcagaatatctggtacagagaattacccttcaaagtgttactgtacacactttgaatagttgaagccttcgtaggtttttaaaattttgttatatggcaaatttcttttcactggtatttgttatagtggaatatattcctgtgttcctccttactgatttaacctttaaaaatatttttctggggccgggcgcagtggctcacacctgtaatcccagcactttgggaggctgaggcaggtggatcacgagatgaggagtttgagactagcctggccaacatggagaaaccccatctctactaaaaatacaaaacttagctgggcgcggtggcacacacgtgtaatcccagctactcgggaggctgagtcaggagaatcacttgaacccgggaggcggaggttgtagtgagctgagatcacaccattgcactctagcttgggcaaccaagcgagactctatctaaaataaaaataaaaaataaaaaaaattaaatttttttctgttcctaaagcaacattcagaagtgaaactactggtttgtatacagtttttttttttacatttgctatctttgggattgtttgatttattaagtacctactcagtagttgaaaacactgtcagatatattacataattttcattcactgtagtaattatatggtataaatacagttgtccctcggtatcttcaggggattggttccaggacccttgtgtatacccaaattcatacatactcaagtcccaaagtccaccctgtggaaccagcatatatggaaagtcagctctctgtattcaccggatgtgaaacatcacatctcacaaatacagtatttatttctttatttctcacaagctttttcctctttaaggagcaggcagacctgtattttttattgcttttggtataagtggatctgtgcaattcaaagctgtttccttcaagggtcaactgcagtagtattcccgtcttataaataaagacactggaggctgagaggttaagcaagctggctaagataatactaataggtaataggtcaagattggaacccagatcgtcccctcccacagtctgtggtcttttcagaaactaattttcattaaaaaaaaaaatacagatatctgtcttatcatagcaaagttcacctttaataataacaaaacacaaaatatatacacacaaacataactttaaagaaaattacgatgaaagagaaactgccaggcacagtggctcacgcatgtaatcccagcattttgggaggctgaggcgggcggatcacgaggtcaggagttcgagaccagcctggtcaacatgctgaaaccctgtctctactaagaatacaaaaattagccaggcgtggtgactcgtgcctgtaatcccagctactcgggaggctgaggcaggagaatcacttgagtccggggggtgtaggttgcagtgagccgagatcgtgccattgcactccagcctgggtgacaagaacaagactccgtctcaaaaaaaaaaaaaaaaaagttaagatgaaagagaaactatacctaatgtcctgctaattctggcaaatcaaactaggaattttaccacatttcttcacaactcaatattaaacagaagccatggtggtatgaagggagaaaagctgctatgaaagaaggaacagaaaagtttagggaggtagctattaggataagtgtatatgttagagtgtgggactcaaacctgactgattcctggctttggctccaaaaagtctcttaaaaatccatttgttataggtaagtgttaacagcaaaacctcactggagaaaaatagtggactcgtgacttcttcctttatttggttacagggagacatgtgacctttgtcatccaccctatcacgtttgtgttgagcagtatgggttgtgggaaagagctcaagaatgcttggaattaacctaaactcctagaaaaggaactgaaaatataggagaaaagggtgaagaaaagaggaaaggaaatggaggtctgtattgaaccctgggtagcaactcttgagcgaagaaagaggaaaaaggggaaagaggggagctaaattatctctgaggcaactcagtctcatggttgcctgaactagtctatactgcgggaataaggtagacgccactggtttctttgaagtaccagtgcgcttcttgctttctattcctggtcacagacaaatttatcagtagtgcagtttcttctttttaagcttcatttaaataattattagtagcacttggaccttaggttaggaaatcactgtttaatgacttaaagattaaccggcatggaaatcccattctttatatgattggggagagttattgaacttgagattgttttactttgtagcaatgtctaaaggcagatttgttttgttttgttttgtttttgaggcggggtttcgctcttgttgcccaggctggagtgcaatggtgcaatcttgtctcacccgcaacctctgcctcccaggttgaagtagcagggattacaggcatgtgccaccacgcccagctaattttctatttttagtagagacgtggtttctccatattgatcaggctggtctcaaactcctgacctcaggtgagccacccacctcggcctcccaaagtgctgggattacaggtgtcagccaccgcacctggcctaaaggcagatttttaaaggtggaacataatgcaagtctgcctttcttaggatgatctaagttacatgttaataaagttcttggagatctagcatagaatgcattcagcactgtaaatcacaacttaatgtttgcctcgatatgctctgttgctctgagcaagttgtgtgggctgttatctcctgagaaatccctgtaaatggtattagtaatactttataagcaggttgggagaatatagttttctaaggcattttgaaattcttagatgaaagggtctttatgtagcaaattggtgtcagcctattttccttcctctgagccagaagaaaataggcaccatagggtgggaagggttggcttatctgttagagttcttttgtaagtagcttttgttgaattttttttttgagatggagtctcgctctgtcgcccaggctggagtgcagtggcgcgatcttggctcactgcaagctccgtctcctgggttcaggctagtctcctgcctcagcctccagagtagctgggactacaggcgcctgcaaccacgcccggctaattttttgtatttttagtagagacggggtttcaccgtgttagccaggacggtcttgatctcctgacctcgtgatccgcccgcctcagcctcccaaagtgctgggattacaggcgtgagccaccgtgcccggctgcttttgttgaatttaaagtggatgtgagaagctcctaagaatatcgttcactgtaaaagcagacttttttggatttgggtcttggaattcttaactgtattttcacctaagatttaaaacaagttcaaatactagtttgtaattggccagactagggacagatacgatccttgaatgatcctgggtctcaacttacctttctttcatttttcctttattttagaagagggataagaactttttctgaagagcagtcaacttttcctttcagtgtgtaggattaattccacgaatctgtgaacttaaatctttgctgccaaataacttgcagtagatgctgggatagttttaaatctattttaagttatacattcagtacataagtgcatctccgtgtaaaaacagctatgtttggaagatctaaaacgcagcttttgtttttgagaagccaacaatctaatagggtaggatcatatatatgtacaactaaccgtaatgcatggtgttttgaaaaatgcacgtatctccctgaattacccctagttaataaaataattgggagcaaatggtaatataaggattttggagtaacttaatactactagattttgctgtttatacatttacaaaaaactttctgctaatgctaaagaaatagaacaagtctatatgcataaaggaaggtagggctaatttacttcctggtgctatgaaactggcaattggacaggtgcaattgtgggtgtctttttttttttaaggtgtacctgttgcaggtttgaaaagctgttgatgctcatgggttgtttgtgtgcatgttctctttaaaaaccagatgtattcattccctttttttttttttttttttttgagacggagtctcgctctatagcccaggctggagtgcagtggcccgatctcggctcactgcaaactccgcctcctgggttcacgccattcttctgcctcagcctaccgagtagctgggactataggcgcctgccaccgcgcccggctaattttttgtagttttagtagagacggggtttcaccgggttagccaagatggtctcgatctcctgacctcgtgatccgcccgcctcggcctcccaaagtgctgggattgcaggcgtgagccaccgcgcccggccattcccattgttatgtatactttgctatttgctgctggtgagacagataaggagtcacgtctttaactgcacttgagtttccagtgaccccattaaatccaatgggtaaattttcccacgcagattactcacccagtttacagattaagctttcatatccttagactgtatctgaaattttcatagctttgcccaccttttagggttcagagttactacccattcagtgtcggtggcctttagctgttggcaagcttccaagtaaatagctcttttgcagagatctctacccattctattcttccactcctgggtagtggagaaccaaagttcacctgagtaatgcccgtgcccagcacccagtttcctgcaggggttagcacggatattggaggctcccccgatcccacagatactcaggatgggtattggagggggcttggtttttaagaggacatgtgaaagtaattaacccgatttacatttgtataatgagtccaaacaccaccttgcaaaagaactgagagtttagcctgcttaatggagtttctgcttttcacggtccttggccttaccgacggtttacagtccagccagatttagttcacaaaaaaccaaaaccaggtcgacctcactgcagtatatgatggcagcgagcgttttaaagcgcaggacctttagtctcctcaatagttttgtgtaaagttgtccaaaagtgtttttttttaaagtgaggtgatccagtcggtaaacgctttgaaaaagaatagctgtcccctgagcgggcattagtcgcgtgtgaggtcagggcccatcattgcgcgtgttgggagcgccgcgctggtctatgagcgagcgcctcggcttgtggctgggccgggccggggcggggctgtcttcccgcggagcgtgctgggggcgggtcgcgccgggccgggccgctagtgcgcatgggcgggcgtcctcggctctaactgccgccactttccacacgctgggagggccgttacctcagagatacccgtggccggcatgttggttgaaaaagcttcccggaagggagacgaagagaaaggagaggagcagctcgtgatcatccccggtagcgagtacgcggcgaagtaggcggcggcggagggagcgctgatgaagatggatgtgtcagtgagggccgcgggctgctccgacgacctcagctctggggaggccgacgtagacccaaagctcctggagctcaccgctgacgaggagaagtgccgcagcatccgcaggcagtaccggcagctcatgtactgcgtgcggcagaaccgggaggacatcgtgagctcggcgaacaactccttaaccgaggctctggaggaagccaacgtcctctttgatggcgtgagccgaaccagagaagcagccctcgacgcccggtttcttgttatggcttctgatttgggtaaagaaaaggcaaagcagttaaactcagatatgaacttctttaatcagttagcattttgtgactttctgtttctgttcgtgggtctgaattggatggaaggcgatcctgacaagttgagtgattgtgatgatagcatagctctttccttctggaaggcaatagaaaaggaagcaacatcctggatggtaaaagctgagacattccattttgtttttggttcattcaagctagaacgttctgcaccaaagccccgacttgaacaccagaaaaaagttcgcaagatggaagaaaatggcaacatgcctacaaagttgcagaagttggacctgagtagttatccagaagcgacagaaaaaaacgtagaaaggattttgggattgttgcaaacctactttcgaaagtatcctgatactcctgtgtcctattttgagtttgtgattgatccaaactctttttctcgtactgtggagaatatattttatgtttcttttattgtaagagatggttttgcaagaataaggcttgatgaagacaggctgccaatattagagccgatgaatgttaaccaaatgggtgagggaaatgattccagttgccatggcaggaaacagggagttatatctttgactttacaggagtggaaaaacattgtggcagcttttgaaatttctgaggctatgattacatactcctcatactaaagatttcttagtatagcatcctttttgtgttttttttctgaagttagatggagagtaaaatgtaaactgaagcacatattgtatctcttgtaaagtgaaaaagtattttcaagaacatcagacattgttttactgtgcagcatatttttcttagtaatttataaggtcatgatcttctgttattaaaacaaattcactggcatatttatgggaacgttttattgaatgccctttaagactattaataaaaacaagttttggataccaaattaagggatatttgataatttgcaaaacataataatttacgaaaatcagtgatgatgctctgtgatgcgttgctttctctgtcatagggaaccaagagaatcccagaaagggttcctaaccaggttgggcaaagagtgggtaaaaaacaaaagttaaaaaaaaaaacctgtctgtaaggcagtgaatatgcaacattaagactaaaaaagtcattgcaaggaagacttaggatttatgagtgagtatccatattctaaacaatttctgttattgtactcagcaaaagtagtgtctctgctgtagtagttgaggtatcagctaagggtgaaaggtgagtagaaacacgaagaaggaaaaggcattctaggcaagagaatagcaaggtcaaatgcatggaattgttagaagttaggcacgagaggaccattagatttatggaaaaactattatatttgataagctgggcaacaattgaataacttcatctattaatatcctgagaagatgtttttgtcaaactattatacattgaacacaagatcttgctatccagttgtagtttttatctactgaatttcttctctggcccctagtgtccctttgtggtctttgctagtacatagaatgtccttcacaatctacgctttttcatcatgtaacaactttgaatatttgtcccactttaattttgcatttctatctttttttttccccctcgagacagagtatcactcttgcccaggctggggtgcagtggtgcaatctcggcccactgcaacctctgcctgcggggttcaggcgattcttgtgcctcagcctcccaagtagccgggattacaggtgtgtgccatcacacccagcaaatacttgtatttttagtaggaacagagtttcgccatggtagccaggctggtctcgaacacctggccccaagtgatccacccgcctcggcctccggaaatgctgggattacaagtgtgagccaaattttgcatttcttaatagggctttaaatgccaggaaactgaccttgctgaaactaaaacatgttagtttatctggatgttcttcacttagtgtaaagccataaaggcttttttctttccgttgcataaattacaaccttatttggagattattgccaaaagtttgggtcattaagaaagtaacttgagaaggtgcagtaagcatacccataagctttcttccccttgatccctataggagcttaatttttggtagtcgtggaattttgccattaaacaatactttggcaaatgtttaggtatctgttatgcatagcagtggcaaactttcctagtaagtctagtggtacaggaaagggaaatccaaagactcaacaaatgacaccaagactgagaggaaggatttttcatgtatggagatgaggttcttcaccaataatagagtagaggttttagcaaaaatagaactttctcatgaaacttggcaaattattttctaaattagttactcctttcacatatgaaagagcgctgacccttgctagtgtctagtatcctttgatttatagtagcagtcatggaagcaccatttgatctcactcatcctcatttccagcatgtctctaccaaccaagttccttgggttttgcagagatctgctgttggaagaaaaagtactcttaatgacagcaaaaagatcccgccccagtactttactgacattcagttgctctgttgaatgtctcatgtctttactaggagtatttgacagtgatgatttaaaagcattaatagagaatctggaggcttaggagaggtaatttttttggtcttctctaaagttaatagctgttaaaatataaagttgaccacttctgtttctatttttactggttggcatgacaccaaccagtaaaatgatgaggatgatggattgcctcatcatttttgaaattttgaaattaaactgactgcttaccttgaagaaaaaaggagattaaaaatttatagaggttaagaatcaaactgcaaatctgcttgtttcttgctaatacgtttgtatactgaatagaaataacattatgctagtctgtctatatactggatcaagatttgttaggaagagggcatttcaaaatagtggagattgacgcagggaagctcagcggaggacaccagtgtaaatacattccagcacttcttgacttagttccaggcaatttcccttcttcaggagatggagaattagtaacttaaagggattaattcctaccagccactatgctaacatgcattatctttcttaaactcagccatttgatgaggtcaggaacctgttagcttcgttaaggattaggtgattggtcgaagtcacctggccttgtgagtggtagagcaagtattttaacgcaggttatttctgcatcagagccatctataatggtaggggaaataaaagtacaaatctggcaaaggatagaaactatgtttaggggaaaagtcaggattgcttattccaattttaaaagactgccacagttgaattgctttctgttttgtgccctttttgggggagcctggagcagtgttttactaggagtgggtctggggaaagggattactatgacaggcaggtggatgaaaaggaaggctatctaatgtgtaagccttgccaacaagtgacagttgcctgcaggtcatctcatattctatagcattggttctcaaagtgtatgaggcccttttggcatactttaaggtcagaattattttcataatagtaagatgctgtttgcccttttctttcttttttttttttttgagatggagtctcactctgtagcccaggctggagtgcagtggcatgatcttggctcactgtgagctccgcctcccgggttcacgccattctcctgcctcagcctctcgagtagctgggactacaggcgcctgccaccacgcccagctaattttttatatttgtagtagagacggggtttcaccgtgttagccaggatggtctcgatctccagacctcatgatccacccgccttggcctctcaaagtgctgggattacaggcgtgagccaccacgcctcgctgcccttttcactcttaattctcttgcatgtaaactgtgaagttttccagaggttatatgacaggtgatgtggcaacagattgaatggagaaacagatatgagctgtcttttgttgtcagacattaaagagaatcgcaaagatacaaaacagtgccattcttctaattaaaaaattttttaaaataaaaatacgttaacatttaataaatatattatttttaatttgttaatgaatattttaagtttcttcttagttttaatttctaatatagtaaatagataaaacccacattaacaagctctttggagtctcaattttaaagctctgtttaagattgtaaaggagtcctgagatgaaagagtttgagaacctctgtagcagccaccacagtcagcggacataatttcaagcagttgtagttggaggaggatgggggaatttttctcctttccttatcccatctctgtgctaccttctactgtttggggcagctgttttctactgtctgtcttatttatatttcaggtgaagtaccacttaaatggaactgaatgatagcactttcaattttaagtttggttaaaattttaaaaacaatgtttctttttttttttttttttgagacggagtcttgctctgtcacccaggctggagtgcagtgccatgatcttggctcactgcaatctccgcctcctgggttcaagcagttctcctgcctcagcctcccgaatagctgggactacaggtgcacgcctccacgcccggctaattttttttgtattttggtagagacggggtttcaccgtgttgcccaggctgattgtgaactcctgagctcaggcagccctcccgcttcggcctcccaaagtgctgggattacaggcatgagccacctcactcagtctcataatgtttcattctaaggtcaactgaatgcttcaattgcctgtgtcttgccaattggtaaattttacctacagtgcttaaaaatggtgaggttcattcagagcttttttggtaaaatctgtgcactggttgatacaatttgacttgaagcttgaaccaggagaagccaggttacatacagaatttcagtaaggaacggattgtaaacattggtgaagggaatatgtgacttttcagcatgaggatacattttctggtatttgttctagtaggtatgttggaggagggggattcctagaaccatggttttcatttagacagccagttattgtgttctgtcaccatctttgctaatttcatgcagataaaatgaggttgagataaaaaatgattgtatgttatttttccagcagaacatctaactggatttattagttaactcttaaaccaggaagtcatgctctttgagacccagtagggagtcacactagttacttgaagcataattgatcctttgatcgaatggctattattaccaaattgtttttcccccacagtgctttgtattgaaggaggaaccttggccataatgccagttgatgactactggctgtgtttaccagcctcttgtgctagaccttttgtgcagactgtcagagtggtgcagtcttgcccccactgttgctggtttccaggtgttctcccttcagtccctgagccactacgtatgcccgccatgctgccaacaggtagccacagtgctgtgcttcctccttcacattgctccaccgcacccccttccacatcccaagaaccttcttcttccgctgaccccaagctctgcctttcaccccctacatctgatagtaggcaagagagaaatgtgcagtttgggctggtaagtttgggggcttttttttgttattaaagttaaggctttttgtttgtttgttttttaaaatgagatggagtctcactctgtgagactcccaggctggagtgcagtggcgcaatcttggctcactgcaacgtctgcctcccgggttcaagcgcttctcctgcctcagcctccggagtagctgagattacaggcacccgccactacacctggctaatttttgtatttttagtagagacagggttcaccccgttggccaggctgatctcaaactcctgacttcaagtgatcctcccgccttggcctcccgaagtgctgggattacaggcgtgagccactgtgcctggcctacttgattttttgaaaacattttattgtgcttgttaacaactttctcagtcattatctcttgttaacatagatttttattttagtaagcgataatattaaatatatcaccaaaatattgtatgaaacgaatatgaaatataattaatgtgtatcagaattatattagtggaatgaaatgattttttaaaaattaagtctaacacctaaattataaaagtctgttacttgctaagtatatggaaagtaaatattaaatatgggagacttcatgcatatgcaaattaaaggaatgagctttgcagagttgtgcctatttaaaatatcctacaaaagcagcaactttcacgtttaacttttcatgcaggtcagtatcaattgacagttttgttctgaatttttagatgttatgccccagccaaacagtatagaaatgtcttaaataaatatttggctggtcttttaaaattgttatattgagattaagctatgcccatatttaccaagcccctatctttaaaacctagtttaaaaattctaggaaaaaaaggctaatgattaaacctgatttagacctaagttggtttacttatgtagaggtactatacgaacacttcaaagtagttagcagtgaccgtctttggggttaataaactaagataaagcaagcagttcacaactttaaggaaggttgaatatttccatctgtatgctgtaattaaacagcatcttccctttgaaaattccttttgtttttctttaagaaaagattttcttacaaagctttttggacattgctgattttaagttaaattattttctcttctgttatttttctttaggcttatcaggagggcagacttcaaaagctactaaaaatgaacggccctgaagatcttcccaagtcctatgactatgaccttatcatcattggaggtggctcaggaggtctggcagctgctaaggcaaggctccttgtgttgtctgttgtctgttgtctgggtggtgattagaatattaacatccctgacagggttctctcctctctctgtggaatttatttgatccactcctgtgacattttgcacattaacttgggcaggacatggacatcgtaagggaccactttataaatcatttttccagattaaaatatacattccttatattaaagtatagggcccagtattttggaacacgtttccgttcactttaagtttaattgatttttcagagataataagggtgttgtgcctggtgtggtgactcacgcctgtaatcccagcactttgggagtccgaggtgggcggatcacctgaggtcaggagttcaagaccagcctggccaatgtggtgaaactccatctctactaaaaatacaaaaattagccaggcgtggtggtgggcacctgtaatcccagttacttgggaggctgaggcaggagaatggcttgaaccttggaggccgagtttgcagtgagctgagatcgcaccattgcactccagcctggtcaacaggagcaaaactctgtctttaaaaaatatatatatatatgtgtatatatatgtatatatacacacatatatatgggtattgtgtggaaatggtctgaaattaagcaaatatatttcttagttaatatttcttagttaatatttgtctttttcacttgaatgatttccctgttcataaccccttctctccaatataaaaaaagatggggagcaattgggtttcttaaacccatttattaaaaatgatttgctttttgtatatgtgaggttatctaataaccactaactctgtggtctgagggtgattgggaagaggatgtataaataaagaaggttaggagtgaggctcctggttctgaatcaagataaatttcccatgtgaggaccccttgggcctgtcatccttacccaacaggttcctttaaaagatgaagtggttataattccctaaggtatagcttgtgctgaatcagtaatgggtagaagctgcccaaatactgcagaccagtatgtagcatgaagcaatgctttactgaaagtaattgaggaataatacctgatgtattttactccagtggtggtgtgtttgaaagacgtgtagactcagtcctttcaaataacctttggaggtctagttgccaatattcaaagcttattctctgagaatgataaaagatattctgcaaaacaaacttctaactcttgtttccctccctaaaaatatatttggaaatatcatagatgttgtcaactttttcatgagcgcctcatgtgaaaattttaggaaatcttgtaatacagaagaaaaacttcttcagtattctgccttagaaaccaaattagattaaactttaaaatgatttttaaaatatcaccttataggatacaggttgcattaagggctgtagactatcagtaaacctgctttttcagctacttggcaacttgcttggaaatggccactttcttttttcaggttattgctgaatctgttattgtttgagtggaattatgtgagagaagtctaaggtttccagctgattctaacaattttactactctattctgcataattttaaaatctactctcagaactatctgaatatctgttaatttttatcctggagtttaactaatcatcatggtgtgtgaagtacccaggtattaattattcgttatgctttaagctctatagcttaaaaaaaaatcatggatttttaacagcccatttccaatctgtcatgttaacctttccaactcactttaataattttattttccaggaggcagcccaatatggcaagaaggtgatggtcctggactttgtcactcccacccctcttggaactagatggggtaagcttttaagatactctagaagtgatgttgccgaagtagttttcccctggcaataatctaactggttcctaaagcctaattaaaaaaatcaaaaactaagttaaagaaaaaacagccccaaaacatatatatcttttatttgagccaagttaaaatggatcaggttaaatgctaaaaatttaggttctttggcacagagtcaagaagtaagaaccctgtctacaagctatgatttaaaggtaaatatttgagtaatctagcatatataggggcttaataactgaaaatttaaacttttcatatgtggatttgttttaaatctacctcctacattcaacaagagttggaatcagataccctactgtatagcccttgctgcttctgagtcttgatgaattatatgttcataatatttactgaacatttattatgaaccaaggcaatgacgatatagcagtgaactcggcatattcaaagttcatgcccttgtgaagcttatattctaagtggggagacaaaagatacctaagaactttaggagttgtggtaagcggtattgaaaaaattaatatagtggcatagagaggaagtggataaaggagaatttaacttcgagaagattatcaaggaagacatctgaagaggtgacatttagaagaggccaaagaatgagaatgagccagctgtcaaaaggtgaggcagaaccttccaggcagcttctctttctttgaggatagcacatacaaaggccctgaggtaggtaaaagtccttcatggttgtggcatggataatgggagctggaggtggtagtgtgagatgagaccagagaggaaggcaggtgtcactattgagggctttgtaggccaagatgaggaatttggactaatcaaagcatataatttggactaaattggactaatcagagcatataaatgagcctttgaagactctaaggcaggggagccatgtgataatataagattttttaaagattacttggctgcttgcattagaaggaaccaagaagcaggaagtccagataaggcgatgtcacaatttctgattcatccattcagcagatatttaatgtgtcaatctgtgtcagacactgctcttggtactaggtatatcccttctgacctgtggagcatatactccagagtgacaactggtagtattctactcagaggacttactttgagctgtgaagtctgttgccatctttcactcttatgtcattttggtcacctgcctgtgttttgttctaatggaaacaagctgtcaccatattctttaagcttagggatactaaacctatttttagggagcaagggaagtcatgcatcctttaaaaaaccaagtgaatgctgtaggccacctccttaaaaaaatgcacatatacaccaaaatttttttctttttttttttttttttttttgagatggagtctcgctctgtcgcccgggctggagtgcagtggcgctatctcggctcactgcaacctccacctcctgggtacaagcagttctcctgcctcagcctccttagtagctgggattacagacacgtaccaccatgcccagctaattttctgtgcttttagtagagacagggtttcaccgttttggccaggctggtctcgaactcctgacctcaaatgatccacccgcctcggcctcccaaagtgctgggattacaggcgtgagccaccacgcccagccaatatacaccaaattttatatgcagtttaagacccactgcactctaatcatccccagcatagcaacccctttatcagttacctctgcatagattcaatggcaagtgcagatgctgcttgaattacaatgggggactacatcctgataaaatcctttgtaagttgaaaacaagtcaaaaatgcatttaatacacctaacctcccgaacatcatagcttagcctggtctaccttaaacatgctccgaaaacttacattaacctacagttgggcaaaatcatctaacacaaagcctattttataataaagtgttgaatatctcatataatttactgaatactgaactgaaagtgaaacacagtatgggtgtatgggtatcaacataaagagaaaaatcgtaagtcgggtcgtctgtatagggttgtgtacatagtaagatttcaatttctggcatctttatcagcagtcagttaattttgtatctttgaagtatacggaaattgtggaaatctgcccctctttttgttttgttttaggatgatgttaccgtgtttggtatgtaagggtctctgaacttatggatgttgtaagagttaggaataaactttattactgaccacattaagcaaatataatacaatatttcttagagttgtaataattgttgactttgttctttgaatgtttgtaaggcttggaaagcaggttataaactgatttctcaatgttgttgtaggtctcggaggaacatgtgtgaatgtgggttgcatacctaaaaaactgatgcatcaagcagctttgttaggacaagccctgcaagactctcgaaattatggatggaaagtcgaggagacaggtatgagagggaaaagctactcttctgtttgtgcttttgggggtttgagctgcaatttttgtgatgcgtcgtccattttcatgaagatagcaaatagcctagttgtttttattgtttacatttttgatggatataatcactggagttatcctttgtcaagtatttacatagttgttatggtaacaacagatactgcatttggactatggtatttctgtaatataaaattagagttcttttgaatatattgtcatgtagtatttgtgagaaatcatacaatgtttataatttgtaaggaagtactaattgcatttgctttctttcatgttgcatttttctccctccaaagaagtctgtttcatgagctgatgtttgtggggggtgggggttgtttgttcaggagggggtggttaggctttgttggattaaaactatttagagtaccctagaaaccctagatgagtttaagagattggaattgttaattttatttttatttatttatttatttgagacggagtctcactctgtcgcccaggctggagtgcagtggcacgatctcagctcactgcaagctccgcctcccgggttcacaccattctcctgcctcagcctcccgagtagctgggattacgggcgcctgccaccacgcctggctaattttttgcatttttagtagaggtggggttttaccatgttagccaggatggtctcgatctcctgacctcatgatccacctgcctcagcctcccaaagtgctgggattacaggtgtgagccaccgtgcctggtggaattgttaattttagaaagtagattgcattatttagtagaagaataaaatgagatctggcatagcttcctggctaatttatgacatatgtcactctgttgtgaagagtgaaactccaacccctatgtgatttgaggtttgagacctatgcattatggagcatttgagggaaaatattccagccagtagccaggataaacattttgtggcttttttggggttttaattgtttattaaatgtaaagataaggcataaatgtatacttggaaaaattttgctctcactcaaactagttatgcttctcttgttgatgcttttacttcctacttaaaataatagtaccttttccaagtctggaatcttagaaaatcactaacttttaaagttttataatgttggggtcacattgtttgctcagacccttaagagagagagggatataggaggaaattttgtaaaacattgataattactgcagcttagatgattagcacatgtgggtgagctatatactattctattccactcctagcagagaaacagcaagtcctgagccttttgtagtggtggtagacagaggccaggcagggaggttagtccaagcttcctgcagccttccctacccacaagctacctggtcctctagaaccataaccgcagtggcatctgcagttactttttttttttttttttttttcagttgaaccaatttcttaaggtttgctctaattctaacattatgatcatatgaattcaatatccatgatctatctgttctcttagaggctataaatcaattttttgtgctgtcattcccacttccagaggctggccagtaagtgttataagcctattttcaaaacttactgtatagccagccaggatcatgcctgtaatcccaacagtttaggaggccaaggggaaaggatcagtttgagaccagaagttcgagactaccttggacaacaaagcaagagcctgtctctacaaagaataattagtcgggcctggaagccctctcctatagtcccagcttctcaggaggctgaagcagggggataatttgagcccaggagttcaaggctgcagtgagctgtgattgattgcaccactgcactccagcctgggcaacagagtgagaccctgtctctaaagaagagattattgaggctgggtgcaatgactcatgcctgtaatcccagcactttgggaggctgaagtcggcagagcacttgaggtcgggagtttgagaccagcctggccaacatggcaaaactgcgtctctactaaaaatataaacaattagctgggcatgatggcccacacttgtagtcccagctactcttgaggctgaggcacgagaatagcttgaaccctgggttgaggggtacggaggttgcagtgagcccagattgagccactgcattccagtctgggcagtctgggcaaccaaagggttgatttttatcctttgaaatttaatattactttagtgtcctgacttaaaggattaatttaattatgacagaatcaaaaagaataaaaaagttttctctttgataagatatgggagtttggaggaaatgtgataagactcttaaaatcctgtctaaatgaatagtcagtgaattttttccgtaaaaggccatatggtaaatattttaggattcttggggcatagggtctctagtagctacttaactctgcttatgtagtgtgaaagtagcactagaaaatatcgaaataaataagcatggctgtattttaataaagctttatttacaaaaagctgatgggctggattggcccatggtgcagtttgccagcccctgacataaacactgttactagtgtagtaactccatactcggctacatcagaatctcttggattttcttacaaacacagaatcctaagccttaatatatcccagaaatcagtaaaattcaagttcgtttctagataaagaaggaaaaagtttgtgtattgttattttagtttaaaattgtcaggggatctgtcttgtattatttaattgtattagtcttataagagaatacttgaagatgaaaaagtggcatatgtgctcaaaatggaggatttgccctttcagattgccttttagagctctgctccctgtatttcacttgagtggttattgagaaatgatctttgccagcagttgaaaagccaaacaagattttgttttattttcttatacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggtaattgtgtgacatcctgactagctttttttttttcttttttctctttttaaaagctttggttagaaaatgttaaagtattataataaaagtaatagccactgtgacccagactatccagtttggtgattttgctatcatatcatcctatggggccttgtgtggaggtatggtaaagtgtaagtatgctggaccagaccgcctggttttgaggcttggctccagcacttactaacattgtgactttgagtaagtctgttaactactcagtcttaatttatcctttttactatattattgtcctcattatgaggatgaaatgagacaatgtagtgaatggcctttgttaactatgaagtttacaattctgaggaatgattacttaataaggttttcatattggttcctttgtaggcaacaaataataaaggcaaagaaaaaatttattcagcagagagatttctcattgccactggtgaaagaccacgttacttgggcatccctggtgacaaagaatactgcatcagcaggtaaaggaaaaaagcagggtggaaaagaaaaacccattgtggatattgctttcgcatttttcttcaaacccactgcgtcaatttcttgggcttcagacagatttctttgccacattgtgccctctctgggggcaggggtttgggagaaagagaaaaaggaaaaatgattttaaaggagaacattttaaatattgaaaacttcaaacattggtcatcttgctacacagagtatcactaacatactagtatagatttacatttgtattcgaaatttatttatgcatgtatgagtatgaaagtatgtaataaaaccaaatggatattcacaaacattttgtaaaataggtatgatacatatatacatttagattttgtaaaatgaggatcatgtattaccctttaacacttgcagagtggctgctaaaagaattagaggctgtcaggccatttagatttatcagaatctagaccctactcaatgctgtttgaatggttgcagtgtcagtgtagaaggacctcctgaaacaagtcaagcaaggagatgttttgctgtgtggtttatttttgcccgtcaaatggtaacactgctgacattgttcaggagctttcaattatgaagtcattaagacagagtgttggtaaatgtgtcttcttggatgctttttgctcaggagtttctgattgtgttataaattactctactccttcaggctctttttggtatatgcttttatcctttctcacatggtgggagagggagaggcaggtctctggggccttttttatgaggacagtagccccattcatgagtgctctgccctcatggcctaatcacctcccaaaagcccaacccctaatatcattgccttggggtttaggatgttaatgtgtgcattttggggatacataaacattcagacaatagcaggctcccttccaatattttttaaaaactcattctctaacatgcttttatgatctctgtgtccctagctcaactagaagacttttgtcaggttctactccttatagttggcttttatattataagatattgaaagtttttttttttttctgcatcctagtccacattcttgataataattggtgtttcagctgaggacaagcaacacaggtttttccacctcagagctgagtggtggcatgaggatggaggttagggtttgcaaatctataatttgttccaaacagttcaaaatcatttagtgtgaagatgaattggactaactgactaatatcagaagttacacagtttgctgtgtttagctatgggtagcttgagctactcccaaagcaactgagtggcaagaaagggtatctaagaattataaaaacttctcatgtattatgtgtgtagctagtagaatgtttatcatcttgaaagtatgttcttgtcaaagtaaaaatgtgtacttggatttagtaattatttatataggaactttctttttcttctttcttccttttttttttttttcccccagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagtaagtgggtttgcctgtaggtttcttgattctacattcacagtaaaaggcaaaaagagagttgagttggtggtagaagcatcctttcagcattataaaccatcaggaatgctgattcccctactgttgtatactggtatataaacttgtacctccctaccatctaaacacctatatagctttgttcttatttgtagattaataatctcttcctttgtcaactttctaaattttggttttcttctcttctgtttaatgctttcctttatgcattcctttgtcatctttggtctcttaatactttgtttcttcatatgtaccagagatttaaataagagttcaacactaggccccacctgcactccctggctccccacaggacatttccccttggtatatgataacataaacactacataaacactacatacttctggcatccctgaaagtgattatctcatttatttatgtgtgctaacctttttcgctcttttaatcttttgaaaggagctaatactatgccaagtcacacctgggatttgttaccattatcacaaatgttttcatatatgagtgacaaaattgaacacttagtgtgtgtctcagactaatagataattttctctagtgcagggaaaatggtgggactattttgttaaagttaaggaattatagttgtcttttttttttttttcatctctcagtgggttgacttgagttgtgtatgtgactatggatctcctaatgctgatagataagaatatgaactttgggatcagaatgacctgaattcagataatattctgccagtttcttgctctatgactttggaagagttacctctctgaacccgtttcttctgtaaaatgaggttgaaaatagcatctaacaattcttgtgaggattgcattagccaacacttataaagtaattagaaaagtacctggtagagagtaagtttaaagtgaatcatctcataatattgttatgaagattaaggcacaaatttcctggaagctgtcagtgcttgattactgtagctgttttttatttttaccttttttttttttttttttttttttgagacggagttttgctttgtcacccaggctggagtgcagtagcccaatctcagctgactgcaacctctgcctcccaagttcaagcgattctggtgcctcagcctcctgagtaactggggccacaggtgcgtgccaccacacccggctaatttttatattttcagtagagagggctttcaccatgttggccaggctggtcttgaactcctgacctcaagtggtcctcccagtgcagtgtcccaaagtgctgagattacaggcctgagccactgcgcctggcctgtagctgttttttagagtagaggtatatatgctatatttgcattagagctatgattcataaacaacagttgtatgtatatgctgtactgatagaaagtaacatcttcctatatacaattttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcggtgtttgtgtccctgattacttgagattagggagtggtgatgactcttaacgagcatgctgccttcaagcatctgtttaacaaagcacatcttgcactgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagaaggggtggtggccgggcagaggggctcctcacttcccagtaggggcggccggggcggctggccgggcggggggctgaccccccacctccctcccggacggggcggctggccgggcagaggggctcctcacttcccagtaggggcggccgggcagaggcgcccctcacctcccggacggggcggctggccgggcggggggctgacacccccacctccctcccggacggggcggctggccgggcggggggctgacacccccacctccctcccagacggggcggctggccgggcaggggggctgacccccccacctccctcccggacggggcggctggccgggcggggggctgacacccccacctccctcccggacggggcggctggccgggcagaggggctcctcacttcccagtaggggcggccgggcagaggcgcccctcacctcccggacggggcggctggccgggcgggggggctgacccccccccacctccctcccggacggggacctatatacaattttttaacatttggggagttgtggacccttttgaaaacctggtggactattcctagtaaaatagggttaccagagtatctgattcccacagctgggtattaaactcttgctgtattataaagtgaccgaatggaaggaaccttctgtggagagtggggagagggtacattttggacagagaatgtagtatgtgtacaaaggctctgtggggagaaatattgttctagataccaaaaaggcctgattgaagtacaaaagtgaataagggtggaggtgggatgaggcccttatcatttccaaacaaatcttaagcaatggaccaattaagctcttttccaaggattagaacattttgattaaaattaaacaagaaagacttctccagtatgttcagagaggctcatttaactatataagaaggaaagggaattcaggaaggaaatttttattatttattgatgtcaaataaaataaccctggatagtttcccaggtgggtttcgttttttttttttttttgagatggagtcttgctctgtcacctaggttggagtgcagtggcgtgatcttggctcactgcaagctccgcctcccgggttcacgccattcttctgcctcagcctcccaagtagctgggactacaggcgcccgccaccacgcccggctaatttttgtatttttagtagagacggggtttcactatgttggtcaggctggtctcgatctcctgacctcatgatcctcccgcctcggcctcccaaagtgctgggattacaggcgtgagccaccgcacccgaccccaggtgggtttctaagtcattatacctagtctgtaggttgttgttgacatctatttgtagtaggttggtatatttattctcctctgccatcactcaagtatcagggcttgctcatttctttctgcatccttaacaactgaaaacaccccctggttctgataaacacccacatctccttgcccactccgatttttaagactttgtaactgttacccatatcactatggacctgctgtaatgtaatctatcctttgttgtcaatgaaagctgagcatctgtagtcaaaagagaatctctgaatttgggcaacagttgccctccatgggattaatgattctgggtgaatcacaagatagaaacctgggaaaagcagtaagtcattggtttgattttagggatggtagtgtgctttctgtagcttgcttttcccccccatttttctctgaattttattgtttgagaactctttcaaagaaagcccctctagcagacaacattgagcagcgaaaaagaaggaaataatcatttatcatcctaataatgttaagtgagggagatgggacataaaagacttttcaagcacgattttatattttaactttgggttaaccagatggaaggggaaggtagagaatccaacttgataaatgtctttatttcacagtaaaactttatcactcttacaggttgaacaaattgaagcagggacaccaggccgactcagagtagtagctcagtccaccaatagtgaggaaatcattgaaggagaatataatacggtaaggaatgggcccaggttaatactttatcagaaagcaaataacatgcttattgggtatcttataggaacttaaaatggctcttagtgatttccaaatgtactggttctatgccaattcttagacatctcaataacttatgatattaaaatttgttttggtggccaggtgtgttagctcacgcctgtaatcccagcactttgggaggccaaggcgggcagatcacgaggtcaagggatcgggaccatcctggccaacgtggtgaaaccccgactctactaaaaatacaaaaattagccgggcgtggtggcgtgcgcctgtagtcccagctattcgggacgttgaggcaggagaatcgcttgaacccaggagacctaggttgcagtgagccgagattgtgccactgcactccagcctgggtgacagagcgagactccatctcaaaaaaaaaaaaaaaaagttgttttggtaaacggatggcttcagattttttccactgtaacttaaagtattattagtcaaatggctatacaaaggcaacagaatttttaaatgagccagaatttctgtcccgtgttctttcctttcatctccccacgcaaccacttaaaaaataatttagttacagactatgatgtcattgtctttaaacttggataggtttattaaggcattatgaattctctttttcctaatcagaagtggaaaataatttctactatatcatatatgttcaaaggatttttttctgaagattttaatttatttaaactcttgcattactttcttactgaaatatttatttccaagtttgaaaaatgaaatcagattagcttaataagcagagaaaaatatgattaggtaataaatgcaaagcctttttgttattagtcactaatatattaataatttttcaggtgatgctggcaataggaagagatgcttgcacaagaaaaattggcttagaaaccgtaggggtgaagataaatgaaaagtaagaaaaaaatctttattatgtcatatttgtgggattttttttttttttttttttttgagatggagtttctctcttgtctcccaggctggagtacaatggcacgatctcggctcactgcaacctccgtcccctgggatcaagccattctcctgcctcagcctcccatgtagctgggattacaggcatgcaccaccacacctggctaatttttgtatttttagtagagatggggtttcgccatgttggtcaggctggtgtcgaactcctgacctcaggtgatccacctgccttggcctcccaaagtgctgggattacatgtgtgagccactgtgcctggcccattatgtcatatttaatactatttcagttatttacagcattggtcaattatagaattttagttttttgttggtatgtttgtttttttgagacagagtctcgctctgtcacccaggctggagtgcagtagtgcaatctcatgtcactgccacctctgcttcctgtgttcaagtgattcttgtgcctcagcctccctggtagctggattacaggcgcctgccatcacacctataatcatgctggccaggctggtctccatcttttggcctctagtgatctacccacatcagcctcccaaagtgttgggattacaggtgtgagccactgtgcctggccgaattttagattttttaaacctaatttttaccatagttgagctcttcaactatgaagaaatgaaacttttcttccagtgccattcacattagtgtttcctgtttgttttcttttatccattttgaggggagttataatttagaatcctcactcttaaccactgtgttggagttcttccattctcagatttcttagagttttcttatttctttgattttcagaaccgtggacagaattgtcattatctgataagatttttgttcctttgagctgttttgttttatttttaacacattagaacattgccctcagctagagtcacaattttgggcttccctgaaaaaacggaagattttgttctccttaattaataatggtaattaatgatgatttttaactgaataaaattgcaggactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaaggtgagtgttgtgcttgttgcccattagatactgttgtcagtaatactcccagttccttatttagggggcagttgggaagtttcgcagatcttgaataatttagttattttggtgatggcatcctagatgtcctttattagttgtattccagacaagatattattaaggctgctgtacattgtgactttattatgaagatcgacactccgccgggcacagtggctcatgcctgtaatcccaatactttgggaggctgaggcaggcagatcaccaggtcaggagttcaagaccagcctggccaacatggcgaaaccccatctctactaaaaatacaaaaattagctgggcatggtggcgcatgcctgtaatcccagctactcaggaggctgaggcaggagaattgcttgaacggggaactgggaggcagaggttgcagtgagccaagattgtgccactctactcctgccatggctacagagcgagactccatctaaaaaaaaaaattaaaaaaaaaaaaaagaaaattgacatcttggattcacattatgaataaaaagagcttgattaatcaagttttcagcactgttgttgaatagtgtactttatatccatatactctaaacagttgtattttatgtcaatttcatcattaccagtataaataaaatgttctgagtctttttatggcacttatctaggctataaaaggacttgaggatttaggtaatggtgtcagtgtacaaagtagcttaaaccactattcaggccttattacccagtccttagaaaatatctgtcttagaggccaggtgcgttggctcatgcctgtaatcccagcactttgggaggctgatgcaggcagatcacgaggtcaggagattgagaccattctggctaacatggtgaaaccctgtgtctactaaaaatacaaaaaattagccggccgtggtggtggcgggcgcctgtagtcccacctactctggaggctgaggcaggagaatggcctgaacccgggaggcggagcttgccgtgagccgagattgcaccactgcactccagcctgggtgacagagtgagactctgcctcaaaaaaaaaaaaaaaaaaaaaggaaaatatctgttttaggatgttgaatatgttaaatgttatattgaattttaaaatgattttttaaaagtcagtataggatgttaaaactcttcagtatgtttcatgggactagatggccagaaaagaataaagacagctgttttttaaaaaggtttccagaaacattagttgtaaagaattttggcattacccattttccttacattggtttcagttggttacagtaatgggaatctcaaaaagtgatgctagcaaaatttgtgacctggggttatttgggatgtagcataataaaatctcatattttgaattaatggattgagggttaaaaaagattttgaatgccagattgactgattattgagggaatagcagttggttcgtattactatttagaataaatttaacaagactacctctttgaattacatcttgtatgcattgttgcagttgttgagtatctggtacctcaatatagcttgagattggatgcacttaatttattcttaaattcatgtctcagtggtttccttaaaaaaaaaaggctaaaacattgaatggagttgtactttaaagtaaggggtacagctgggcacagtggctcacacctgtaacccagcacattgggaggctgaggcaggaggatcacttgcccaggaattcgaaaccagcctgggcaacatggtgaaaccctatctctacaaaatatacaaaaaatgagatcggtgaggtggtgcgtgcctctagtcccagctacacagagcgctgaggtggaagaatcacccgaacttgggaggtgaaggctgcagtgagctgtgatcacacactgcagtccagcctgggcatcagagtaagaccctgtctccaaaaaaaaaaataaataaataaaataaattcatggatctttttgtttctgttggacatactcttctctgtctcagccgtaatctaggaagacctctacagacctcaagaactctctttatgcgtgcaattccatcctttctggttttctgccttgcaacttgaaaccaccttggcttccaggaaagaccctgggctctgtttgagctctccctctctgcactgaggcttagaaactgtctctgagcagtaagctggagcagtcacaggactcatctcatttgtttcccttcccgcagggatcacaggcttgcactgcctcttggtcgatgtcttaaaatgtgttgcttcatccctgtctggtttcctagttgtttaaagcaggagggtaaatgtggtccctgatacaccactgtggtataagtggttgtctgcctttacttttaaattagaattccaaggttctatgtatttttttttagagaaaatggattatatttattgtttctagaggggagcatattttaaagattttatctccctgttttagagagtgagaattgtacttctcttattttaaatgcagaatgttactttggatcgcctctgtgtataagtataactgctaggcttttaccagatggcattataaacccttggcatttacataatatattttttcacaattcacagcatattaaaagttctgagaaatctgatagaggaactcatttatttgcttaatccagttctttacaagttcatttgactatggaatccccttgtcatctatacctgttaacatcatacagtatgctttgaaaaatagtcctaagagttaacctttttttccccatggtcttctttaccattttaatggctgcatagtgcagttttacattaagggtgtgaactatagaaccatttcctaattgggatttttttttacttttttttgagacgaagactcactcttgtcccccaggctggagtgcaatggcgtgatcttggctcactgcaacctctgcctcccgggttcaagcgattctcctgcctcagcctcccgagtagctgagattacaggcgcctgccaccacgcccagctaatttttgtattttttagtagagatggggtttcaccatgttagccaggctggtctcgaactcctgacctcaggtgatccactagcctcagcctcccaaagtgctcggattacaggtgtgagccactgcgcccggccctaattgggatttttaagccattccaacattgccactattgagtactacagcaatgttcagttaatacatgtagccttttctgtatatcaaactattactatgttagtattgtatattatagtaaaatatagtaatatatcgtactatatatctatatgttaaattataatatctataatcttattatagatttctaaaggtgggattattgggccaaaaggataaaatgttttatggctgttaatattacctaattgatgttttaaagaaatcttttaattttttatcactgataatccaaaactatcagatttgggtacaccagtattatttttggctgctttattaaggggaaaaaagtgtgtcattgttgataacatcagttggttgatggatggagaagctgcatgaatctttttctcatagtcttaccagacttcacacttctatccactaaacttttcaaataagttaatggttctcaatgtagtagattaattaattaatatctcggattgagacttcacatactttggtagaaatttattactcttatatcctttgtcaattttgacttttttgaatacctttttttttaagttataactttgcctattataactccttacctccatttttaaacagtgtgactatgaaaatgttccaaccactgtatttactcctttggaatatggtgcttgtggcctttctgaggagaaagctgtggagaagtttggggaagaaaatattgaggtaagttcttttcctcttttctcctatgttatatcactacttttttttcttcagaatttaaaatatatagaagacttaaaaaatagtacaaagcattttcatatacccgttatccagattcatatattactaacattgtgccaatttattttatacacttttagtagtctctcattctgtgtgtgtgtgtgtgtgtttctgtgaatcatttgagagtaagttgaattctcctttacccctaaatactttattgtgtatttctatgaacgagggcattttcttatatagccgtagtgtagttaccactttcaggaaatttggtattggtgtaatatttttatctgatttaattttcattttctaattctgtcagttgacccaatcgtatttccttttactttttaaaatcacatttattgatttctctgggttaattataggaaaatgaaaagaaaaaataaaaatttttcactgctcctaccattagtactacttgtttctagcattactctctaatttgtactaacttttctgctcacattttatcatggagtcaaagaaaatgcacatgaaatacactgtttctgtatacacaaataatgccacccaaaaggactgctgttttaaatcattttagggaaaatttccaataaaaccttttgaaagaccaaatttgtgaataagtcaatttttaaaaataaaaagcctattttaaatctcttaataatctttttctttattacatgcactggtagtagcatgtaatatgttggtctattagtaacacattattaacctttttttctgattataagaatagtatatctggctggcatggtggctcatgcctgtaatctcagcactttgggaggccgaggtgggtggatcacctgaggccaggagtttgagaccagcctgaccaacgtggagaaaccccatctctactaaaaatatgaaattagccaggagtggtggtgcatgcctgtaatcccagctacttgggaagctgaggcaggagaatcgcttgaacccgggaggcggaggttgcagtgagccaagattgcgccattgcactccagcctgggcaacaagagagaaactccgtctcaaaaaaaaaaaaaaaaaaaaaagaatagtatatctttattataggaagtttcaaaattaggaaaatatcaaaaaggaaattttaattcatgaagagataactgctattaatatttttgtgtatttccttccagtttctttttctctaaatattttgatgcgtttttatattttatgtatatatatatgtgtgtgtgattttgtgtgagtatgtatgtcttaatgtttttcaaagtttgatgaagttacagttttaggtccaagcttaatattaatgttatgtcatgaacatttcctgtctttaattctctaaaatctccatttaaaaaaaatgtgtaattcttcttttaaggggtgctatactgtaatttgttaagccattctttgattaggttgtttacagtttttcattattataaatagaattgacatcttcataattcattgtttctcagtttattttttgaagatagatttcctgtgtgagtgtgtatatacatgacatacatatataattaaaatttgaaatttttaatatatatttcatatttcttgatagacaatatttaagttttttaaaatttgctttgttattatagaagtataacgtgtttgagttgaagaaactttgaaaaatgtaagggaaagaggaaacaattacttatggagttagagctgtaacagcaattgttagcaatttggggtgattcctttaatttttttcctatataattgtgatactatgatactgtacattaaattttgtaacccatgtttatttttaaaattatattatttatcacaacatcgaagaacacttgttatgtcttcataatcagtttgctcgtaaaaggtagcgaatcatgttttgaactgaggctagcagctggaggaaaaaaaaaatccatttagtcaaccagcaattaaattagtaaggatgctgtcgttccacccttccttcctcctttccttccctatctccttccttctttccttccctatctccttccttcattgcttttagtgaataatgccaaaggaggaaatgtcttttggaagcatttagcaagagaactagataattaccttaattgatcctggcaccttatttgtttcttgcccaagttgtcattcacagtggataacaagatagtattgagtttgggtgtgtgtgtgttttcaatgtatgacagcaggtaattaaatggcttatttctgtcattcccttgctcttttttgttattagttagggtgtactattttgaggtagagatatacataattaagggatgagcttatagcaaaagtgcctgacagcaaggagttgaaagtcatttaccttttgaccagattcctatttattccatgaattttattatttaatgaaagtctacttattaaagagtctctactgtctttcaccatatatgtttgacagacttaatgtttaaaataatgggtctaaattttgcttttgtatcttcttaggtttaccatagttacttttggccattggaatggacgattccgtcaagagataacaacaaatgttatgcaaaaataatctgtaatactaaagacaatgtaagtttaattctcaatcctttccagtaattttatttagttgttgttttttgttgttgttttttttttagatggagtcttgctctgttgcccaggctggagtgcagtggcgctatctctgctcactgcaacctccgcctcccgggttcaagtgattctcctgcctcagcctcccaactaactgggattacagacttgcgccaccacactggctaatttttgtagacgggggtttcaccatgttggccaggctggtcttgaacacctgacctcgtaatctgcctgtctcggcctcccaaggtgctggaatgtacaggcgtgagccaccatacccggctttagtttttaatatatagcttagttggtcacatggtgcagatggcattccttcagtatttcgcgtgccagttgtctcagctgatagatatcagcagctggcaaggaccttggctgcactgcctgctgccccctcatcttcactggcacagggccctacacttagtcaacaggcagccaaaacttactgagtgaaggaaccaaaggcacaacttgagaactgtctatgtttgtgtttatagaagaggaacaataaagtcatcgactatctaaatataatgaataacaaaaaagaacaggagcaatgcacgtttgatcctcagcagctggcactactaagaaagagctcttaattgagttctaagatttcattgcctgatgctacatgtaatgctagtctggtgttattacgtgtaaatctaatgtattttaagtgctttttagtagtcctcccacagatatactttattcataccataaacccccaactgtccaggtgaataagagtacaatatgcaatatattacagtcctttttttttttttttttttgagacggagtcttgctctgttgcccaggctggagtgcagtggcgtgatcttggttcactgcaaccttcgcctcccaggttcaagtgattttcctgcctcagcctcccaagtagctgggattacaggcacccaccaccatgcccagctattctgtatttttagtagagacggggtttcaccatgttggccaggctggtctcgaactcctgacctcaggtgatccgtctgccttggtctcccaaagtgctgggattacaggtgtgagccaccgcgcccggcctattacagtacttttttagcagaaacctgtgaaagcctgtgagcaaactctatacctcacagggtttttttccatatatatgaaatgagggattggataattcatattttttaaagttttttgactgtgggacactggtatattcatatacacacactctctttaatattgactcttaagaaaactgatctttttaacttagctaacactttttaaagaaacgacctcagtaaaaatataaatgatgttaaagaatctgtatgttaaaagcctagtaaactgataatgttttaatcttgaaatttgaatataattaagccatgtatcctatttggaaactactgctttaggcagtaggacagttacaggttggttttttggtaaaaccaagggttttagaaaacattttcttgaatcctctgcaaaaaagattcaaatgaatatactaggataacccataatgagctacacagctaacataaataacaattgtatatatagttgtctttttctttttaggcaaattttctcaaaagtttatttatatgagtatacattagatatcacttttactgcagacaaaaggagaaaatgtcagccattctcactggcagtatattaactgcccctgtctcactgagagagacttcaattgctcatagcagtcagtgaaaccttgaaggtttccttcctaccaagcaaatccattttaaccatatgtattttgctcttttttcaatgttacatttgttcaaatggcattgctagaataatgtggaaaataattttcctaccaataaacctgtcagtagttgaggtcataagtagggtgacagtgttttcggttattttcatagataaagatagtaatagagaagatgaatatctgttactgctcttttgtcatgagtaatctgaggtaaaagcttgtagaacttcactatccctggggcgtgctttattcattttgaatcagtcacttgacttcagtgtctaaatgtccttgattctaaattgtacttacaatgtttattatctgctggcttttgttctctgctattttatttttttttacataaaatatttataataaagatgaagaaggtactcaccatccaaagtcaaggaatgttaacatttttgctgtatttgtttcagggcttttttcttataagagataaaccatcatatatgcagtttataacagcttatatttattgagcacttactgtgtaccaggcactatagagctctacaggtattaacttatttaatccttacacagtcctgtgaggtatatatgctattgtttccccctttttatagatgaggaaactgaagcacatggaagttaagtaactgtgctcaaatcatttacctagggaagggcagatctgtacatttattctcacacaatgtagataccatgctattaactattatcttatgcctatgcagtcttctgtcttccttcacttcaaaaggtaaaactttgaagtcgaagggtctcatgcttacgttcttatgtttgccacctatttatgaatgcatacacattatacagtgttcgtggtttaattgcaggtggcatcctcattatgtagagctctgcaactttttaataatctcttgttttttgagaccctttccacattattacatggaaatctattttaagtgctttttagtagttcctcctatggatacgctttattcataccataaacccggaatcgtcagggcgaatatgtgtaagagtaccatatgcaatatattacagtccttttgtcaacagaacaacctcctgattgtttccagggagtgatggaaccttagacaagctctgcaccccacagcctgagttgcctcatctgttatgacgagattgcactagatagtctagtcagagtctgcgctgaaaatctatcagctcaacagtagagtgcatcagatttctctgcttttggcagaggtagccagagtttgagatttcaaatttatccaaaataatttctacacaggtattttagagtgccagacatttttcttttgctttcaaaaatgttttcagactttgctgggcacagtggctcacgcctgtaatcccagcactttgggaggccgaggtgggtgaactgcttaagctcacaagttcgggaccagcctagacaacatggcaaaaccccatgtctattaaaaacaaaacaaaacaaaaatgttttcagactttaatggtcttgcactatttatcctcaaaaccttatttaaaattacttttaaaattttatttgtattttattttttagagacagggtcttactttatcacccaggatagagtgcagtggtgtgatcatagctcactgcagcctcgacctcctgggctcaagcattcctcccacctcagcctcccaagtagctgggactacagatgtgagccactgtgcccagctaatttttttttttttttttttttcctgtagggacagagtctccctatgttgccaggctggtcttgaatgcctggcctcaggtgattctcctgcctcagcctcccaaagtgctgggattacaggcttgagctatgatgcccagtcaaaattttaatttgaatgactactcttaagggtcccagctattacagatagcctctgtggagctgagatgatcaaatacaggacgtgaggacaccctgccctttgataatattttccagaacattttggtgattaaagacttgtaggcatctttgccttttgtattttttctcataaaattgagtaaacacttgtagctgtcccttgtctctttgttcctgtttgaagtgaacatcatactctatgttttggttcatgttggggagtctttagcctaagtagctgttagcagcagtcattaaagtctctggccatttttccaggtgcggtggctcacacctgtaatcccagcactttgggaggccgaggtgcgtggatcacctgagatcaggcattcgagaccagcctggccaacatggcgaaaccccgtctctactaaaaatacaaaaaaattagccgggcatggtagcgcctgcctgtagtcccagctactcgggaggctgaggcaagagaatcgcttgaatccaggaggcggaggttgcggtgagtggagatcgcgccattgcactccagcctgggcaagaagagcaatactccatctcaaaaaaaaaaaaaagtctctggtcattttctttttttgagatggagtctcgctctgtcgtctaggctggagtgcagtggcacgatctcggctcactgcaagctctgcctcctgggttcacgccattctcctgcctcagcctctcaagtagctggaactacaggcacccgccaccacgcccggctaattttttgtatttttagtagagacggggtttcaccgtgttaaccaggatggtctcgacctcctgacctcgtgatccacctgcctcggcctcccaaagtgctgggattacaggcgtgagccactgcgcccggccagtctctggtcatttttgagttggatttttaagaaacagactggagaaatgctctaagctgtgtaggaagaggaggggagaaaaatcagcttaattgcattattgtatttttttttgccttaggaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtgggtcatctacacttatacagtttaaaatgtttaaaatgtgccacatagaagcacaccacccagcttatacatggcagatgtaggaccctgagtttgatgatgattcctcaaaagagggctttgtctctaaaaattagtttttgtctttcaatactgattgctcatggtatgaactggaggcttccgtcatgtcgttaagtggtaaaaattatgagagtgatttatagagctgtgccttaaatattttatttatcatatcttctaaattattttcatggcaatcagttaataatggaagagcttcaatcttagttattccacagctatcttgaggctaattgatactgtctgcctcttcagcttatggtatcagtgaatgagatttgaaaatgatgctttcaaaagatcaaatgacagtagaactagaaattgaccaatctaggcctctgggtgtcagtgtttcttcgctaccagtgatcatccaagagttgaatattgtaatacttaactgcataggaatggtaagccaaaaatgtgtttatattggagaacttgggaaggtgtgggaggaggcacgtcatactataccagcttatatatggagttgaaaattgcagtgattatctgttgtagccagtggcttccaaggtgtacattgcacttgcaaacacgcacacacacacatatgcacattgttgccagatttcatccagcagctccatgactggttgttctgtctgttcatggttgcttttgtacaactgaactcattgctgagtatgtggaatgtcagctttaagacctggaaaaacattttagctttcttttgctttgtcttctctgtgatcgagaatcctcctctattaataggcacctggctgggatataagcctaaaatattaacatgttgagagattagggcatcatttatttctttcatttatagaaagctgctgtttttgtgacggaaatagaattaagcttcaaaaaaatataaaaactgaagtcttgattaatgcctttaatgtgcaatagatcttttattcagtgtaatgactcaaactgcctgtgttgggaaggagccaattaactttgctttcttgagtacattagtttcccagggctattgtaacaaagtaccacaaactgggtggcttaaaaatagcagatatttcctccctctcagttctggaggcaaaaaagtccaaactcaagatgtcagcagggccaagctccctccaaaggcactagggaagaatcctcccttgcctcttcttctgtcttctagtagcaatggcaatccttggcgttccttggcttgcagatgtatcactttaatctctgcccccctcttcacatggcctcatcccttgtgtgtctgtgtccaaatttccctcctctttcttataaagaaactccagtcattggattagggcccactctaatccaacatgatctcattttcacttgattacatctgcaaataccctatttccaaattcacaaatactgggggttacgacttgatcatgccttttagggttatggggacacaattcaacccacaatagtgagtatatttaaaaatgtagatgccatttcaagatactcacaagcttcaatagccatttttgatagggacgaaggaaaagacgattttattgtcttttgtatatgagtgtctaattttttgtctgaattcagctctcagtgggcttgttgaaagactgctgtgtgctggcctctgaccccctcaggaggctattgtgctgtgatccagcagcagcgtacatggcagcatctggcagggtgactgccagctgagcagaaggatgcagtgaggacacaggacgtctcctgaagcccatggctgtggggaggtcagccaaaggcctgttctccttggtatgcctggcacatttgaggctgtgcatctccatctgttggtcctcttatgatgttgaagctcagaggctgaatgttctggtgctttgataggactctgatactttgttttccccaagctgttggctgattaagaagataaaaaaaattgggtgaaatcgcactctgtgaacacacttctcaagctgtgtacacagtgccgtgctggacactggggacacagcagggatttgagataagcttaggaggagaggaggcagctaggtgatgtgccagttaacaattctgcctgacgggtcctaggatcagggtagatataaagtgctggaggcactggggtgccacatttgtggtctttgcctcagggattcttgtgatctgtttttttactcacagagcacttctgaccccagatttgtgggggttttgctcacacgaccaattctccagctttctagacaccagctgggtgtctagaaacaaccaattgtctagaacaaccaattctccagctttctagacaccagctgggtgacctctaatgtaactcaattctgataccagctgcctggagttagcatcagatcctgcaagggctcattcccataagactgcctccactgcagaggccagtgtcaagcccaggcctcctgtacttctgacctaccagctataaagtcaaggggttcccatgataaattgctagcatggctcacagaactcaggaataaactttacttatatttacttgtttattataaaggttgcaactcaggaacagccaaatggaagagatacacagggcaaggtggttgtggggaggcgggggacaacagagcttccatgtcctctctaggtgtggcatcttcccagcaccttgatattcaccaacctggaagttctccaaaccccttatttaggggtgtttatagaggtcccattatgtaggcatgattgattaatcattggccattggtaattacccaatctcctgctccctccccagatgtaggggaccagaactggggctaaaaattctacctctgatgacatggttggttcctctggcaaccagctgccatcttgaagctatctagggccccaccaagagtcacatcattagcataagctcaggtgtggttgaaaggggctcattatgaatagcaaaagatgctcatctcactagtgtcactcgggaaattccaagggttttagaagctcccttgccaggaaccagggacaggatggaagaccaaatacatatttcttctcatttcacaatatcgtaggatgttggggcaggatgattctggagggagttcttacctaagactagaacaatgtgtgagtgttagctagtgagagaacactgtacaaaaggcctgggtgggaaagcggatggctcattcaaggaactgaagaagaccctcaatattggcatagcttaaagagcttagagagttaaaaatatatatttattttttatttttttgtatatatatgctggagaaacaggtgggtaagtgatggtcttgtaaactaaggaagggtattttgactgcctttggggcattgtgattcagccaaaaggtctaaagcagggagtaatatgatcaggtacattgttcagaaacattcctccagctgcaccgtggaagcgggactgagcgagcaagtgaagtggcagatccagttatgtggctggtgaggtgcatgagaggagatgatagtggccggaggtgtggcagtggaaatggagtgacacggttatatttgagggcagagttgatagtacttggcagctggctgggaatgggaagagggagagctgaagaccactcaggtttgtgtcctgcagcaggaagtaatagcaagagcagactcgaggtgacagcgaggacgaaaccactgatgtgtgtgagggcctgctgtgtgctgggtactgtgtccctgcctgttgactaacttagtcgttgtgagcaccccatgcggtggatgcggtagtatatctatttgacagacgaggaaaccaaggacaaagaggttgagtaacttgcccatggtaacccagcctggtcatggccgagctgggattcaaacccaggcagcccagaccccaaagcaccacattgtgcagctgatacttcatctccacagactgtcctaccatatttggcatagaatttaaaaatggaaatgattcttggtagcaacacgaatgtagtggagacacacagacctgggttgtaatctcactcagccaattcctcttagtgagacctggccataccacccaggttttcagaagcttagtttccacattaaataaagtaagaggccaggcgtggtggctcactcctataatcccagcactttgggagcctgaggcgagtggatcacttgaagcccggagtttgagaccagcctggccacatagcaaaacccaatctctaccaaaaataacaaaaaaataactgtgcattgtggcgtatgcctgtaatcccagctatgttggagaccgaggcacaagaatcacttgaacccaggaggcagaggttgtactgagccaagatcacgccactgcactccagcctgggcgacagtgagaccctgtctcaaaaaaaaaaaataaaacaaaatggcctggctcagtggctcacgcctgtaatcccagcactttaggaggccaaggtgggcagatcatctgaggtcaggagttcaagaccagcctggccaacatggcaaaaccttgtctctactaaaaatacgaaaatggcctgatgtggtggtgcatacctgtagtcccagctactcaggaggctgaggcatgagaattgcttgaatctgggaggtggaggtttcagtgagccgagatcacgacactgcactccagcctggagcgagactctatctcaaataaaaaaaaaagtaaaataaaataagggaatatctaactgtagggttgattaaaatgcaacctgtaaagtgtgtaggagagttcctggcatttaatagatgccgaatagctgcacctgttagctgttttttccccaggatattatagatgtggctgtggcttgggaggggagacgatgtggctggactgaaaggtcatcatgccagtatttttaatgggggttggagagagatacatattgtgaaaaagctccagtgattttttttttttttaaaccctggttgtgaactacttgcgttgatactggattttgaaaaaccaaaggctttaaactcctggttatggacattttaaaaaattatttttaattgacacaataattgtacatatttatggggtgcatagtgatgttttgaaacacagagtttatagtgatcagattagggtaattagcctatcaatcatctcaaacattgaccatttctttgtgttgagaacattccatatccttctagctatttgaaagtatgcattattgtttaactgtagttatcctaaggtgctatagaacatattcctcctatctagctgtagttttatatcctttaacaaatctctccctatctccttctcccaacccttaccagcctctagtaatctctgttctactttttacttctgtgagtaagctagcacagccactgtggtcaacagtatggaggttcctcaaaaatctgcaaatagagctaccatatgatccagcaatcccactacttaactgggcatttatcccaaggaagtcttttaggggttcataggaggaactcttttctctgccaaatgctgggttctgacttggatagtatttggatttgctactggacccactgtttttatcgtccagacatattctgtggggaatgtgatattctgtggggaatgcggttcagaagtggtccacagaatgtttgttattagtccataatgatagaaggctagaaacgaagaagaaagtttagaaattttaacaataatttgacagtgactgatctagtaataaacaatggtgttttaattttacatgccttttaaaatttcatttccccagtacattgtcagtgaatttcacaagtgttagtccagtggatgaattagaaataataataatttttaaaccagtcctgagtactactttaaactgagtgctcaaaaatagctgcagctccagagccagctgtggtaggctggcacagtgactcactttggtaaaaatcctgggcaattgagagcagtctttgactctgaggagtaattacttacaaaagttgacaaattccttagcaaagtaatttccaaagggaattactagaattctagaattgctgtaagaggagaggctactcttgtttgtcctgtgtgagagggattctcagcgcctggggcattagcaatgcatttgccgtattcagtgtgagatggggttggtggtcatttattctgaacacctgagccgcagtcattgagtaggaaacggattacacatagttatgaagttcacttgtagaggagaaaaacaatagttcaagaggaaaacatttgaaaatacttccttgtaatgtcttaaatgaattttagtgccaaatattaaaagtttttgtgttttttgtttgtttttaatttaatagtcaatataatcccactctaaagtgagggagccttctgcggctggaagtggtggggacagataagagtatgtgaggtggaaagcctccagcagctcctgacccttgtacgagtcctgtgtgttgggatggaagggcatggaggctgccccttctgctcattttttaaaaatacatgtttttataaaaattctaaaacagttgtgtacgaatgaaatctgtcaattgacccaagcagtttttttcatttatttgagatagggttcctgtcacccaggctggagtgcagtggtgtgatctcagttcactgcagccttgacctttcaagctcaagcgatgttcctgcctcagtctcctgagtagctgggaccacaggtacatgccactgtttccagctaatatatatatatatatttgagacagggtcgcattatgttgcccaggctggtctcaaactcctgggctcaagcaatcctcccgccttggcttcccaaagtgctgggattgcaggcgtgagccacggtgcctggccagttttttatttagactgatcaacgatggcagtttggcttcctccatctttttaacataagaacaacatcaatatgagaaaaaacagataagagctcattttggtggatttagttttgtatccacatctcctacaagttctatttctaaatcagtttctgagaaatagaacccaggcttgcaaattgataagcctggaatttgtttaaatgtattctttggctctttatttttttcctcattataaaaatggaaaagaaagcatgtttgaattgcccttaatacccctttctaacacagttatttttattatcatgtattgtttccccgtcctcatctgtactcctacattttttttaaacaaaggaattttattgcctttccaaaaaagttgtactagtttataatgtcaccagcattgcatataagagtgctaattaaaatgttgcaaaattcagtgtcaatgttttttctataatgagtataaaaaggataactattggccaggcacagtggctcatgcctgtaatctaagcactttgggaggccgaggcaggtgggtcacctgaggtcaggagtttgagacaagcctggtcaacgtggtgaaaccctgtctctactaaaaatccaaaaattatccgagcatggtggcaggtgcctgtaatcccacctactcgggaggctgaggcaggagaatcgcttgaacctaggaggcagaggttgcagtgagccaagattgtgccgctgcactccagcctgggtgacagagtgagactgtctcaaaaataaaaataataataaaataacgatttcaaggattttagcatatctttgctaacaatgatgagcctctttcttcttataatgatttttttttttggatatgaattatccatattttctaatgcatttgtattttaaaactttttaagatactggccattagtatttggtctggatttttttgagaagtaaaggctttgtcaccctctgaggctaaaacagactaaagacttttctcagtattgttcctcccttacacaaaactgttttcccccttattcacaagtatttttgtttttacgtacaggcaatcttgagcagtagcaagtaaagattgtctaaaactgtcaagtccacaaccatcaaatgtttgcaaggatatgaaacaaggagaacttgttagtcactgcaaatgagagtataggttggttcaggtaccttgaaaatctagtcaagccaaagtttcacctgccctctgactcagcagttgtactccagctctgtgtgcaaggagatgtgctggaatgtcacagcatcgtattgcaaagagcatattggcaacagcttggatggccagcagaaggagcccaaatgtgtgattcatattcactagtcgaataattgaatactacaatatacaccatatatactacactgtatgtgttgttctatactatagtgattgactcgaactccattcagtgaaaaaaatggaagaattagctatttgtatccatatgggatacaaaaaagcagggtaacaaaagaatctacatcatcttgccatttgcaggtaaagcttcttaaaaaaacaagagaaatgcaggaagaaatgcctaggaatgataagaccaactcggtggagggaaaggaggaaaaggccaatggggtggcacacacagggctaactgggcactttatacccttctttatatccaaaatattttatggtgaatttcttttagagggttgacaagcacctgtgggtacctgatctgttttaatcatcctcatgctaacaaaattcttcagtagatataacctaaattttttttctctttcatcttggttttaaaatgtcttcccccttttattctctggagaaatagaagatatccttgatcatactacttctctgttttattcattttggtagtcgcctaagatggttttaatgcatatggcattatctgaactgttccctgttacctcatttgctcaggcatctgaagatgttgtgctttctcttcccctgcaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataat

SEQ ID NO: 35820 - DNA, 5293 bp, Homo sapiens
tctgctctcccagcgcagcgccgccgcccggcccctccagcttcccggtaaggcggtgggggcgcatcccctggcgactcctcccgttccctcttccgcttgcgctgccgcaggtgggcccggtctgtgggcgccccccgatttcccgcaggtcccgcgcggcgtcggagcgggagattcccttgcagcttgcgccccgcgggccttcgggctccgcagagggacgccggccctgcgcggggcggaagcggccgggaagccacgtgtccccgcggccgcgcgtggtgggggaggagggaccggcggcgcccacgtggcctccgcgggccccgccagagcctgcgcccgggccctgaccgcacctctcgccccgcaggaccatggccaacctggagcgcaccttcatcgccatcaagccggacggcgtgcagcgcggcctggtgggcgagatcatcaagcgcttcgagcagaagggattccgcctcgtggccatgaagttcctccgggtaactcgcccccgtctccccttccccgctgcagccggctcgcgggtgtttttccctcccggcggcggtttgtccgcgtctgctttccgagttcatttcgctgccgcgaaatccctttgccctctgcccccgcccacggcggcttgggcccgccgaccctttcccggggtggtggggacagacgcccttgggaaggtgaagcgctggtagcgtgactcgccctccgggtttgggttccttcccgcgggccgctacctgcccacccgccgcaggggggcagcagggagcggaaaaaccccgggccccagaccccctgcgcctgcccactcgggtccacctaggcacagaatggaggcttggaatctcctttgctttagtctgaaactccgagttccagtgcggtgctcctcctttagcatagggtagtgagtgtattttccacattaaatttggggcacagatctgaatccctacacttacgggtaagaatctaagtactgaaattcaaccaggctcatcggtgaagagaatgttctcagttattatctgaaatatttaaaagggcattgtgagtagcccaggggagtttaacatgacctctgccaggcagatgacctgacatatgtacttcagttgcagccaaaatttaattccctaaatctagatcctcaaaccacctactttttaggcttacaaaacccctaatgtcattgacggtatgagggtgtctttacgattagaacagtcttggccaggcgcggggctcacgcctataatcccagcaatttgggaggccgaggtgggtggagcccaggagttggagatcagcctgagccacatagcaagcccctgtctctacaaataaataaataaataaataaaaattaattgggcatggttgagtgcatctgtagttccagctacttgggaggctgaggtaggaaaatcacttgagccctggaagttgaggctgcagtgagccatcattgtgccactgcattccagcctgggtgatgatagtgagaccctgtctcctaaaacaaaccaaaacaacacaccaaaaaaagaacagtctttctgttaaaatggcattagtttcatggtttggatgggatttaaaaaatatttatgtgtgtgtatatgtgtgtatatatatatatatttccacacaccacttaggaacgtgggctagaatataaaaccggacttgctaatgggaggttcagaggatgggttggagtctttccagcttagctcctaactggtgcctcctctccaatgccaggcctctgaagaacacctgaagcagcactacattgacctgaaagaccgaccattcttccctgggctggtgaagtacatgaactcagggccggttgtggccatggtgagtgctcgtggggaatgagagaaaatgaggaaaaagtgctcagtgttctttgttagacatctccctcagctaatctaaattttattttatgaatggaacctgctgaagttacttaactgagcaactaggagcttgggaggagaaagcaaatcagaccttagaaatgggaaggatgttagctgggtgtggtggtgcacggctgtaatctcagctacttgggaggctgaggtaggagaattgcttgaacctgggaggcggaggttgcagtgagccgagatcgtgccactgcactccagcctgggcaacagagcgagactctgtctcgacaaagaaaaaagatatgggaaggactttttcaggtacatgtctctatggttaaatagaatctcactgcctgcaagagtggtaaattttcgggccaggcttggtggctcatgcctgtaatcccagcgctttggaaggctgaggcgggtggatcacctgaggccaggagttaatcccagttactcagggggctgaagcacgagaatcgcttgaacttgggaggcggaggttgcagtgagccgagatcatgccactgcactccagcctgggcgacagcaagactccatctcaaaaaaaaataatactcaatttcttctgtttgacaagtgttttagaccttaatgtttcctagattaaaaaactttatcctattttctcatgaaaaattcaaaggtaaggatgtaagaagttctcaatcctatactagaagcagtttcttctggatggtgctaatgtccatttgggagtggagagaatatgaggagagagtggctgggcgaggtggctcacacctgtaatcccagcactttgggaggccgaggtgggtgcattacaaggtcaggagttcaagaccagcctggccaacatggtgaaaccccatctctactaaaaaaatacaaaaattagctgggcatggtggcgtgtgcctgtaatcccagctactcgggacgctgaggtgggagaattgcttgaaactgggaggaggaggaggttgcagtgagctgagccactgcactccagcctgggcaacagaacaagactctgtctcaaaaaaaaaaaaaaaaaaaattggagagagtaaaatagggaggcagtgaaattgttgagaaagtagatctatttcctgttcacctttttcttccttctgctgttccctggaatccttaccctagcatgttagtctttcttttccctcttctagcagtcttctgggatgcccttcccactgatcctattccagactggccactttctcctttcttcaccagttcttctgtgttgatggctgcataaggattctgcaacattgtttatctctgtctcagctaaactgggaagtccccaagttggacagacttttctttgaatcctagcaatacgtttggaatgcagtttttatataggcccctactctctgctggggttagctgataatcatgtcactgatcggtctcattgatgtgtcgtgtcaggtaggagtaaatgttagaccctacctgtcctgagtggcaggtctgattataaatccattttcacactttcgaggtctgggaggggctgaacgtggtgaagacaggccgagtgatgcttggggagaccaatccagcagattcaaagccaggcaccattcgtggggacttctgcattcaggttggcaggtaagtccggggacaggagggtggatgacttttatgcaacaccatttaaagcagacgtcatggcgtatcctactttcagaagaatctgtgcccttttttttttttttttttcttgagacggagtctccttctgcctagctggagtgcagtggtgccatctctgctcactgtaaccttcacctcccgggttcaagcgatcctcctgccgcagcctcccaaatagctgggattacaggtgcacactgccacgcccggctaatttttgtatttttagtagagatggtttcaccacgttggccaggctagtttcaaactcctgacctcaggtgatccgcctgcctcggccccccaaggtgctgggattacagacatgagccaccgcacttggcctgaacttttagttggtgattatcattgtataaaaactttcaggctgggtatatcattgtataaaagctttcaggccaggggtttacgcctgtaatcccagcactttgggaggccgagatgggtggatcacctgaagtcaggagtttgagaccagcctggagcctggccaacatgaaccccgtctctactaaaagtaaaaaattagggcatggtggtgcatgcctgtaatcctagctactcaggaggctgagacagaagaatcgcttgaacctgggaggtggaggctgcattgagctaagatcacgccactgcactccagcctgggcaacaagaacaaaactccgtctcaaaaaaaaaaaaaaaaaagctttcacacatagcttcttccctaggttacttaattttaagcaagacaacaagggagccataagtggtaattcctgtgtagtacagcaaaaaatgctaggtgtggagaagggaagcattctagccacatccatgagtactttgtccatgggtgtgtcacttaaccttttgattccctcacctgtacacagtctgttcaaaacctttacaaagttgtgaggttgaagtgggataaagggatttttattaataagcagtgttatgtcatggttgggctttgcaaatcagtgttataagaaaatgcagcagagctggcctatgataatgaacacatcatatctagttgggatgttgatctgcagtgggtttgagtatcactgtattttccaaaatttgcggaggagtgttttatgtcttcggcaatcttggggtacaagcactcttttgatggggaggccagacttggaagcataatacagttgaaacaaggaatgttttaaatcaagcacttttacagttgtatagctgcttttaaaaggaaatgctttgggggtataaattggtctgttgcttcaagtggcaatttggctgaaagagtctggagtgctgtccattgcggtacccattaaacagacttttgcactttaaaacatggcaacttgtaattgttttctttcttaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccgg
